United States Patent 9,328,346 (POLYCOMB-ASSOCIATED NON-CODING RNAS) - sequence listing, part 29

SEQ ID NO: 4884 - RNA, 114339 nt, Mus musculus
cugccgggcgccgagcgccgagcgccgagcgccgcccgccgagcgccgcgucuucccgcgccgccgccccgagcuccgcccgccgcgcgcuccgcccgccgcgccgccaggcugcccggcggccgcccagagcgaggaugcggcggcgcucgcggaugcugcugugcuucgcgcugcucuggguccugggcaucgccuacuacauguacucggggggcggcuccgcgcuggccgcgggcgggggcggcgccggcaggaaggugagugccgcgaggccugugcgccgacccgggccugcagcggggaggcgccgugcaccgagagugcuccccggcucggggcagcagauguggggacccuggccgggacgcgcgccucaaguuuucuccgggcccucaggccagcggcgcgagcuccggcccuguccggcucacccgcggcucugggugcagcgacuugccucccgcaugcggggcgcgggcacccggagccacguaccgcccugcgccaggaucuuggaggcuguuaucucgcuggcgacacugcgcuccacucccugugccgggaucauagggacaacccuuccgccggacucccugcccccugcuccguacuccgcccagaucaccccggagccccacucccugcuccgggaucuuggggaucguugucacccgaaacccggugcuccccgagccacauuccgcccaacuggaacccgcgacccucucgucuugcgcccagaucuuggggaccuuggucgggcuggaacccuggugcuccagugaucagaggcgugaucccucccuauccuccccauccagcaccccggcagugaggucguaccgugguucugucagaccucccguucuacuugcuacacugcccaccucggcccuuggccgcucacggcggcgggaacuaccuagccuuuugcgcuugcauuuccuaaccccaaguccgcauuuccuaaccccaagucccuccucggugugugucucugguggguucgguagugaggccgggagucuuagagcuuacagguucugauucggcagucaucucggcuuggguaccgaguggacaccgagcgagcgugggauccuugccuugguuggugcugucuaggcuguuguauucucuccugagggguuugugguguuuuacuagcuaacgagcuucgaaauauaguuaucuuuuccaaagauuuguagcccuccuuacuugauuuugaguaacaguacacgaccagaaaagaauggagguagaucgcggcuuagggagauaggggguagaaucuugaguaggauggacugcccaugagcagccgccgacuuuaccccuacucagacacugaaugucaaaggcacauggcugauucccuuuuucucuggcaucuucaaguuauuccuagcugcagguacggagggaggaaggaagggagggaggaagguggaagugucuuuuugacucugggagggguucaugauucguuuuuuauuuucaguaacgaacauggaaacaguguuucccugugccuggcuugugugggguggacacugacucucauuagcccugcuuucugaaugguuguugugcugggagccccugcuugcuaggguuuaagucuagcaagcguggcugguggcagcagccagguuuuugagaaccauggugacucugagcaagugugguguguacggacuuugcuuccccaggagacuucccucgccuugggaauacccuggcugcugacaaugcuuuuuccuagucacacaaagaugaaguccuggaucagcacagguauguauguagaaaggcaccuguggcaucagccucccagggaugucacccuaccucugggggugucuguuggcaagcaguuggcuugucuccucauuaaaguucucuggaugccuaagagguauuagcuuuaggugugaagaaagcccaagaccucuuugugauccgauggagacccuauagaaagagcagaucaaugaccugggguucuguugucagugagccauaaaauguuguccuggcucaggguaucaugguuuagugaucugcagggcaagggagugcugugaaaacugcagauuuggggcuggugagauggcucagcagguaagagcaccgacugcucuuccgaagguccugaguccaaaucccagcaaccaaaucccacaaccaucuguaacaagacuggaugcccucuucuggugugucugaagacagcuacaguguacuuacauauaguaaauaaauaaaucuuaaaaaagaaaacugcagauuuugaaauuucaguagugcucccauugagguagcaagguggauccugagagagagacagaggaugccgccaaacuguggagugccaucuuggaucccuuaguggguuuaaacacuagacgacucuccacauuuagcucauccccuugauaagagaaaaugugcgauuccuuuagcguguacaacaugacugugaggauaagaagagcagcuuuacugagagccuguagauuuuuuuuuuuuagcgauaaguagauggcauuucuucuguguuuggugcugaucacagcgggcucuuguuccaucuuuagauaguucuucaugcucugcuguuucauucccaaggggccccaggcuucaggguugugcuuuggggauugucugagggcauccuguuaggauuucugcugcuucagcagccaggccaggcugugcacugugugcccugccugcuaaacaacaagucugagaacugcuguucuccauuuagcaaaacccaggaagucagcucaccucagacuacagacugaauaaacuaaggagcugaaaaccagcugucagcauuugcuggaaagcccggacucgaugcugugauuccgcagggcagaggcuccacguuaaagcaauuuaugcaugauguuuaaaauugcauuucauuuguauagguaucucccccugccauauuuacucuugccucccuagaugaugauaugcacuucaagaaugccuuuccuuugagcaucuuaaaugcuuuaaaauuuuaaucacguuaaguuucccuggggcccugguaugcuggcaguggauggcgcugcauaggagggaagggauuucuguugaaaggaagcugccucuggcugaagggaagccacaggaaggguucccagcagugagcucagccgagagacugagggccccuucauggacugccuaagaguuugagguacugcucuuccugggagcuggcaccucugcugcacucacucugggccucaggugcagguguuuggggguuaggcaggaagcauuggggaggggcuucucuuggaacuacagagaaaccuuuugugggggacacucauugggagaacaguagguucuaaaagcagagaagggacucgggccuaugcuguccuguagagggcuucccauggcaagcugacuggcucacuuguucauauggcugauuuggaggggaccacuaccaccuugaguagaaaguuaggcguacaaguggacggugauagcacgguggccccaguggugccggggacaucucgcuuucuuuugcucagugacccuuccucagucgcugcucaucucugucucucugcucucucaucaacguugggagaguagcauccuuauaucauggcuuugcuuauccuuuuuaguuuauucuuaggauuauaugcuauuaguaagugaucaauaacugauacaaaaagaaggaaagaaagaaacgagagaaaaauccccuaaccccagaaaauggagugagcuagaauccugugaggccuuuguuucuggcaaacuguacacccuggcgucgucuuuguguacuuccugacggacaggucugcaagguuccuucagauuugcacugaaccuugggcucuguuaagucauuuguggggaaaccuaagggacaccagcuguggacccagcuguagugacauaaugggguucccaguagccgaagugggugaggugugcacccuaacuugggggaaaguccaugaugguuagaguccuggagcugcuccgagucuuggcaggaugggcuccaagcuccccacccuucccugaucccugguuaggaggaguagcuggguuuaucuaaggcugaccagaggcugccacaccacuguccuauguuggcaggguaccaaugauaggcgugcaauuuaaagaaaggccauuugcacuaaguaugacauagaccugccauccugguacuuagggguggaagcaggaggaucaggaguucaaggucaccguuucuuacauaucaccuucaagccuaggcugggcugggcuguaugagacccuguucuaaaacaauggugcggggugugguggggaugggaagauugucagggaaagcccagcguagccucauccacaccucuaagagaagccuccauaagggaaauaaagcuccagaauucuguuguggcugcccagggcagugcaaucacauuagacacagauugugacccacaaacacuagaaagauggcaaguuaugcccuggacccuccagcaaaggugaaaaugaaccuguguaccaguagcuagggcccucauucugcucggcuugccaggcgagcugcgguggggugagagugccgaggaccugcggggacagggacaguuuuucugaggcuuuuggucugauggaagaaagggcguguggggugggguggggguuggggguaagggauggggucguuugcugcccuucauaucuaaggagggguaugugagagacgggcaugcacguagcuucccugcugcugcccuagucucagguuucucaggaucaugaugucagcccugcucaaagucauuuucagagguagcugccuggucucuguggggaggcucagacagagaccaggaaggcugcagggguuucuggggaguucuuggacagucuccugcagguucagguaaaugcacagggggagaccugggccuugacacagccugcucccugaggcuuuguccuucuuguccuugucucccucugcagccuguuugagagauuggcuugauggugacacugagauuugcuggugagaggagagucauguauguagccgggccagacagucugguggccacuguuuuuuuuuuuuaagauuuauuuauuuauuucgaguacaccauuguccucuuuagacacaccagaagagggcaccagaucccauuacagaugguugugagccaccauguaguugcugggaauugaacucaggaccucuggaagaguagucagugcucuuaaccccugagccaucucucuagcccaagccacugucuuaauuaagcaccuagagccccacgggcucuaguugcuuguuucuuccugcccaccugccccuguauuuuugagaaagucagucucccucuugucucccuuuccacauagagcagcuaagggugaacucugucacccacuaggguuccugugcccacuucccugucguaucagguacugaguguuggaaugcucaccucuugucggugacuugaggucuggccuugccuugagcagaggugcuugucuacccacauggucucagcuccuuccugccgaggucucuuuugaugcaagaccucaguagugcuucccacaaaggcugcccaaggagcuugagaacaggccgggccaggcgggcagcuugccucccuggaugguuacuguacucugauguaccagagaagcucaccacagcagaacuugaccuugcucucucugggucggaagacuuccugaccuuuggccugagcauuguauucgggaccaacuccagccucagagguucuccugggaguauauaccuuagucuagaaggccuuucugucucacuucccagagacuaugggcccauuuggaguggaauaagaggaugggggaaucaggcuucaacaccagucagcucaccugcugagacugauuuuuuuaggcucccauccuggaguggguuugugucugggucugccaguacccuccugacauggcuuggucuguaaagcugacuuguccauacuuagucuucuccgguacgugggccuaggaagcaugugucauguugcacagauuggauuucgugucagcaggcugacauguagacagucgugauucacaggggcuggguauguaggaaagcagacccucuuauuugaacucucauuucuggagccauaguuugggcuuuccuaggagccauaugucaucccgaggcuggugugacaaaacuucaguggacgguggcugucacuggccaagcuaaaccugucgcccauggcccagccuauccuugcaggcugucauccuggugaaugccccuuuuuccuagaagcgcccugugaaguaaguagucuccuccaggccaccuugcugccugccuccuucaaguugugcagcuccugucucucccaaagaagaggaaugccgggaaauggguggaucagggccauaggauuguagugugugucuuagcaguggccagugguuggagguuucagcuucuugggguccacccccuccacugugggaggcucacagcauugccaaccucugcacacugggugcagcacccucguggguuauaccagaugcuaccauggcauggagcagaacugaccuacaugcugaggaggguacuaguaacuguuuugcugcuucuugcugcaacuuuguggcugggccgucucagaaggaaacagccaauuggugaggucuguggucuauggucuauggcccccuuuaggaguacauacaugauuacuaaguuuuaaaaucuaauagauaccugcuuagcacccacugcaugccauguguguccuuaaagcgacugaagaaaaugaaggguaggaaaggcaagagggucugcgaggguuacagagcuuguggguagacaaucgcuugggcugugguggcaucugccuccugaggucuuccaguugucaggaugggggugugacuccccgagauuccuagaccccuuccuugguugacaguguccuuucccuuacugugguggugacuuagggaggcacccugugcccuguaugcuuaggagugucuaauggcagcugcaggcugcuugccuuaucucagguuucuucccauuuagcgucagauuuacccucuuacccucagguuuuagccugaccugcagcagcuauccuugaugcuccacuggcuaaaguggggugauaccagguucuauuccugucauucucuucccaagugucuuucgagacuccccgugugcagagcguagcugugucuggaaucuuccugggagcccagcccacugcacugugguuggugggguauggggcggacagcagacagaacagcaugaagggcagcaugggaaacggguacaggucuuggccagcaugaguccagccaaguugugaagcccuaggcgcugucuuccuuugcuccugaggcccccugguuccucagugcucaggcccucugucacaucaucuucugcucacuagauagagugaaccagugugaaccaguguucccaggggucacugccuuaacuuugccagcagagugcaucuucuuucacggggaugccccguuuuucucuuccguucacuuaguuaccacaugcaccugguuagaaugccaaaucacccaccacacgccagccccuuccccuccugugguccucaguuuccagagauaccuguaguucugugugugauagacuugcucacuaggcuguguugugggauagacucuggauaccugagcuagucugugagguguagcagggcagcagcguugcaguucuugguuuagguucuuugaaaggacauuguguauuuacagaguuugucccgccguucagagcuuagggagucagucauccuugggucuugagccccugcugcagucaguggucuguuacugcuccauccccggagcagcuggaggugcaggccagagccugcugguguccugcuuuggagcgcuggcacuugguagugaaggccauguccggaaccuaggaucugagguguuuguagagagcaagaugaagcugugaccucacugccuggaguugcuaagggacuccuguagacucccaggggagagcugccugucagcuguguucucagggcagguaucuuugggggagggggugguuacaugcaggcuuucggguacuuguggaggaagcagcuaaaguggcuaccagucaguccaggacaggcucaggagugcugcaguggcuucugauaucuuccuggaaggcucgcccaggugugaccuugacgccuugcuuuggaaaaucagugggccccagaugaaaggucuuucauagcuaaaucaccugggaugggaacccgaggaacccuaggcaaauuaaagacucggacuggaagcugccuauaaauuaagcacuccauaggcguggggugagucuggugcucacagugggaauuguagcugcuguccugcagagcgguguggcccagcauggggugccuugcugccuggcuguccuguucugacugccuugggcuuuccuguugacccacuugcugaaccuuugcuuccaauggucaccuccccuccauccucuccuacccugccugggcugcccaccuucccagcucacucacuccugcucaccaggacauugguuuuucuauguaucacucuugcacacagacacaaaggaggacaugaguggauaucugggggcaggcaacccgaaacauuuucugagucccuucaccuucugcuuuucucaguuguccacugugucaccaggaucauuggugacagcauuucccaagggagaggggaccauaaaagugcuaaggggcauuggcucugccucaaagcaaccuggcaguuguauaauuagccaccccugacucuacucgucuucccugaauccugcugaauucuccauuccgccgagaugccgagccuguggugaugcuuuggggcccuagccuggcuuauagagacuuggggggcuugggggagaccuacuccaguuucucaugaucaaccauaagcgaggaucagcucugaauggaccaaucagggcgucagggcucugcuccuugucaucuaugagagcccaguuucccccugggccucucucucucucucucugacagacgaggcuggccucugucugucccguucccagacuccugauaaauagccugguacuucuuauuucagagagcagcugagaguaugcacccauucagaaaacaugcuggcguguucaccacggaagagguccccuugggugccagguugcggaagggcaaucgugucuuacacugagauuucaguuaaaagguagcuaguguauuuuguggugucccuuuggugggugagaaacacuuagugagguuuuaucugcggugcuuugaaguccuagaagauccugacaggaaagcacucaccguuugugcugauugauuucugccuuugauacccugcuaggagcacuugguggcugagugugaaucaagguaggcacgggucacugucaccuaagcugcugucagcagcucacagcccuuuaccuaacaagacugcuguggccauucaauggcgguuucuugauugcccugucugucugcgucagcacccugccuuaucaugggcaggaagaugaaguggaagaccauuaauaaauguauauuacuccccuuuguuccuccaacaggaugugauugcaaaacucccgcauauuacuucguauuuguaacuggcaguuuuggcaaggacacgauacugcauauuuccuguaagguguaauuccuggugacuucaauuuauaucagccuugacacuguaauuccugaaaggcuccgagccccgccaucugucuugcuucucuguaggcugggaaguuuuuccuuuguacgcauuaccagacugucccccaggucacacaguagcaaacucaggcuguuuuaaggucucagcagcugccuaugacaagggccugggaaauccagcacugggcagcccguuuucaguccgccccggacgcccaggcacagauuccaggucuuccucuuguacccagccacagcuucaggccaggagggugcugauuacagggcuguugccugcuuauccuccaucaaaccugcugauguagaugagcagagagcucaagaaggcgggugucugggcuucuggguggucugaggcccaagccuggcauugugaaaggguggugacugcagcuuaccagccuuaccugagcugguaaagagcugggguggcucauuccugacagagggacaccaagaacacauagcaguagcaucaugcugugaacaaauugaugccccaccccuuuuuaaaaaagauuuauuuguaaguacacuauagcugucuucagacaccccagaagagggcaucagaucucauuauagaugguugugagccaccaugugguugcugggauuugaauucaggaccuucagaagaacagucagugcucuuaacugcugagccaucucuccagccccgauguccuuuguuuuaggaagggauggacuauuuacccuuccuggccugggcugucaucauaucaguaguguuugacuuuagcauuuuucuccucaaugggacaugggcggcacauacugucguuugccuguucuggccucccaagcugccuggguccaggagcagguccaguguggagccugagagcaauccagugguuugcaaacaguagcuucuuugccaccuggccaccgagucauggagaucguaauacuaaggguugcacagaaacucugaaggccacuuugcagggguuggagacaaccuagauacugcacugaagcuggcccugggucccucuguaggacugguaugacguggcaaagaggauauagcaaaguauugggcuugggccuaagccagagugccugcguaugaauucuugcuuccuggguggcucugugaccucagggaagucacuuagucuuugugugguuuugucuuuugccugucucagcaguuuccagugugcagcguguuaguauguauaaacuguuuggauugguccugcugugcgcacagcagaugcucgguaguaugaggcauugugaaggcugcuguuaguguuaaguguuaaaggugggugccaaguaauggcguaugguaaagggagccccugccccauggggaugcugucucuuacaguggguugcuugggaagagcugagaugacagggccugguacccuuguuccuuccucaccugaggaugucaggcuagguggugucccacuguugagagccagugcacagaccugagccuucacuucuagugcuggguuucucaaaaguucuuucccaauuccacccuuucaucccuuguaacuugacuuugaaaauuuguaucaggaugcguguuuuaacuguguaacuauguaauuaaauuuuaaaacucauuguuaauugguuauuucgacaucuugaguuguuacuaucugaaacuuucccacaagguucugauagguaaacagucuuuugguuucaucagugcagcaucuccuugccuuugaggcugugggugaccggcacaggcaagauggacaaauagcugugguagcacagcacagccgcagggcugaggccuggccaugccaauuggcucagcauuuacacauuuacucucagauugcagauuaacaaacuucacuucauaaugauugcagcaaugaguaaucuaaagucuggacguuggugaggaugcugggccugaggaaggccgucacccagcccuuguuacccuggagugacucugggucccugucuguuugguucacagugaagagggccauggugggucagugagagaugaagguggggcucaagggugcagugaggcucccuggcugccucuaccugcucaugugcucugaagggcuuucugggagcagccacagcugaacgggcuggcggauggggaagaacaguggcugucuccaucuuccuggaccaacucccgucuuugggccaccugggguugucuuggaucuaggaaggucccuguuguuacggagacacuguggaucugugaggcuguguuuugaguuggaccuauuuuaagguguuucaaaguauagugucccaggacaauggcagucgaaggccucaaagacuaacagguggcuuuggugagcggacugaguggccacugagcaggguuugguuuggcuugccuuucuggccccagagguguccaggcugcuggaacucgcccaccuugagguccuccagugguauaugcucacaccuuggugguccacucuugauuaucuuauauacacccuaaaugucucuagguggugcccuccacucaguccccugcuucuagccucccaucccccacccccagguccuuaaugcauuagcccaucccugagagcccaguguaggacugcccuuccagccuagccauucuaaccugagugucuguggucaccugugcagggccuguugaccuuucuucguggaaggaguuuuggauaaugaucuucaucugagacuccagucacuccuccugacaccucccagcuagcucuauguccuccugccccaucugcauguggucuuguagucuugggaggugacggacucuaucgaaugugaaaaguaacugaagcggaaauuugaggguucuuuggaaagucaguugggucagaugguguuuugcugaggcaaacacaugaaggaacguuuuguuuaaguggacacaggugugaaaggcuaagcagacucuugaaggaacgauuuugcugaagcagacacaggagagaggauguucugcuaaagcaagcaugugauagcacaugugaugaaggauucuuugcuaaugacacacaugcauuggucugccuuacauugugcaguugagcugccuuugucaggacuccauagagagaaacauaccaaaaaccuucugauggugugcuguaguuucuugccgcuuccccggacaggcugauuggaugcacaugcugagacaaggcacauggaggacacgugauguuuggaggguauaaauaggacuccauggagugacagagacuuggcuugugaguccuugcuucccugggagugucacagcugagaccuuuuccugguguuccuguuggucccuucugccgacuagagccgaggcugaggccuggcugucucugcuaggucaugucaccgcuguuguuaacccaacucuaccaaacuugacugcugguguaucugugagauguuugccaguggaucacagugagcugccgcugccugcugaccugugaacugaacugcugauuuccagacgacacagacgggaguugcuccaaaguaccuuucuucuacgcuacuucugguggguaauggguuacgaggaagguuaaaguguuuaagaaccaucauuaaaaauaggauuuggaaaaaugaaaguuauggguagcugaguguuaacuccauccguggcuauagguaaguuggcauccacgcuaaggugaaucuucuugggggugcugcugauuuggggucacccaugcucuguaauucagccugacacacucauuggauccacuuuggucugguuauuuuuagucuuuuguuggugcccuguccagggguauacauguuuguuuccaucucuccaaggaaguucaugugacacuugagugucucucuucccccaagaggcuucuuucguccccucucagcguugagcugcaggagagucuggcuucuaugcucugucuuacuccaggaagagagugugacagcugucugucaagagggaggcuuugcacaagaagaauagcugacagagucuggaaaguuggccauaggcgggaaggccauaggcgggaaggcauauaguaaaaggccacuuagcagcugggccaguggagaaggggagugggcggucugcagccucuggugcuugcagugugucaagacuucuuaggauuuagaacccaacgaucuccgaagcauugguagguccuucagaaagcugccuuaugcugaggucaggggagguguguagcauugaguguucucagcaucuuaacucaguguaucugcuguagcuuuguggcccagugugguagauauccccguggccuguuagcuuucuugggugguugagagcucagcccuacagccuuacugucugccuucuccagccugcaagaaagggcacugccagcucacagaugguaugcacauguuuuugggugagcugucccuuccuucccaggacuggacauacggguucuaagucuuuucacccucuuauacuagaaucugcuguaugaagugguccucagugguggccaagggagggagucagccuuguuucugaggugaacuugauuuucucuccaggugcagugggcacaaggguuagacgagaccugaguucucuugaagcccucacugggguugcaccagcgugccucagcuguguuugcaguaagccguuagauccuggugcaucuguagguggaguucaaucuaucccugagagguggcacaagcaugcggagcuggucagggagcauucguuguaagacacagggucagaaucaggguuuuguucauuucucucaggacaacccuucccucugagccuuugaguucucaguguccuagcuguugguaugaaaccauugcuacaauauuguuacauugguaaggcuuucagacaggacugagauggaugugaguccacacacagauucaccccucagucagaaccccugagggacugggcucuugcugcaaagggacagcaccagcaguugguuugacgcugagucaaagccaucaaggaaugcguacguuccuggucucagcuacuuccuugagguguaagaugcacaucauggagacucauggcucaagagcuguugaaagacucacugguuaucacguggcaagcacuuacauaugccaaggacaacccaguguuuugugacaagacuuuuccuggagagauacaacacacacaucuacuugcccuacauagggagcccacaacagaccaaaguauggaaucuacuggaguccaacuugguggaacaguggguuuuacugggguugcuuacagggauaugggugaggggucacuuacuccuguaagcaggaugacucaaagucagcgcaucaucaaaguccaacccagcaugggugacagcucacaaaagcucaggaccuucaggcagccuggcauguguugaagaauguccuuucccggugccucgguuggucuaaaccucuuccaugcaucuuggcuggguucugcuucuuucagugcugucagguguggagcagcuuggaggcuuuucugaggcuccaucuuucggggugggguccuccgaucggggucuuguacgacgcucugugcuguuacgauggcgucuggucuuaugauuuggaagauuuccuugacuggcuucuagaaucagaguugcuucuucucccaggagucuuggugaacuugcuuucuucccuggagcacugauaccucuuccucagagccauuuucagccgcaaccccucugccccugcugugacaccaaguuagggcugcaccaagcucugucccagcacacugccagccuccacuggaaggugacaugagagggaucagugagagggaggugacagcuugcuccauuuggcuccuguugccccuguagucuucauggcacuaacagacuuucaccuuuggagaugccagccccaggaaaagagccucucgcccuguguucucuguccccaaggacuccaaccuccagugucccagcccuguggguacagaggcucagucugaccucccugucacccacauauguaagagucaccugaccaccaguguuaccuagguggguguuuauacggaaaccgcucuauuggagaaauaacuguagaucggguuagauucuggcugauuuguagccugcuuuccaacacuguaaugggcauagaugcguuccacuuauuuagacugugguucacgcucacgggaguuguacuugcuccuccugaccagacugggagaugcucuccucuguccagccacguuccuaagccucagggaaacuggguaucugagggaucgaguuaaaccacagggcucagccauccagguugcucauguauauauaaaggcacuggacgaaagcagagcagcgcagaaagggcugacugaguuuacaggucacagcccaucaucacgggaagcugaagcaggaacugaaugaaguguaaccacagaagaauagcugcuuacuggcuugcuucccauagcucacuuggcuugcuucuaauacaacccaggacugccuguccaaagauggccccacccacagugggcugggcccccacaucaaucaagaaauuaggcaaaucugauggaggcaguucuucaguugagggccucucuuccuagaugacucuaguuuguaucaaguugacaagaagcgacaacgcauaaccagcacagugcacaaggccuguguucaggcaccaccugaguuuaauucccagaagccacggugaagaagaccagcucgugaaagucguucucugguguccaugugggugcgcauucacacucacacacaucaucguucaggugugcaauccuaauacaauuagaacuucauguacagauucaaaaaccaaacaggaacaguacgacccaugggacucggggcauggugcgaguagaggaugcagaacuggucaaggauccagaccuccugcagccccugggcuggucuuggcgcugcuucucaucuguguuaaguguucggcaccgucuagcaugauagaugcuguccccaggucagcagugaucuaggggacuccaggacccaccuggguuuggcauaucagccaacagugucagagcagcccuuucaguuaagcacacuuguauaugggguagccaaaacaagaaaagcaguaauucacauuuucuccaagaacaagguagcuccauuugaagaguuguuguuuuguuuuuguuuuuguuuuuuguuuuuuucccucaagauaguuucucugugccgcucuggcuguccuggagcuugcucuguuguaaaccaugcuggucuugaacucacagagagccaccugccucuaucucccgagugcugguaucuaaaggcguguaccgccacugccuggcuugaagagguuuuugguagccuuucaacuugguaagacuccuguggugcugaguucgagguugugacacacaguucugguuacuguucaagcagggugauacggagugaaggugugcuuauacaccuguccauuuaaggaagugccugcaucugacguguggcucugccccaggccaaggcgagccuuacugcugcuuggcucaagggagcuuuggugagcaccacagaucaccguggaccagucagaggcuugcaggccucauaacucuaaaccuuaggcucauuaauuauuaacuuggggcagcagugucuuguuggcuuguauguaacccauugccugcucaaggugccaggacugccagagaacggcuuuuaggcucucucuucacaggugggaaguagauucugggucaugguuccuccugugugcucauagcucuucacaaggugguuagggccaagugauaccaugaagguaaagcuggacacauuuuagagauacgcagaacucauggucaccuggcugccucugccacuccagagugacucuuccacuugagugugcugucaacacauuguucucagggucuccagucggguaguugggcaguguugucaggcagugaguuagccaauggagccgagagcugccccugaaugugggcaggggccagcagguuccaggagguaaugcucauggcaugaggggucagauagagaccaaacaaacacccguaaugcaagcauucagaaggcagaugcagguggaucucugugaguuucaggccaacauggccaucucaacucugccccuugcaaaaaaaaaaaaaaagccaaacucucucacuaaccaaacccugggaggcuuucuugcugacccugucuccuccaauagaaaaagcugccagcggggacugagggaucucuguggcauugccuagggcacaggugaugcagauccugcccgcucugcugcucagugugaauucugagauggcugagucuuauaucccaggcaagugugaggaguucuggccucagaggguggugaccuucgguucuguguuguggauggucugcagcaucaggaguggcacauucugccuccuugaucccagggcuccuucuguggguggaaguuacccaggccccauggacuuggucugccuggugucucaaugaaugucuggcugcccugugucacuagcugggaauccagcugccaugcuuaggcauucugccauuguaaugguggaggggagcccuguggagggccaggaagguugaggccuuguguagaagagggguucagcuccaggaccagccgucucccagguagaauuccagcccacccacugcccgaggaucugagauggagagcuuuguucaguccagucugucuguggagugugugugggaauggcagcuugaacuccuccugccugccgggaugagcaccaguguccauauggauaugguacggaaaagcccaucagaguggggucuuauguggcuggacguggcaggggugaaugggggcuuucaccagccugguggugccuggaugcuuuugguuuaagauagcaccccaguuagcugugugagcuuucccauucuagcaccuaccacauuagcugagagagaguuuucucucuucuaagaagguucuaauuacugagcugaaauauuaacacacgcuuaucuguggugauuaggacuaaggaagccuggccgagaagcuuagucaucugcuuaaguggccaggaguguguuagugcacaguuuaucagggaccccagggcaggguagcuagaggagugccggcagccuccuuucuccuccuccaccuccugcuccuccccuucccucuuccuucuuccucucccuuucucccuuccuucucaucaaccccucuuccuccccugccccuuucuccucucuaccccucuucucuuucuccucccuccuguucccaccccccccacccccagcuuugccaugcgcuuaacccaccuuucuuuccuccuaccccuuuguucuuuccugggcuucucucuuuccccuccuucuucccuuucugucucuucaccaggaccucuuuccccuucacugaugauugaucucugcucagaggcagcuaugcagugggucacucugagcgauccugguggcugaaccuagaagucacguuucucucuggguuugauccacauggagccuccugugcagccuucuucaagaaaggcugccucagacagcuaaggagugugucccacagugaguggucccaucuggcaucuggugguuguuaagacacaaaccaaaggcuccucccacuguaacauuuguugugaggauuucaaaaccacaccaagugcucucgaggucauggagaagucagagaguggcaaagagggaaaggccucguuggacauugcauaauucuaggccagggucauaaaugguuuaaguaauaauauacuccaaaugguuauuaguguuugcuaugcuggaaaucaugguuguuauauguaugaagcaaaugcuacgccacauacaaaauaaguaacuaaaauaaauacaggcaaaguaaauaaacuaaaguguaacacacacacacacacacacauacacaaaagauucauggaugguuagguaggccuuuaguuaggcucuguuuuucagaaagauaguaacaauaucuuguauuugucuauucagcuaacuaggguuguuucuuuuuggcuguuauaaguuacacuguuucuuauaguuucacacucaggugaaacauucuguguccuuucuauauuaggggauuuauuuaaagugucuuuauuuuagagaacuaaggcagcacguaccaaugcacauuauauuaguaacacaagauggguuggugaugcagggcaaaguauauaguaaaucuucagcuugccuucugcaaaauaguuaauguaacuauguaucuggguuucagagauuccaaugaguuacugugugugaguauguuuauaggggacauauauggcuagguggcccuaggugaucaauugacuaauuauaaauauuaacacuagauaauacauccugauuuguguguguguuuguguguucuguaaauauuuacaguagaaguuuggucaugauuuaauucaagacacuucaggaacuuuuugaaguuuggucaugauuuaauucaagacacuucaggaacuuuuuguucugucuauugagcccaggguuaaacucucuggcacuguuuguagagugagguuugaagccauuucugaguucuguggcuucucuaggagaaguagugccuacuuggaacugguuuucauugucuccugucuuucuccuuuuacguaauucuguucuuacaaguaugacauucacgaggaggggaagcauucuuucuuagacuuacacacaggcucuauagcuuguagguuugcuguauccauucccagaauguguuuguugaacauuuaguccauguacauggcuuaccaugauuugaggugagccccaggggcauucacuccaagaccagucugaggugggugagaguuuccagaugaugcggauggacugugcacagagucauccuggggcagcugcucugucuacucuagauacauagacugagguugcaauucuucagcagacucauuuagucaugggcuuccaaguuuuaguguauuuuauuuuauuuuacagccuuggccuuugacugccucuagccuuccgcacuguggccagguauccuugggaagcuggccugggcagaguugguggacacugugcuucucuaauggcagaaacugucaauguguccuuccucugggcccgaugccugcaggaagggcacuguucccccugcagugcucuugagcucugccuucuaaggagcugcuuucccuggaccuggugccucgggcacugcgcaggugacugguuaacuccuguguauucccuuccucagaggccuaggcuccucugggcaagagcucccacuucccuguggaugaauucccagauccuuccaguuugaguuacaaaacuagauuguucagcaaaugauuaaaaagugaagacuuugguucuggcagcaguuuuaauuugcuauaauucuaggcagcuugcccaaacaccguguugucuagauuuuggaguguauuuaaguguuucuugaauggauccaaaggauguggguggaaguuacgcaguucugcagcaacugugagccugguacuacauacuugcauauagauacguauagggaguugcagggguggugugugugugugugugugugugugugucuauguauguauauagauguauguauguauauguguguguguauguauguguauagguguaugaauguauaugugugugccuguguauguauguauauugugucuauauauguauauauauguaaguaaguauguguuuauguguguguauguguguauguuucaccuaaauguuugcuaucuuaagaaugcuuaccacaauucuugccugcccucaaccucaagaauugaggucccuggucugugucuaucucucgauaucaugauucugacccucucccuguccacagggggcuucucagcuugagugugcacggucuagggcauguuggugugccugcaugugugcguucccaagccugcuaguguccugauguggaaggcuccugaugcuccagcccugucaggcccuggccugccgagcccugccuggaucagagggcaguaucgagggcaucgucccuggagcaggcuuugcagugugugacagagccacaugcugcucuggugcauguggucagccaugguuagucauucaugauuuuccugaaaaugcucuucuuuccuuuggaggucuguugugggccccauucucagaacucuggugcaguugagccugggaggauggguuggcauguggugggagcugucccuggagagauuuaggucugcuuuucuucuuugcuguccuuuugccugaagaaguacacugccuuucacauuagccacccuguuuccccaggacugcuccugcuagugccuacacggucccgccaguguguaugaagggcugaagcaggcugugugucggagcaacucacagaaccccagacuugguuguucuuuuagaagaggcacucuuucccucccccucccccccaaacaagcugccuuguccuuuaaaaccugaagcagagaccagaugaagcucugcagcugcaggccggacuugcuugcuguggcaugaggggucuagccuggauuccuuagaauaucacuguuuggccuuucauucuuuagcgaguuuuccucagauggcagggaauccaggagcuguagcuuucgugauguucacgaacccucugucugcacacugcauccuccuccuuagcugugucagaccuggccucucuggcucccuugcagcuguuuuaggaggugauucauuuccugggagaauuagcuggaguuaagaacugaagugucuccuuguugaagggcuugccugaccuccggcagguuuccaucuuuaaaaacacuuguuagcauaaacuaacuguacaaaauaguggguguucagauuucuauguucaccucagauuucuacguucaccucaggcuuuaggaaggaaacccggucuucuggucuucugguugguucugggcagauaccguuggcugcagucgucguuucucugacaguuucuuucccaggacugugguagcuuacaguugugguuuccagcuagcuggguggcugagacaggaggaccacaaguucaaggcuugucuuggcuacagagcaaguucuagguaacuggauggggaggcccugucucaaaucagagugagaacagaaggacaggcaaacuggcggcgacucagugcagaaugcuugcuuaucuuuaucgaggugcuagguucaguccauagcaccacaagacaaguuccccaggaccaaaaugaaacaaagucagaaauggaaggguuuucaguugagaugauugguugaagagagggaagggccuggaagagagacggugacagaaacucuggcaggcuuaguauguggccccaggaacacgcacggucgguagcuuuaaagcagaaagcccccagccccagcucgcagaacauagucuauugcgucccacucgaccggcaagaaagacgcaacaaaccggaaucuuccguggcaagagcuuuauugcuuacuucuucaggaagaccccgaaccgggaaaauggcgccacuuuuauagcccgcagcgugacguuucagcaccugauauggcaugauagcuccugauucguugcucacccaucaccccacuauuacaucccgagaaugggagugacuaggagugaguucacucucgcaccugcguacaaggcuucuuuacuaguuaggcacagcggaggccagcgccaucuuauaauggcgauugcucgcggcacggcucuccacaauagucauuuggcucugaucugauuuggaccuugauucuggaacgacccugcugguucaggcacccugugagaucuuggggugcuguuccccucuccuccagcucuuuacuuccagcugcugccuccugacugccgucagauucuggcaguagugucuucagaggaaccauagcuucuccuucacucagaguuaggguuugccacaagaaagaccguaaaguaggccugauuacauccaccaugcuuggcagugcuaauccugugccuguccucuggaugcagaugaagaccacagauuugcuugggccacaaggcugagaggucagcugggcuuccucuucccuccucuccaaaccuccauggaacugcugucuagaauggaggcccucaaccuucuuaacucugcgaccccauaauacaguucuucguguugugguggcucccaaccauccguugaugcuucauaacuguagcuuugauguuguggauuguaagguaaauaguuuugguuugccaaaggggucaugacucacaggcugagaacugcugguguagaaaauaaaaguguuauccucugaaggaugcaugguggacgaggaggcuggaggacugccucucucuuguugugggcuagguuguuagaaccggcuggcagccucaagugcguggcuguugcuccagcccaagggucuugcuucuuacuccuggggcuccccuaaucauaacccucucugugccccaggauagugacaucuugacacaccucccucccucuucaggugcaaagugugaugugcagagagggucaggagagggagacggacggucaggacugugugugcagccaccugcuccguuguuggcuuuucuuaguagguuucugaaccccuggaguguagacucgcguucacaggggcccaccugcauuuucuguagacuccaggcuuucuccucaucuggucccuagauguguuagggguuguguuguaugcagucuguggccugcaaccacugcccucuguagggcuacucuugauggcacucagccagagacacuaaacccagggucccuuuuagucccccuguuucaaguauagguuugcauacuuggaagaugaaccacagaggugcaucguaugcugguggguucaaggcuacaccaucugcugacuccucugcucaguguuccuuccugaggugugucccguggcuaguggggggggggggaacggcagccccagugcuuuuggcuguuuagcguuugccuguuuagugaccuggcuuuucacacauggcacucugaugccuugggugguggggguuggggggcaucuucaguaggauaggugaugggggaccugcaggaagcaguggccucuguggucccuucuggaaggguacugugucaucccaguagcuucaagugagagguucuccagacucauccauagcagcucagcaagucucuguggggucagccauguccuggggaugaauuaggggagucugucagagcacuguauaccucuuacugagcccuugcuggcguugacacgccccaggcaagaacagagcucgaguucugggcugccccgggguuccuguugggucuuucagagauuguaggguggaggaguacucuccacccuacauuuuagcaccuuggaaaucugaaaucaugaugccucucucaguggcugcccgcccuacagccauugcgcuggaggcccaguaaaccccgcaggguuuccucccauuuccacuccauccugucagcagccugagaggaagagugacagcccucuagugaaaagcacccagcuagugucucaucagcucccugaggggccagcaucuggcugacuacaaacuugaucauguguucuguacacacugggcugugaucccacagaggagucagcagaugugcguaccccuaugccuccuaauucccaggccuccguagcguagugaguacaauaaggauuuuucccuuuuucagccugcucuugcggccugccuucucaaaagcucgugcgauagcugcuuguuaccucugcacacaguugguugcucacucugcgaggugucauuuccaggguuugcccauggcuuccuggauguugacuuacaauuucuucucaggccauaugucucuggaugccaugucaagucccuuauaaggugggcaggucuguggaggcaaccugugacugugggaggguuucagugagaaaaagagcugggugggaacacugggcaggcugccugccuuugagcuucgugucucugugaacccgaggcucuggguccuggagugugccggaacugacaguggcuuggcauaucgccuggaaauccagcugcccgaggcgcuggguuuggagcuuuuuguuuuguuuugcucugguccccagugaagcagcagguaccguucauuucacuuguacaaggcacagaagcacacaucagcgaugaugaauaaugccagggcaccugcugcgugguggacgggagcaaaaguacuacugcccugggacugcuugucucacugccuggggcuguggggucauaaagcugcucuuaacuggcucugcugacccucaggagucaugcugcagggcagcguggcugugccgcagugaggaaugagcccgccauguuccccucgguggggcuggagugguguccagucuggaugcuucuagcgaguccauccugcauagccucucauucaauucugguagcaguacuaacugggcaauguuguuagcccauaguucccaugguccgguaguaccgggggguucugcugaggccugggacuagaggaggaagcagcccccgcagcaggguaaggccuggguucuucggacccucucugcaggacguugugccccuucagaaugguggugcugagguaugaagucuuaggucuacagggcggugccuugcuugguuggcagccaggggagacucuuccuagagugugaacagacauggugucuggagggcacaggugaaugccauugacagguagggggguguguguguacguguacacauguacacgugugccauucauuaaaaaaaggagaagcacagcacugaacuuccacacugccagggauaagaggaguuuccacucugcuuacagcacagagcuuuuggaggagguuuguuuauuuauuuauuuuguuuguuuguuucuuauuuacuaagccagcaguugucacagccggguguucguuagaccugaggcaguacaggguuggagaagacagaagcagaauguggcagucgcuugggggugguagggcgaggcuacguuuuagggguggucaugccaggagcucagcuuggguuucuguguugucuucugggucccuguauuugugcaggcacaaaggugaauguuacucugugaggcgugcuaggcuagcguaguguugagauagacuccauggcagagccccccagcuugccggagaauggugugcugcaccaagauccauccguauggaaggcugugucaggcugugucacaggaacucagccgaacucugugaagucaguuaccccaggagguagcagggaugguucugaaagaguaguuccagucagacacugaaagaacuccagaagaagacagcccaggacgugugucuuuuguuugugcauguugauuugugcauguugguguguaugugcacguguguggacaaccucagguuguuucucuggugccagucacuccucuuuucuauuuuugggugugugugggggugggguuguaauggugguggugggggagcacaaucuaucacuggccuggaacacacuaagcaggccagacuggcuguccgugagaggagauggcccaaggcuaaucccugguaaccugccuagaacaugcaaaggacauaugacuuguuauacaccuaugaguauguguaagugcauauguguaugggugcccaaagaugccaccaaagggcauuggauccccuggaguugaagauggcuucgagccauacaacaugggugcugggaacugaacuccaaccucugugagugagagcagcaguguccucaaccucugagucaccccugcagccccaagccacgcccuccaacuucucagcaggcucuuuacuaacucauuuuccuccuccucauuuuugaaggugacgucuuuaugugccuggccugugugagcucugccugugaugagcaagacuaguaaugacacacacaagggaagaugugcacaaggaaaggacaggauaggggaaugugcaagccaagguacacugucaaacaugcaguggccuggggcucgcuucugccaguugccccucugcugcugaagagcuuucucacacacugucccuagcacaguugcccaccuaccugcuucccuccugccccucuccuccgagagucuggaugaguuuggagguuggcaucuggauuagcaaacccuccugaggcuguuaggaagccugaaugauggugguggugggguguaugugugugguccuugccuucuguggcucucuugcuuucucacugaguggcgagaagcccccuugugccuuccuaugaucccucacagauuucuuucuuucuuucuuucuuucuuucuuucuuucuuucuuucuuucuuucuuucuuucuuucuuucuuucuuucuuucuucgaggcaggguuucucuguauagcccuggcuguccuggaacucacuuuguagaccaggcuggccucgaacucagaaauccgccugccucugccuccuaagugcugggauuaaaggugugcaccacuacgcccagcccccucgcagauuucuugcuucagauuucuguagcacagaauccccacuggguauugggacgguuggcccugcgacuagagaccagugucuaauuggcuguggucucuuacagucuuguagccaggggcucucccuucuucucuguggcagcugugcugcucaggguaggcuucagaucugccugggcucccggcucuuguucuccacucuaaagagguuggcaguguccauaugcaccacaucugaagauucuaguugucauuguggucacugacauucuuggaugcugucauuucuggaucccagggagcagcgggaagccccucccccccauacacccugaggccaagacugagggugucuugaccucaccauuaauccuaccuaccccaguacagggcuacugccauccgguggcuccuggugccgccugccaguguuuaucagcuagcagaacguguggggaacuucagugucccaggcaaaggcgagccuguagacagcaguccucaugccauggguggaagaguacgugagacaggaagucgguugccgagcgacagugagguuuccucugauccuagacucuucagcaacagcuaucccccgccccccucaguuugccauguucauuacuccaggcauuccgagaugcuaauccuacaccucuguaccaccucauuguccauagagaacaugugucugguucguuuuguuuugauuuugaugauguguauaugcgcauguaugcauguguguauguuacaugcgugugugcgugcguguauagagguaugcaggcauguaugagcaggccgaggccaggagaggaugugggugucugcccccauugcuuuccaccuuagcuuuugagacagggucuugcacugaaccugaagcucgguguuugggcuaggcugucugaguagugagcucccaggauccauguauucacgccagucaggacaccuacaaaagauugcucaguguggguucuggguguuuacacaggucuucugcuuucauagcaaguacuuuucuucacagagcugucucuccagccaauuuugacauugugugugugugagagugugcgugugugauaguuagcccagguuggcccuggacuuacgcagccagugcuauccuuacaccuccugccucuccacuuccaaaugcuggaauaacaugauuguacaccauagcugucacccagcuugaggacacuguuuaaaggaacuuaggaaagguuguguuuugcucugucguugauaguaauggucuuuuaacacaugaggagccagaagggaucuucuuagacacacugggcuguguguuuguggacuugcaagauggaugggaacggcuucccagaggagggcagugauggcaggaagaagcaggagguuuggguagugaugucuguguguagaggauagaggccacaggaugggccacggagaaacccccgagcacaggcugcugccaugaagccuggcugcugccguuauggccagggugacuggagaggaagguggugugggggucgacagaaugugugcuaauggggcuggagcccacauuuuaggaagcgauguggggaggggcagaugacaauccuucagguuuauuggugcucgcugcugugggugcagggccugugguccuguuucuguguguccuuccuguauauuaccaacaacagagagaacucuguuguguguuccaggccagcugagagugacagucauguuccauaguugcaggucaaggaagaggaaggucgcuuccucaagcaugcccccuucuaucucaauucagcuuacaaaccacugagaagauauuuuggugguuuuuuaauuuuugugauuccugccucccuucccaaucauguuuuugccauguguuggugugaaaugcaucccugucuccacacugcacccugacagugagacagcauucaaggcugcuuuugucuaaaccacaauggcugucacuaacaccaaggacuggggagcccagugccauuccagggcaggacacaguccuguuguguucaugccugaccucugcacucuguuccacaugugacacugaguggacugacuggucuugcaugaaggcccagcgugggaugagaacauagguguggaugagagcacagguguggaugagagcacagguguggaugagagcacaggugugggauaagagcacagguguggaugagagcacaggugugggaugagagcacaggugugggauaagagcacagguguggaugagagcacaggugugggauaagagcacagguguggauaagagcacagguguggaugagagcacaggugugggaugagggcacagguguggaugagagcacaggugugggaugagagcacaggugugggaugagagcacaggugugggauaagagcacaggugugggaugagagcacagguguggggugagagcacagugcugggcaugugaugaggcuguguggucaguuguuugcugguauucuuauuuauuagguuuugaguauucauguauuugggccugacauucagcuauacuuuuucugguauuuuuauccucaauguguuuuucuggagacuucuguggcaaagucacccuagagaugugguuguauugaccgugaacugagagugaugaggaucucauuacugacuuagacagcugggaaggacugcagaaucccugccaggccuuggaggacuuagauuccuuccuguaaguauaaacagcaccuacaccaggcaacauacagugaagcaggaauguuuggcuuauggggaugcauauguguacuguguauguacuguacacauucacaaacgugugcacauuaaacaugcauuugggucuaguuccauguggaaauguaguguguguguuuguacaugaacauguauauuuguggcccgcauuggugcauuuacauacauguaugcauacauguucauuacucucauuugugcucacacgccuguucguguauuucaugugugucuacaauauaccauaauacacguuguacacauaacauggugcccacgguacaugccuauuugucugugcaugugacauguguuugcaugcauguucuaacauuccaggugaacuccccagagacagccuggccacuguuuccucagaagccguagugagcugacucucucuuccugcagaaauccccagggauccuuuaggaucucccuccccaccuccacuccguuaagucccagcgccugcacucggauggaaauguuugcuguuacgcuucucgguuugauuaggucguuggauuaaauuaauugucaggcugccuggaacuaaagccucuuaaaaugaaaacuguuuucacucaggaaauuuaugcaagaugaagaaugggaaaaccuuccuggggaggaaaggccgggucaccugaaucugccugucccugcuccccaaagccaggauguacacgccagcaggcuccuuuuguucuguucuagaugugucucccucuuagagccucuugguuacaagugaaaaccgcccaggacaggaguaagcugaagagggaacgcuugggguaggagggcaucucacuucaccaagaggaaggaaggcugccaggaacugggaccuggagucagccugggccaccacagucuaguggccugguucugugccccagaucgguggcucugcuacuuuuucaguggagguguuuucugcucagaucuuguaucugucugucccuaguccagcuucucagccugggcugagccuccuugagggaacccacgagcccaauuuaauaugggcuccugcugcgaccuaucugcagagggaguauaugucaugcagaugaggguagcugauaauggacaggacuuggaucaucagaaagcauuuuguaccuccgcguuguguuuguccuuagccugaguugcuaggauaugguggagggagaaaggaaggacggucagcacagguaugaaggugcaggaacucuguucugagaagggcccuuucuggggugggauuugcucuuucuuauacgaguuaaacagagaccuuugagccucuuuguggggucgagguaucuguguguggaggaaggcuguacuguugagcuuccgucaaagcuugcaggaagcuuguaaaacccaggaugacccuggucugcucuugggcugugugccaggaugaaacacacacauugaguuuuucaagcauccaaaaagcaagcuguccucaugggcucaggaaaguuuugccugcauucuggauucuguucugaauucugcugcccguuugcauugaguaaugaccgcgcccaggaagccagagcguuggcaucagggucugagauccuucuuaauuucugaucgcgugugagaguacuuucuaaggugcuucuggcaugaagagguguccaccccacuugguuggccagagaagcagagcccuaagccauggcacagacuuguugguucaguuccugugaugcccagagcagccacuccacucugcacaggcagcaggaugagcccuguacuuccagcccugcucucucuucugccaugucucucuuucacggcucaguagccugguuugcaucacgcuuucagcacugcgcguaggcugugucuguggcuacagguaccacugccaugccuagguguguggggagaggcuguggcuggccuuccucggguccagaaugugagcacccaccgugaagcugcaaagcagcauggguacagccuguuucaugaguuuggcacggcagcugcgugauguguugagcaauugaugggauaguccuuaccaagagggcugggaggcagaaaguucuggcuucugaugaugccuguaggccuuucacgugucagauguucacugcccagggagcaacgcaugggcacguuaugccuggugggauagaagaagucgcugucucuggcgaaggcccuuggggaaggucuagcauaugauguacagcucagagaacggaaggugcccaggucucagcauaugcauagaugcagcuuguccuuugccuuucucggcagaguuauggcagcacgagccagaggucugacucacagagagaggcaguggacagaggccuggguccccuugcaugucugacaggagggccauuaaacuugugcuaacuaagccugggucucugccucauucuaagacagaccgggguucacgcagguuuccuuggugcaagccuagcuuuagcuacaguuguauacagguccugaccugcuccacucuagcccuggccugcagguucucaggccaugacagguuguuagaccucugucaagaucauauuucuaucaguuuucugccaugccuggcuggggcaguuuagccugccugucuccuguguuuucagaacugcccucuguggaggaauuauccaaauguaaauuucucagucagguucagggcugcccugggcucauacccaggcuuuuaucuuccugcucuugccucucaggagacuccuguuggucagggaacaugguguaccaugaugaacaugcugagcuucgagguggucugaugcuucuuccuaccuggcccacugucccuccuacuucugugcacuuggcccagccaggccguucugagugcuuccaccagguguggcugacauuugcugcugcuuugcccuucccugucaggaaggcuggggaacaugagggucagcauccagagucagacccagggagcucggacuggccuccuggccucagugugagucugcugcacagcauggcccuuaccaaagcaggcgugaggaguggaaggcagaggcagcuguccacacccugccagccugugucacaugacucugcaggaggggugugaccuggucuccccugucacccagugacgcaugggugucugucagagcaggucagguuuuggugccccggguaguuagcugucacacacuucuuccuggaaugggcuggccucugagccgcuugguguuacacguggugccuccacccaucggaacacugugcucuaagugggauccacgugccucccucucugugucacuaugucucuaugccaacugaacaccaaacccuguggcucacagucaugagacaggcuuguagcccuuguucuuccaugguccccuagagacuuggagcccuguuccucagggcauccuuuccuugacugucucugcuucgcucuucuacccacacaagccauuuuuccagacuucuucccagggccagggugcccuggucaucacccacaccgacccagcugaugcuguuauggcuucuacccuucaguuacaguaaaauugccaauggcuuccucagcucuuuaaaaaaauucuuuuuaucuuaguuuauguguauggguauuuugccuacauguaugucuguauuacauguguuccugguaccuguggugggaggaagauguuggggaacucuuagaguuacagaugguugugaacugccauguagauucugggaacugaaccaggguucucuggaagagcagccaugcuuuaaccuaaggagccaucuccucagccccuucuuauuguuguuguauaugugagauuaugguugggggcacacacacacacacaagggggggagagagagagagagcgagaguaugagcgagcuguguuaaggagucauuucucuccgucuaccuuuguacguguuuuagggaugagcacaugccaucagucuugcacagcaagugccauuacuggcugagccauuuaggcugaggggcuuacaaaugaagagcuguguauaacagaacuuuuccuagaguggaaagauccaggaacacaucuccucaccccacauauggaaccuguagcacacugcauugcuuguaggcagcucaacagguuagagagugagcauucuagguuccucgguuggcguaacucucuuccaggcaggucagcugguuucugcuucuaggcaacuugucugguaaggaguugucuuugcagcugggguuuguggcuuacucuaucagggagggaccuagggucaguuucagguauuuucugaaacuacguuuaguuguuuacucuucuguuuaaagagcuucccugcagacuagaauguuucaaucuaggaggaaacuguuaaagaguuucaggcuaguuaaagaccucggcuuccucuccaaagccccugggagcaucccugagacuuaaacaccuagugcuguugcccuguguugugucuccugugaccauucccagagccaugagaagcaggugguagccacauggauuuaccuguguccuccugggcgccaggccagcuguugucuuugcuucucuucuuucaucuagaggugugguccuccacaugccugcugagugcuuccuagaguccacaggugcacacgggauucaggcagauccuuggaucucacuuggagcuguacuggcauagcaccugugggucagcucuccugacagugccagaucuuuauagauagcccggugccaacccaucugccugcuuguugggucuccucccugggcauauucucucauguuuguggcuacuaguucuggggccuuucugucaguuuucaucuugguaaggaggugcuggccagcacuaaguacucaggcaggcaacaggagcccuggcaaggaucuauguggcagggcuuuguuugcuacuggauacugguggccacccuaguccugacagguguuucuuucauaguuuccugaagguggguggcuaucucuucaugugucugucccucuuccagaggagagucacagggagagauugagagccauccuuuacacugucauuguuuuuuaucucuguaaggcuugagccucauggcagcucuaggaguucaguggugucaugagcuucacuuggcaagaacucacuaacacucauuguggugguuugaaugaaaguggcucccauaggcucauaaggagcagcacuauuaggagguguggccuuguuggaggaaguaugucacugaggguggacauagaggcuuaagccaggcccagagucucucucuucuuguugccuguugauucagauguaauacucuaagcuaucucuccagcacugugccugucugcacaucaccaugcuucucagcgugaugauaauggacugaaucccugaaacuguaagccagacccucuuaaauguuuuccuuuauaagaguugucacggucauggugucucuucacagcaauaaaaacccucacuaagacacccauggggagagauacuagcaaaagcagaaaagggaugcugaauucagaccugggccaugaccaagcaugcaccugcauuccugagcaggcuggccuccugaguaucuguggagcaaaugacggugguugugagaauugcagaaugcuguauuccucacaaacuuuuuuaacacagcaccuccagccauagugcguagagggugcuucuccugggcguauuucuugaauuaaggaacccgaucuucugcuguuauuuggaaacacaggcuguccagcuuucugucaccuaggggcuagguaagaagcccgaggcugaugguagugacuguucuuuguaccugucuccaccccuugcugcucuuuccucugucugguguuucuagauguacuucuucaaaauuguguccauuuugagauuauaauauaguuauuucucccuucccuuucauuccuuccaaaccugcgcaucuauuccuccuuguucccuuucaaauuuguggucucuuuuguucauuguuauuguguauauucauaaacacguaaacacaaccugcccagucuguauuuuguuaccuguguacugguauuggauaaccaguuggugugcuuuccccuggggaagaccguuucuccugcucucagcuuccccuuaguuccccauaguucuuguguagguugaggcccugugcccuaccccagccacugcagcuugucuauuguucuuguucagcucaggcacaggcaguucuguuggugagacucuauggguguagcuucugacauuccuaggagauacaaccucacagccaaguccccauucccuuggcucuacagacuuucugcccucuuuucugcauugaugcuugagccuuaggcagaaguuacauugugagauauguaucuuuugggacugggcucugcuacucugcauuuugauugguugugguuuccuauaauugucuuccuuuguuacacacagaaguuuccuugguaaaagacaaugacuacauuuaacugugggcucaagaaauauuuaggguguauuaagggauuaugauaguuuaguagcagguucucuaagagccaugucuucacuaguucuggguaguuggcuagguuuccaguacuaggcaugacuucugucuugcuaaccaggucuuaagcccauuuaaagagcuauugguuacucccaagguaauacgugccuuagggucggugugccaugcuaguuguggcuccugcguguuguagcuggggaggacuguugguuggcuucuuccuuuagaagcuuucauggcgucuucugguaucaugagaacuaacuaguccucaaagagggacauuucagaucaguccuagcucaggggucccugggcccucugucugaaguguguggcgucuucagcaauagggacuugccucccacuucuagggugcaguagcaauagccuauaauauuugggggguaaaaggccugaugcuggggauuuuguuaggugaucuuuggcuuuaguggggagcauugucagcccagaugggcaacuucauuuaaacuauuuuacacauacacacacacacacacacacacacacacgcacacauggggggguagauuccuuacagaauuuucagacauccaucuugcuguuauuuuauguucccccuccuccuucuguauuugucucccuccucccuaaagcuucuccaucucuccauccccucucaggucgccugcaccccgcuaguccccucuauggcucccaccuccaccuggcaaugggguucucuacuuuccugguuucugcaguuacuccagaauauguauguacucacaugagaaaauuuggagcuaggagcucugcugagagagaacauggaaccuuuguuuuuaugagucugagcugccucacucaauacagucauucucaguaacagccguuugccugcaaaguuaaugauuucauuuuccuugacucuagcuguucuucuuaacacaguuuuccucuugagaguaggaggccuggagccaugguuauacggucagaugcaggagggugugugcacggcggcgugugaauguguuucccuccagagcacuuuuaaaggucuccgcuguuauuaacaagaauuuguuauucguauuuaggauaaugcugaugaauaauccauggugugugcuuguguguucgugcugugugugugugggcucuguacacauaugaugaguguuuaugucugucccacuccugaguguuggcaucuauacacagaaucuggcaucuugucucuguaggcuguuuuguucauagucaucuugguuggcugagauacuucaugucucucaucaguagcagcucauuuaggcuugcacuggggagguguguccagggacgacuugucaagagguggcugugaagucagaggacugggcaguguguugggaacgcacgcacgcagcucugccucuugucuuggcugaugcugcccuguucagagcgggauggagugcugguugucuggcuuggcuuguuuucuuccacugugaguuucuaaucaaaaugaaguuaccaagcuugacugccccguguccauagcucuuagcuauggguaaaugcuacaacuucucaagaaugagcaugccuuugauaacaacagccaugguuuuaguuucagggccaucuaucuugggaucuuccaccguauggcgccaucauggcgcacugcuuaggucucaccacagugggcacagcugaugcuugggucuuugugggaguuccaggauuugaagauuaaugacucacaccguccugccugagcgugugacucacacagugagguucagacaucugagccuugcagaucgcaccuuugauuucugguccugccuuuucuucucggucccaguggccuuaucaugccgaagcgcccguggagacaaaccuugcuuugcucacugaacaucuuuuccugguuuucuucuguuuguggaagggaaaaacugcauuguuuauaaagaagcaggagggcuguguccucuugcuguacugcaggucauaggauccccucccccuacagucuugugucccaaguugaucuuggguuugcuauacagcugaggaugaccuugaacuucugagccuccaacuaccaggugcugggauugcaagcuccuguccccauccccuguccaugcagugccgggaaugaaucccagggacucagaugugcuaggcaagugcucugucugucaacugcgcugugucccagccccgcaggaguguuuuaacugcuauuuuccgguuuguucuacauuagccuuguggucacaguuuuguuagacccuuaacucaggaaacggccuguacacuugacaggcacgauaugaaacuaagucauaaaaccacaccauuugggcauucugaaaauaaaaacgucacgucaucgucguuucuuuguuguucugguucuacggugagcucaagacccacagaugaccuucucugcguggcccagucuccagugaugacauauagcuggccugagagaauuucugcuuacucuccucaggacucuuccucacaagcugccucagcuuuaagcagcagagauggugggugugguggcauacaccuuucaucucagcauuugagaggcauggggcggcugaacucuugagugugaggccaaucuggucucaugcugaccucaacuuaaugaguucaagaccagccaaguuuacauagugagacucuaaaaccaaccaaccaaccaaccaaccaaccagaacucaaacaaacacagugacugccaccagggccacauacugucuagcucuuccucagauggagucaaaugaagucuaaggccugccagguacuucuuggaguuuuuuggguuuuuuccccccauuauuucuguuucuaacuuugucucauacaaggagacagggaagaggaaggcaucagcacccaagaacuaaaggagcuaugaccccagcuuuggucauucuaggcuuuguaacaagcuagcauuuccccuugucgcauacugugaagaagcugaagaaaacugcaagccggacgucuuccaaaacccgcccaugacaagagucaggcucagaagcagcugcggcgggacgggacaggagcuauccccagcugccggugcguggccugccuucuucagagauucgaagugaggguaugccuucucggugauucaggacacucuccgguccuucagauccuuggagaugggaugugaucagaguccccugcuuccucuggccuguagucuuggaauggcgggcgucagcgucacaguggugccagaguuguguggucugcacucaggucucgucaggcggggguucacucuguuacaggauagagcacagucagucgggucugaggaucuggucuuauucucagguacccagguauuuuggggguggggggaggggacagacuaguuaaggucuggugucagguggcuagauacagccugcugucuacacugugagaucacuuuccugcugucugugugaacuacuccuagccagaccccuugauguugcccuccuggcugaggucaucuaccuguaacccauaaaccugcuauguccugagccaacauucucuguccuuagcguuugacccaaacggucaagucugcuggcagccuggcacugcaguggaggaaagggcagaggcauuagugggucagaggucaaauggagccugcaagcugcuggguaugggucucuggccuguguguaagggaggaagagguggcacacggaggaggagcagaagcagcugcaggaggcacugccuaaguccaccuaacagucugcaagucacccuccuuggagagcaccggcgguuuggcuugaguucgagaguauaacauguuuuaaauugaaggcagauggacuaaggagaggagggcuugcugugugaggcucaggagccucugagccaagguccuguguuuagucuuguauugugcuguguuuguuaugccgaucaggagugucagaagugcugauagagccuaagccuggucuuuggagguugcgggcuuggucuuuggagguugcggguuuugaugagcagcaagagagcuucguguuagagggaucgguggcugccucagcuggagagcacuguuugggugugaagaguggcagaacuuuggguaggaugacacucagagcuuagauccaggugcucagcuuccgucuaaauggauaacugcucuuggcacuuagaucugcccugccauguugugucugcaaggcucgggccuacguggcucaccuucuaguagggguuucaucucucuuuccuguuuguuccccuacuuccuguuucaggcaccaagcugacaggugccgggcgggaugguggccuugcugcugcucacccagauggugccacaugccuucacacgcuaugaaacugcuggguuaggugcagggguggugugugagguguucagcaacaggagcagagccaccccagagggcagaggucacagggauggggcugugucugcugcuuggauggcugaagccagcugagaguagaugggaucacuaagcuguggagaugagcggcugugagguauagucagggaaggggaagauguguauaguuagaggaggaggggaacuuccugcugugguaggcguggccucugaacuggcauuguucuggcucucaccuuguagguccacaggggcagcugcucucuuguagcaccagucacugucugguacucuguagaucagcccccugccccucagaacguuggacagggagaaaguauuuagggcuaaccuuguucccacacauaagccaucacugcagccacagcuugguggcggguucagauccuggugcugggggugcaggcauagucucucacuccucaggguagguggaacgauuuuguacuguacaggagucugggaagauuugguaagcagaggucuccuguugaggguugaggcaggagugcaggcuccuccuauuugggaagugggucucugcaggggugagagguuccccucacaucccacugugagcucugcccagcugaucccuuaugucaauaccucucaugccagacucuccuuagaaucugggagguugucuuaaugguuugauuuaaaauucaugacaaaaagcccuucuguuuugaagaauggcguguauuugagcuccuugcggcgggcugugauguuccugggcgaugcgcucuguuuagacucuguuuagaacgauuuguggucugcucugcguacgcugcugggugugggaaccuuuuugaggugugaguuauuggugcuauaacucacuccucguuacugcagcauugcuuaccuggcaugaaacacaaguuguguugaugaguucugauggagccccugaaugcagagcucugugaggguccugcagccucagcacaugcugugauggggagguaggcacagugcagcagaugcuucacacacaugcaguucuugucuccucugcagcugcucauggcaaaucugcaggguacaggacuggccgcugaguucuuucuagugucuguggaguugguucucugccacaggugcugcugguucccauaucccacccccuucucacucuugcauugacuguggguggguuuguggguaugcacauggaagcaggagugugguuuccucuacaguagaggaacuagacaguaucacucuguuuguugagagagggucuuucacugggaccugaagcuuguccguugggcugugcuggugggcagcaaaccucuggaaucugccugucuccaccuccccagcauuggggugguaagugugggccaccagccugacuuuuuuucauagaugcagggauucaaacucuuugagcugagccaucuucucagcucaugagaaccccccacccccaggauagcuaguggccuugaauggucacagccacccacccuggcauguguuuaagucagaaggagucuccagcaagacccccuuccugaagucugcagcccauaugagcuaguucuguuaacucugguccuguaccccugcucaagucccugggaaauggggauguuuggggugcugucacggcuucacagugugcuugcuguucguuuguagucugcuuuuaggcuggcucauuuggaauuagcaaacucgucucaugcucagaauagaucguguugccagggaucaaagccagaaucugaguguggguaugcugaggcuguugcugcuucucaaugcccaucucuccuguccuguugccugcuuacugcugaggagcgaguacagccauggaacucugagauggaagcaaggaguccaggcaucccgcaguggccacagcgccaaugccagcaaguuccugcacuaugugaaucacuuggugucauagccuugggucuaaagaggcacacacagucccuggcccaaggcuugguagauggguguuuccucugugacugccugagggcagagacuagcugcgcggaacaggagugauugcaaccccaggauguggugagagccuaucaaacagaucuguaugaccuuuguguaccuauuugugaagugggcacagauuaggguagaugucccaugaguggcuucuaguggcuuuugucccccacaguugucuuaguuacuuuucuguccuaugaacaggaauagaaucacgaccaaggcagcuuaugaaagacaacaucugacucggagcucacaguuccagaagguaguacaguucauggccgucaaggcaggaagcauggcagcaggcaggcaggcauggcauugcagcgguagccgagagcuuuacaugucgaaacagcagccaggagguaaguggagguaggguuggugccuaggcuaacugggaauagcaugagcuuuuggaaccucagagcccaccccuagggacacaccuccucuaacaaggccacaccuccuaaccuucucaaacaguuccaccaauggggaaccaaggaucaaauauaguagccuauggagccauucuuguccaagcugccacagcagccugaggauacuuggagaccucuuaacugucuggagacaccugaguacccccacccucaacccuauaauaaaucucauugcacuggcccggugguucacaugccggcaaaggcaccuuaauuucuagcccacgcucugugugccgugcgguguauaucauuguuggaucacagggcugcuccugucuucccugggaucagcaucccauaauuuaagcuagggauacacugggcucacacuuggcugccaaggaucuagaagcuugccauuuaacccuaccgugaggggaggugccucaggagaccaagguugacacagccauuuggcuuccacuggaaaggcagccauaugaauugcaugccuauuugaacagggaaguccugugcagagucgggcaggcaggugggagcuucucuucugcuguguccccagggacuauggcugacuguggaauucauacucaaguagauacggaggugucagcagaggauccuguuguguguucagaguuugguggaccccggccaaaacaccucaagaguucgugggacagagcaaaauggcagaccaggucgggagacucagggaccaaauaggaggaggaugggcguugguggcugaaucucuagucaggaagguagagagagauaagggcuccauugaucagaggaugcucuguggcuaacccuacucccaagcaguucgcacugccccagaggacauaggguccugggaaagcucguggaacugggucuguauucccuccagcggguccuagcauggcugucacuaccugugucuccauuugggguuuggcagggcugggucuugauaaugcugaggucuuaggccuaaauaagaagagugguguguugucagccaucaagcaagguugggguccuuuguuaggaaggaaacuuucuucaaacuaaaggcagauccuucccuacccgguuuguuucaaaucccccuuucccuugaagucuccgggcuuugcugggguguugggcagagcuuuuuggagacaagugggcacuggacgacuccugauugucuugcuguacuaggccugacauaggcaggacuucuucugcucucaggaagucugcaaaggcuacgucucaguuaggauugucagcagaugccccauugguacagggccuauugcccaacugugcccccugucccuggggccacagccuugcugaccugugucccuguacuuucaaggguacuuagaggggcuucugugcugguggccacaggagagucuggucuucugaaguggaagugaacugugccgcuuggauucuuccuuuucucgaugcagcaucaggaccgaucugagcagacucuuccgucuugucacaggcccucagcauggguuagaacuauauuauaacucagcccacacugacaaggaaagaggagggaaaccugguuuggcuuaggaacaaggcugugugugguucagcuuuuauugucuuucgugaacaaaagauguccguuccccuaaauuccggaagaaaguagagauuuccuccugacauuguuaguuuuaaaucacagcccguucugaucccucacgaauccuuuucaccuuuuccccccguggcuuuucuuuaguggugacgucacgagaacguguucccgcucaucccuuggcuuccuccuuccuugucccugcuugcaacaccguguuugggagcagagcccaguguuugcuguccugccggggcuacugucccgggagacccugccauccggcaauuucccaggcaguguccuguccgucauccuagcacugagaugaggacacugggugaaaguacccgguuccguugcugugucugaagugugcugguggccgcgaaaagccugcugcuuucccuccaugcuccucucagacaagauaaccaccuugugagucgcuguccaaccucugugccccacaagccaggaugaggccaggaccugggcugaaucagcgcagggugacacaggcuuccaaaccuucaccuccgccacagcgguggcugcagaguccauggccugcugcaccaggccuggaggagaugcacccauucaccuccaugaccuaugguguggaagccgguugaaagagggccugccuuucucagccucacagcaaagcugggaaagaacacaggucucgaguggagagcugagauggagguuucugagaacuggcuuguuuugagucauuuuggaaauaucuagucagcaugaguuuaagcucuggaggccugugacuaugauucacaggcucaucauagcuguguacaguguuggaagguacccagaagacaaauuagacuagaucccuuagagaccacacgacuaauccacccaggaggccauuccuccagaccuacugucuucggguguuggccuccuaacaguggggccucauggaggacugugggcaguguggagggcagggagcaggguggucugguggguccuuuguucacauuuguaggcaguucugagaaagcaguguauguggacauuucugucaguaaacaguaugugaccaaggaucaaauguuuauuuucauucuggcaaugccugguucugacaugcuguccacagcugucaccucugcacagaguguccagguagcuuugacugggcucugcccuuucggagauaaugggaacauagugacugugguuucccauuugaagauacuccuguucuguagagauuuggaaucagacuuugaaguuaagggcagugcccccggguguguccuaccguggccaguucccagguuagggcuuuucugcacacgcgacacaguucuucuuccuccucucugcacucugugguugggguuacacagccucucuucuuuuucagccuucuagcccugucccuuaauaauuaaacccauguuuacccagugguaagucauugaauuuugaggugaauuuagagcauugugugcccuuaugcugccuaguucagugcccaucuguauuccagggacucucuaccagaagauagugcugaagggagaaaaauaagauccaugggaggcucugcugucucuggucaugucaccagacuguucuaacuuucuugaaauacucaugcaccuggggcaggaaccacaggcuggacagaaacggcucagaauaagacggagagguuucugcuucugccuccuggggauuggugguuuccagaagcuggagugagcaggaacuaggucaccccaggagacuggaaagagcugauuugucuuaagagauguggguaccuaauauuacaucuggagggagagcauccuuagggcgcguggauguaagcugugcuggcucugguacauccaacucugguguacuugugugugugugugugugugugugugugugugucugcacgugugugugugugcgcgugcaugcacauguacacuguguguguuuuuugcacacacacaguccauaucaccugucuuuaagcaugcaguuucuggcauuagucacagccauacuguuaugcugucauuaccauggucccuccauggacucugcuuguccuuuacagcucuaugacugagcgagugcugguggacacacuguguguuuugucaaccagcaucuuuagggcucaccugccauaggaugugucaauuggccuccuuuuagggauguauaguacucugcugugggagugcacucccugcauguguugguggauacugggcuagugguauaauuccacagcaaauauaacauggauccacuuccaccauauugucccgucuucccggguuuuccugggguagacuuggugacuauacuuggcacucugccagucagacagggaaguccuugucaccccguucagccugaggugagcugcacuugggggcaggcgcugcuguggacagggggcccugaaggagaagauucugcagacaccagucagacaaggguguuuccccucucccugaccaguucucucuccuacacuuguguccugcuucuacugugaacuaagacaucacaauaaaaggcgguuuuaagagaugguuugcaugccaguauaguuggacccucuugcguuugcugaggggaggugguugagacguuguaacugggaaaagcguauaugaugggcagucgauuccugaacagauuugaggcaaguuuugugguccuaaguuaugcacagccaugagaauaucuaccuagauagaucuaccuaucaccugaagaggcaaacugagacagucuguuuuucucaaaggugguguuagauaugaggcaacuauagcuccuggcaagguagaugucugugugacaguauucuucgucaaugugauaacccaucagugggacacuccaucggugggacacuccaucaguggaguuugggagcucagcagaggccacuucucuuuaugacugccccucagccagacuggguuuauguaaccaugugccgcacaggucuuaacgugguacucacacaucagucuuugaggugauccagugcuuccugggcacagacugugugggucagugguuagggacuuccaggcagcuuugucauuggcuacugggacagguggguaaaccuugaguggccugcucccccaugggugagguggguguacugagaguguagcuuaggcaucugcugagauguaagauuugggugccgugggugcagcuggguguacggugucuaaagcagccuggguuucccuguguaguguguuucuaacuucugagagucaacaguccuuggcaugcucaaacccucuacuccuuugucaggcuuggacuuaaguguuccguuacaucuagauuugggagcuucgcacccaccuuuuggugugcuugugauauaaggugcacaggcugaggacugacacuagagacggagugucgaccauuucucuggcaggcaccagcucccuguagaauuguccauucucucuguguguggguuuguuguuauuuguuuugacacagggucucauguagcucaggcuggccucauacuuacuguguagccauugaugacucugaacuucucauccuccugccucugccacggagaagaggcugggaucccagguguguaccaccucucccaguuuaugcugugcuggggauugaacccagugcuucaagcgucuagucgaacacucugucaacugagucucauuauucuucauuugaaagaggccucucaugaguuaaucccagaggacauggccccucccacuuacaugccacucauccagugcccaggaaauauauuccagaaugcacacccacugcccuuccguguacggaggucagugggaaaggaaggccugagcaucugccauaauccaggacaguguggugcccagugucugucccugcugcccuuggcucucucuccugaggguuccucuuugcuccugucgacccauggaagcucaugugucuuggcugggcuaaaaauaaaguccuuucccuaggccaggaauuggaaagacagcauccccucugcuguuuggaacuggacacaagaagcugaugagauaacaagccguugcuccuuuuccuuugcuguccauggguguugguguggagcccugagguguugccaggguggcggcugcucccauccauguguguacaccgccaucugcuuccccaggcuugugaucugccccugagugugaauggugcuuucaucugugcuagcagugacugcagaccugccucugccacuugcagaagcggagugugaagccugcaccgugugcucuuucuggcagggcuggcuuugguggugaagugccagguuuggcauguuagcucacauagggguaagagagggcugccaccugguuccuggccuguaguauauguauuccagaggaggcucugccuuggcauaccacuggacuucuugggucuagccuccaaggugcggagacuucugaacuaaguuacuuccuguuuccguggugauucuggggugagcucugugaauagcacgugcuggaguggagucuuugguguguuugguacagcaaucaguuauaggccuuugauugggaggacuagaaagagugcccaauggugcgugugacugacugguacucacacaugcgcaccuggcccccagaccugcucgcccaggugagugaugacacaggggacaucugccuguccagggugaggagcuggagcagagccgugugcaagcaugaacacucugcccagccuuccuccacaccagggcugauugguaggcccugaguguuccagcagggcacuuuuggggguguuucagcaggguaccuuugggaguuugcuaccacccaccugacacaccaccugcucuugaggggcuucccugacaauucagaccuugaagacccgcccugaagucaugugugauggcuugcuccuguaaucccagcgcacgguaggcugaggugggagggguaaugggaguugagguuagucuggcccgcaguguagaccaucccaucuaggaaucugcccugauuaugcugugaugagcugugcacucagcccaagcggggggcaaaaggcucuguagcuaucagggaccaggugguggcucugugugcaggcuggaccgggcccaugacuugcaaucguccugucucagaggccuucuguccacguagccuuuaaccccuguuccuccauccccuggaacuugcaugaucucuaggaugucuugcugagagagggccaguggagucgaguccucacagaaucuccugccaccucacagguccuggcugccaccuguugauacagcccugcauguuagaucugagacagggugguggucuguguguccacccuggugucccgggagacuccagaugaugccuacuucaggaaugucagcacagguugccauggagauggcuugugguacaguaccuuuguaaagcaacagucuccuuaacaggcaggaauacuguaaagugguccuggaagaaugugcugcagagcuuccuggcuuggcccugugcccaccacacugacuacagggaugaaaacagagucuauaguucaugguggcuucgccugugaacggaggcugggagggaucacacacaccccauccccuuugcucccgugcccccugauucuggcauggccucuuggcuucaccucacaugccauccagaugcuaaggcaaaguuuucuaguugaaaguuguagcccccaugaguagcuccugaaacugcuauggagagcaaacagcaaaccuagagcggucuguguguaaaugugggcagcauuggauccuuccacgggccacgucugugucacugagccugcaaggucagagccaggccaucuggcugguucucuugccugugggucucucgcugagccuggucucucauguccucugccuuccugggaugcagggugcuucacccuuguggccuccuccuccucccacaggagggcucucuguucuuccuggaccuuccucccucugaucaggguuagcuacguccccucuugccccgugccugcugccuccacgcacccugagcugaggaaaagguaccuucuuuucaugugugaaacgucacaguguugacugucuuucgaaucucuaaauggucuaaaauuaaaugauguaaucaagagcaacauacugugcccugccugggacagacacagcacgaagcccugaugucuuucccucaccacaggggguuucuguggcuucuucuuucuguuucuguuguauacacauuucuacacaucacagcgggcaaaacaaaacacaaacauccacagcaauguccauauagaagcaggccuuacaaugaccuagcuguucuauccuuugaaaaacaacaucccguuuagucugaggacuccuucagaccaaccaaucaccagggugaaggccccuuccagccuucccugcccucuccagagucuacacagaggucugugucugagguuccuuuugucagaccccugagcucaggcugucugggcuguuccccaccccugggagauggauuacagccauuguucuugaggccuccuggcugggcugaccgcaggggcugaguuaggcggaggcccuggauccccagaggcagugguuugcauucauuuggccucugccuugugucuggaauugauacguuaauaaaagcccuggugcccagccccucuuacgcacgcaugcagauuuauuguguggucugucugccugagugucugacuuauuaaagacaacaaaauggguucuuucucauccauuauuugaagagaauaauaagucucugucagauuagcuucuugggacucaaagcugaauaguggcugucuguggagcucuugggccaagaacucaccucaucuugaagcugaaaauuguauucugaacaucuuaaauacuguacugcucagcccuggcagaaagcaagcauggacaucuuaaauacugcacugcucagcccuggcagaaagcaagcauggacaucuuaaauacuguacugcucagcccuggcagaaagcaagcagauagaaaccgucagucacacggggcuauggucuucucuguggggcacacuuacacagagaagcagcacggucccuugagcucgcuggccucugcaccugcccucccagggcugguccacagccaaaaucgccagacuuuuaaagaucaagccacggaggaugggaagggagccaaagccaagggagccccugggaccuccuuuucuguccccucaggaaaaucucuggggcaguaagcacuauucucccgaaugaaaauguaggccagaguccuaauccccagggccucaggauggggcuauauuuggugacagggucuuugcagaagucuaguuacaaugaggucauuaagguggcccuaagccagugugacugguguccuuauaaaagggagaccaugggcacagagacaaacucacagaggaggccaugggaggauauggggaauaggccaccugcaggcuuaaggggaggagcccgggcaguccucucagccccaggggagccagcccuguggcccguaggccucccaugcccagagcuaugaaacauaaacaccuucccagacugggguccuuucagggcauccucagauucaagcgauaucuucuagguuauaaauuaacuucaagacaugaauguagacuauaccuucucagugugaggaccugcagccuuugcugguuagacuguugucugggguuuuguuucuagcacaaagacccucugggcaggcugaaguucugucgcuuugagugcaggcccuggggagggagcaugcuucucucuguaguguagacaucacugggcuuuugcugagguucugcugggaaguuggguuuugcccaccucuggugccaucagauuccuucucugagucgggggccuugguuucugcugcaacccguaggaaacaggccucugaggucauggucucucacuccaggggccacuacaggugaccugugcaaaaacugaaagucagaauauaauccaauaggcagcuuuuucaggaugacuuaguucagagguuaagauagauaaagucucaauuauccacgugcuuaaaaaagacugguacuuggggguuuguggauaggucucccuugcccaaaauguuauauguauguuguuuagcugcacagagucuccucugugggacuguuagaacucucccaguuaugggcagagcauggcucugugaggcccgcaguuuucuaugaaagcggauuuauaaccccagaucagguuccgaagaaacagcacccgagggaugggcuacgggccucgcagaacauucuaguccaucauggggccugaggagauggcuugguugguaaaguaccugcuaugcaggcaugagaagcugggcucccagaaccgguaugaacaggcuggguguacuggcacaugcuuguacuccuucucauugcuguggucugugggccgcugcacaagcucuaagucaccaagagacccugucucugagaacaaggugggaagaccaugagguuggccucuggcuuacacacacacacacacacacacacgcaggcacacaugcacacacaugcacacacauguacacacacugagaaagcuaugccagaguguagacaaagguucauuagaacaaggacucccuuuguauggaagcccugugcuggaugagaggacaccaucugcugguugccuggagcagccugcagcugugugacagugacugacacuggaggcagcuggcuauggacuugaaauguacggagaccuaaccccuuuuggguaguguguguguguguguguguguguguguguguguaugcagcagcagccuugggaguaucugcuuccuugcccauauugggcagcucccagugguuauagggugaggccugcguccaggucauacucaugucaggcugggaaccagcaccagcagccccaccugcuguuuuucuaggaagcccuuuguuugcagcugccuacagguaaaggcagauaaaggcccucagcccgugggcaagguagauugucacacaggugugaacugaaggauggggagggccagccuugggcuucaggcuuaggagaccaugcuguuuucuuugguuaucugugagccacagggcaggcaggccugugggcuggccaggggcuccucugugugugggggcugaguggaugaaacagggcauccucugaccucacuugaccugagcagggcacuaaggccccacacgggggcuguugcccugagcugucacccgagaguugcucuucucuggugaccuuggcuucucauuucugaggccgaaaugcucagugcuuccuggagcucacuagaagcaucaggaaaaggcaggaauccggaguucagugagcccaaggccgaugagaauuucccugcuuacuucaggucucucuuuagcucuugcuucgccuucuuccugccgucugaagaagcccuucaggauguaaucugguuagauugagauccaccagacuuuccuaauggggggaggaggaagccacucugcuucuugauuggucccugagggccacauccaggguaugggguacugugauuucaggaugccacuguauccagugucuaugugguucccacuagguagacuguuaugugaugugaugagcuuaugaucacauguggaguguggccaaacguaucagucauucugaagagaaacagugaggucaccuaccuaccuacaagcaggcagccucccucuccuccagaacagcaacgcacuggagggggcauagccagcuugccuggcucuugguaggauccucaugccugccucuggaaagggcauaaccuuccuugacaugggggaggcugaguggaugucucuggaagccaguggucacccaccaggugcccggugugucccaggaccaccacuaccauccugaugggucucccucaccucugugccacaggaaggaguguuccucuuaguguuggguuucuacuugauauuacugccacguggucuauuuuagacauaguacccggagguugucgaagucuuaagugaugcccacuagccuuuaucugcauuugguagcaaggcagcuagcucugggaaggugucaaguuagccaggaccacacaucgcagcuagacucuggcagcucaagguagaauguugggagucucuggccucuuucuucuaguguggucacaugagagauggcaucuacacauaaggacuuuugucagccuccaugugcacccacucuccugggucccccauaaguacagaauagugcagcacccagauccagggcuacuggcucaagcuguguagauggcaucagccuuuguuucagagagguuugauggucuaggaccugccuauacuugaggagcagcuggaguugucugucacugugcccacgaggccauagccagcuucucacccagggagggagggagggcagaaaaacuguggccauuucuaacccagugcaguccauugcuccaaaccaguauucuucaugacacauaccaggauguaguagugccagacgucagaucauggauaggaggcuccuggcuucauuugagcaguagcauguggaccuguggcuuuggcucccuagguuuugucgacauucugccacuuccuuugaaugugucauaccccccccaacccccgugucaaccuagaugaaaacaugauuccugagacucugggcauggggugggaacuugaguuuauugcaaagugagucccauguagggaaucaccccuggugucucaugaggaucaagcauggugugugaucaccacagagguggcuuuuaagacaggugggaauagguccaaaguucugaaaaucaugagaggggauggccaggacccugugcugucugagcagcuggggaccagccagcaugugcuagagggugaccauguaucuggucagcuagucugucccaggacuguuccugggaggcagagagagcuggcacccucccccagacagccacaguuucacugagguauacaguguuugcccucaauucugugaucugggucucaguuuucuucucuuuggaaugggaugcugguauugcuucacagaugugguaaagaucacacacagacuacagggcaccugagagcuugacagccccagaaggugggauguccacaggaagcaucugcuucaggaaggcagugccaacugucucaccgaaaugcagauguggcgucuggugggagcaucuggcuuucugugcacauguccagccuccuaugaaaacaucaugggcugauguucuccuaacaguccagccguggcugugugugcucacggggcaucggugcccaugguccccugacgcuuaguccagcagugugcucaugcuaauagcuauauucucgcaaggcuacuuuggcuucuccuuggccaguuuuuguuuuuuuuuuuaaagaaaauagauuuaguaugaaaagugguguuuaccaaaaagacauagagacagacccagcauugcucaagucuagacugcaggggugucucuggguacucaccugaauuccuggggaccuuuggagucuggccuauuguguggacuacaccugaggaguagaccagaccuacagcauuucugcaaauagcucucuagccaggcacaguuggcaaccguaggccaggccuggccagaucgucugcugcaucagugaugcugagagccauguagauuuaugauucuacccauaacauauuugugcuggguuuaaaaauuauucaugagaauaauuuaagaacaugaaagaguuggagaaguggaaacagcacccagcacucucagccagcaugagcuuccccgugucucguuccaggcugguccauauggauggguauuuuuagauaguuguuuuauuguguacauaaaauuuggucuccugcuuaacauaagcauuuugcauauuugauguggucuuuaucauuauaauuuuuaacgaaugcauaauauccucuuaaggggcuguaacauaaauuaacugcuuaguggagacuauuuuaaguuucuucucuacuuguauaaguaauacuguaguauuuacgcauagaauguguuccuuauuuggcauuaguucauugugaaaacucuccagaagcccuuggguagaugugggagggggagugaagcccaaucucagggccuagaaagagcugcggguugggguucugaucacucuccucagggacuugcaaacacugagcaggguagccuugucaggaugguuggcacucuggggaggccagucuuuggaucaggugugauagauccaccuccuauuguuacauuguagcaaccaccuuuucaucuugccuuccucaucaggaaaaugaggccagcaaaagcacaaacgcauugugaacgaagacuguguuaaguaaaaggcagaccagauggggagguagcagauuaggcugugcuauuuggggcuccuucaucugggaccccaacuggaagaugcugguucugcuccaggaccuguguugggcuggccccucugcuccccugauccagauacacugauggggaaagcccuggaugcacugaagaaggugucuucugaagggccaccaggguccaugguggcuacaugggaccugaucauccaagauacaguggaucuguuugugaguguuugaggcugacauggacagacaaacuucugguagugaauagggcaggaagcagcauggugugaauaggcuauggccacaccagccagggagaccccaucuccugcucuguugcucucugcugcacccucacccuuggcuguacacugugaagugcugucugacugccgagccuuuccaccgcuuuccugucaucuguucggaaguuuuacuuuauuuuaaaaugugaucaacugguaugagucacagggaaaagcauuugcuaaaaaccacucccuuucauguggaagacauuuucuagucaagcuuuugacaugcgucacuucuguaauaugaggggaucugcuucggcuggagccagaagcccagcacaagcagaacuggggccaagagagggcuguuggcaccacugcacaagcaggaucuccauuuauaggcagggaauggauguggaugccaugcccaggucacacccagcucacccacggacuucaccgauuuaccaugaggccccugccucagccuccgagaacaggaccggaccgaaagcugaauugguucccauggcucccagacacacccaggugugauggcuccugaggagcguauauuugggcucagaguguauaaggccacagucucuaaucccugcccucaggcucccgggcuccuaacaugucaccuagacccuccuuccccaggagaugcucuuuaaggucacacacucaguccacagaucugcccagacaaagccaggcugcagcaaggcacuguguagucagagacuccuacugggagcaagauggcauugcaccaaggcccuguggcaccucugauccuccaguagugcagucaagaguugccugaggugacagagaucuucccuacugagucucaggagcccuaggggacugcuccugguggacugggucucuggcagccaucacucuuguguguggcugagagcauuuggacagaaugcuuuuugaugguugugugugugugugugugugugugugugugugagugaaagguuccaugguggagcaccagcuacagugcuccagaggguugagugcuccugauacugucccaugagcacacauagugaaauaaaagcacagaugaccuuugucguagugugccugugacuuguggucaacgaguguauacagagcacauuaacucacaccucacugaaccuugaucuccacaaccugcuugguacagugagcaucucuggguagagcagcccucucaaggcugccugggaccucucagaacuggguuuucaucuccucccuuaacggcugacucucugcaugggcugugaagucuguugcgggcuccuccuguucuucaggcgugucccagugccaccccuguaaggugaggcaggaagauuuacugcuuaccucugugcacacggugugcaaacagcuuccgaggagauccauggauccgugaggcacaccuguggugccaagcugccccucagcagccagugauggggaggagcaccccucaucuucaagccgugcucccaucaggccuugagcucacaaguauagcccaguugcucuccgaggccgaggggucaguguugcugaggucgaguugaggaaaccuguaauguagugugguccucauguggggguugggggccucucccagacugggugcccccuucucgguggauuagaagcacgucguccgguugggugggugguuuggugcgcuccuuugggagguuuguaagaauuuuaggagaugaugagguauaucuccacagugcaggccugggggcugugacccagccuuucugcccuaugucugcuccccagucugcuguucucaucucccacggccacaggcugccccagccacaccucuccugggugacgggccguauccgcuaaaaccgugagccagagucaguccuuuucccuuacguggcugcuuguuggguauuggucacaauaagagcagccagcagggaaaaugaggcucugacacagugagcaggaggugccuugcucugucuggugagcccugucuacagaguccugucauuugggggagcucugucugggggaacaugugggguuucuucugcuccaccaugguagaaccaccuacuccaaggacucagaaauagccagcagucccugcgucccucugggucccuugguggaaauaccuggcuguaagaggguggucuguagcugggagcuguucugcuccgcgagccuggcuuugggcugagugguaccuuaguggguuugggcgucugaguuuugagaugagcuccaagucugaguaagccucuuucagaaucuggcgaccuggcuuuuuauaaacgcaagugcuacuguucugcucagccccggugauaauuacugaacagucucuaaaugacgcugacaggugacauugaggaacccgacauucaggaguauuuuggggacuuguucugugccugaccauauggucuaguagcuaaaaggauuuaacaucgacaagauguguuucaaaagggaagauuucaaacugccuguuuauuuucucccuucuuccagaggaguauuuuuaugccuguuacaaacauggcagaagccauguguuuauugccuccgccccacgagcacagaccugucacuaggcagacuccgucuuccuuccucauagcaggagaagcacagugccugguccccagccuggacccgugggcucugagcacggggcuucaccaccuggaacauuagggcauucucaacaggacugcuggucuggucuagauggauugcuaaggucuguagaugcaggagccuccaaucgaucacgggauggcggggccggugagaacggagcgugugaacagcauucuuagauguucgccacacacuugagggcaccacacaaagggauucgagacaguuccugggaccacagaggaccugggggucuugaaugcuacaugcugcugugaaaggccaccaauggcagccacgggcucacagcagcucgccuagccucccaguuuuaaagcccagugaguagugagacccuguuaucacugacccugccuagcaccccagacucaggcucagguugugugggaagaaauuuguguugugagagaaaugcugaguugaccuggcuauguugauucugugacugccacagacuagggcucgauuggagccaccagcuccggagacuaccucagcguuccgucucguucaaggugaaauagcugguccgggagccagaguguuugagaggucgaaagcccugguguguguguguguuugggaguauuauuagucagaaaauuuaacaaaccagcuaugaaauagaagugggcucuuaauuaaaagauagcaccgugcagccugccgggccggagugggcuguuuuaguuuuuagcaucauucccuccguugcaaagccaccgucugcuguguuuauagggucacuguacagucaucaccaaugguggguuggaaguuuauuuauaacgcaauaaucagaagagcugauuacaaggaucguuuuagaaucuucuggcugcgagaaauuguaaauaggguccagaugcgugcucaaacauuugucacugcguggaggcaggagcgcugggagucuggggaggcugagacgcguuggcuaggugguuuggagcaagugggucaguguccaucguuagcauucccccaccccucccccucugcacacuucucccacccaccccuuuguacaccccucccaugauaaaccagccauaucacuauacugcagaagccaggagaggaaggaaaggcuacagagagaggaggcgccgagaacaggauggcuucccguaaaugcagauuauggucagagcaagugacaccaggaggaaaucuuucucugauccagcacagcacauagcaaagcacacacagccagcccaguccagagaguuuggcuacauggaaagcaggccgggccaccagggaaggugccuacugccaggauccccaucugcaggaagugggcuuccacagggcugggcccaugggaggccuccuguuuggguuaugcacagaaacacuuuucguucacagcaaucggauuuaagugggcggaacgugcauuaaguuguggggcuguggggcuguuguuuaguuugauuuaauguugauaaaugacagccgauugcuugcccagaugggugggauaaauuccaccagaacuuaugucuugcucugcaggcuggcuccacggcaguccccugugaguuccugguguaccaucaguaggauuaauaugcccuuugacauauuagaagcucagagggcccagaccguagagauuucccaggagcccuggucccaugacucagccacuacgacagugcugugcucagcacauggcugcugugguccucauuggaguccugcagagauuguccugcacugucucccuagagcguagucuagacgucucugggugauuaugaggauugcccuacggugggagcacucccugcucugcucgcugcugaggucccggcgugaugguaucacagaaccacucugaagcagagaagcugugagaaggugaagccacagaaacagacgacucacucggugucuuuguuucuccagggugacuggaaugacaucgacuccauuaagaagaaagaccuucaccacagcagaggagaugagaaagcacaggguguggagacccucccuccagguaccgugucugaacuggggcugggcuuccguggaccuccuaauuguuaauggucugaauauagugccagggcgguggcuuagggcgguggcuuggggcagagagagaaugacuuaugcuucuggacacugcccuuuccugucaggaccuugguguguggucagcagagucuaucgagagagaaacagaguagaggauaaaugacaaggucugagcuuacaggucaugaaaaaauuucaaacugacuugauuuuuuuucuuuuucuguuaaagaguuuuagguucacagcaaaguuggcaaaagauccagaauguucacaugccaugcauguagcucccacugccugucuguaucucaccacggugggacacaggaaugggcugugaacugcauuaaaucagggucaccaccagaguccacagugaggaucaugcuuggugguauguagaugccaguagaggccagaagaagguaucaggucccuugguuuuauaagccacaggaagugggacaugagagcucaaccccaguccuguguaagagcaacgugcccucuuaaccacugagccaucucuccagccuuagcuggccaaguucuagcacuggaugaccauccacugccuggcucuaccucagcuuauuuuugcauucacuugcugaauggugucuugguugcuucuaaguuuuggcaguugcgaauaaaguuaauauauaaauacugauauuucaaaacacagcuucuguuccaaagggaacuagcaguggcugauucuaaacgagugaccccagccuaggaacauggguugggugguccuugaugacauugucuaccagggaagagauucugugagauuuuauaauuguagaaaagagaaacaucaugagauaaggcguucccccgcgccaccaucaaggacagcugggagacacggcagcagagcggaaucuccuaggguuuagacagggaguuucagauacagggauuggagacuggcugugaggagacuaaaggagggagagaugaugcugacuagaccugagauguuuguguguggucuccuagaauuuuauuuaugucuaaggccccuuugaguuaguuuguaugaaagaugggaguugccugucuagaguccugaauugaucugguuaugggugucagcuguugaaaguuuacucuuuugcuggguguugguggugcacaccuuuaaucccuguacucaggaggcagaaucaaguuauucucugaguucaagggcauccaaaaugaagggagggaggaagggaaauagacagacagaaagaaagaggcaugacacugagacccuggaggaaaggaagagggccuucagagagaggaagcugcaucuugcuguugucuccuucagugcugagucugacgaguccggagcuuuguaugcuuggguggagacuguagccaugggauuuauuaaacuggaugcacaaugaaaagaccuuucuccagguucaggagaaccugaauguuuaugaggaugucuuagccgcaggucaguuccaggugccaugaaaaggaacacggaugcgaguguguccuuaucaacuggcucacaucagaggcuaauggguggauuugaccggcagcaaguggaguccuggcacuagaacucugcuugggccagaugcugagaauaaacugaagcuuauuuauuuaaaguuccagaugaguugcuguggaccagugguuuucaaccuuccuaaugccaugacccacaaccauaaaauuauuucauugcuacuucuuaacuauaauuuugcuacuguuacgaauuguaaugugaguauccgauauccaagauaucugauauuugacuccagggaaagggugguucaaccccugagggggucuccacccacaggcugagaaccacugcucuagauucuaaaagaugaaauuguuuuuuggagguuuuaauguuaguaaacuagaguuauuuuccccuccauuuuacuucccauuccugcauuucaaaguugcuuuccccccuuucaagacuugaugguuaauagaaacaauguuucagacagcagggauccagugugauacuucagguuuucccugaacacuugcguuugucauuagagauguguuuuuucuagguaucagggaugcaauguccauacuuaaauggggugacaaggagcuggagagauagcucagccaguaagagcacugacugcucuuccagaggcccugagcucaauucuuagcaacccaugguagcucacaaccaucuguaauacccauugcucucuucugaugugucugaagacagcuacaguauacucacauauaucaauuuuuuuaaaaaaagguuauguguguuuagaacaaagcaaaacaguaauguacaaggcaaaaugcuuuuggauaaguauaagccuacuguaugaccuuucuuaauucgaacucuuggccuuaaauggucgacuguuagauauuuguacaaaauaaaaaaaaauuuuuuuuugaagagcuaaaaaauaggcuguugugugaauauguguguaguugucuauguacacacaugcguacauacauacauauauacauggacacaaaggagcugucuggcucuagaguguuaaaucugcccugcagguuaaacccuccauugcaauggcugccuuaaggagguuacuaguccuguacauauauguacaugucuauagcuacacugcuucccagugauaacagccccgggaagcgugcugcagucuaccagcaucagaauguguguguguguguguguguguguagcuuguauguccacagagcugcuguggaugugaugugagccauaugaaggguaagaagcugccgcucccaauuagccugcugggcacucagguuaaacaaccgaugccuguuaggguagguugguagguugguagguuggcugguugaugguugauagguuaguagguuggcugguugguagguuggcugguugguagguauguugugacugguagguuggugguugguagguugacuggucgguaguugguagguuaguagguugccugguuggcugguaggucggcugguuggucaguugguugguagguuggcugguaggucgguugguagguuggcugguaggucgguugguagguuggcugguugguaggucgguugguagguuggcugguuggcugguuggcugguuagcugguugguuauuucuguucaauugcuacuuguauuauggaaggcaaagcauuuccuuucaauagucuguuaucuuuauuaauguucccccccccaaaauguuauaaaaauggaacagaucuauaguuugggggcaaaaugauaaaauuaaauguguagguaaucuauuuauauacugcuauaaaguauuuucuaaagaaagauaugcaaagaagcuauuaccuauuucagauguauauuuaaagauuucuuuuacauccuagauaccgggauauaaagaugcacggauauauuuaaccauaacauacugugauucauuaaacaacacaaacuuucauuucauggaguuuaucuguuaaagcugauuuaaacugugccuugucuuaucaugggggaacaugaguucuggggucagaauauaaggaauuugaacugauguugacuuaauuuuugcuguaucaucuuuucacaguuuaccuuuucucuguuuucuuuccuuugucaaaagucagcagacuguguguguguauuucugggguuuuuauucagaucgguuaauauauuauguauuuuaccaaaaccauaauuauugcaacuuuauagaaagucuuaaauuugggugacgucagucccugacuucauuuuuucuucuccggaauggcacuaucccuucuggaccuuccacuguuccacuugaagucuagucuguuuaucgauagccacacaguagcucacugagacucguauugguguugcacuggaucuguagaucugagagaacugacaucugacagugaugcguucccuacucacagacgugguguauacggccacuuaucccauuuuucucuggggucuuucaucaaagcuuuguaguguccuucuaacagcucuugugcauaguugucagauuugaauuuaagaucccuuuggggaguuccacgguagaugguacuguguuucugacuuuuacuuuguuuggugcugauagacagugacacgaccucucucuaguaauccggucucgugucuugaagucuugcugcaguugccucuggaugguuuguuguugcuugucucguacucuauauacaaauaagcauggccuuuguggacaaagaugguuuuguuuccuccuuuccauccauguagcuuuccuucuucuuucuugacuucucuguucacuaggauucuuggugcaguguggaagaggaugggccucucaccuugucucaucagugagacaauggguccucauauugucucagacacuugucucagacaugaguuugcugggaguuucuguccugaaggagugcuggguuuugucgggggccuuucugcaucguuggauguggucacguccacacuuuuaugcuuuguugauuguuauuuguccagccaaccuugcauaacuauuuuaagucccaccuguagaauggaauuucuuuuguacauucccugauuuaauucgcuaauguuuuguugaggauuuuugcauauguucauggaaaaauguggucuguaguuuuguuuucuucuggugcccaugacuuugguguuaggccaguuccuuccaguuccugcccacaacugcuggaugcccaacugaggagccaccgagcucccagaaccacucacucacucagcccacacucccugcagaaguaggauguucacaguaagggauccucugcacucugacgugcucccagggguuguccucugggagcaggguuuuuagcaauacugguagaugaauuagcgauacucuggagaugacugaaguagguggagacagcguugagugagaacccugcaguaaaugugacuguuucuguagagggcuuaagagggaaaaggaacugcaggcuagccugagcuacguagagagacccaaucccccaaacaaacaugcaagcaaaagaauccugcacaaguuagagaagacucuuuggagauucacucuugcagauuuggagcugagcaaaaccucauggauguggagcagcugccuccugcccucuguggagcugcucauucgauagcaucgauaauucuaagccaguucugugcggcucuccuggaacaucuggcagcugcuuagaucuuuugaugaggugccuuucauugcuuugaauuuccaguuuuuucaucccuaauaaugaguuauuuuaggaagccuuauuucaggagagguucccuacaguggcgaucugccacagcagacacccagcaaugcuauccuucgcauucuucgcugugagggcuggcuugcuugcugccgucuuggccuucccuucugggcugggcgcucguuggagcagggacaucaugagguuuuucuuuuaagcagaggaaaauuagguucaguuugagaucagccauggaguugaggggcuucauagcauggucucucuuucuguggguuuuuggcucgcuugcuugcuuucccaugcugucccaggagaagguagugcuacuccacacaggugcucuguccagggggcuggcguuugcuugagcugccuuugcuggggagcccauaucugugccgaacucagagccuuggagccccuaucuugcaggcuccuguguauugcagacaccuguggugaccaagcaugcaccccuccucaggagcaugaguuggguaccccgcccuugcuucccaaagccucuaagcccaugugcaugugucucucagugccugguuucaaacaugcaccuagccauguuaguucuguaaaaauucaucagagguugaugcaauucuucuuucaaggauagcguuuaauuaaaaacaaaaauuuuauaaagaaagcucugcggucuuuucaaauucacuuguagaugaauuguuagaaacuugacaucaacucuccuuuggccccgaggaguccucuguuccagucucccaggcccagaucuugguagauagcaucccagggccucuguuccuguguguagcaggccuauggauauggcugccagcugcucuggccaagggaaggugaugugggaaguccuugcacugaacuggggaguccaaggaucgcagccagaggugugacucaugagccccacaggaggaucuggagcagaaagagaagccucugcagcccagccaugucuaacuaagauguuuaguuguaguccagaccugcagucucaaugucaggaggccucuccgggagucaucguggguaaagaguggaggaagcugugaguggccugaggguagacaguggccaggacaagauagcauagaauggcccagaagacaaaggcagggguuuccuccugacagcaccauuccuugggucaccucuucauggcccagagggacucaucccuugucuuccaagggcgauggugguccaggcucacccuuuccugacucugagcuguuguuuccauugcugccaucugugggcugggaaugacaggcaaggguguccccacauccucuuacuguuagcccagccccuccuccagcuugccuccauuggccaucagaguccacagcagugaguggacaggagaggaaggcuacccucucucugucucauguaccuggagauggcauuacagagagcuuuaaggucugugaaggaaguuguuuuuauccugaagagccuaagcuuugcucauaggcuuccuguuuccugacugccaguuggccgucucuuggucugcuguagagggagagcgagugccagcgugaagcugugcugugcucuuccaagucauacucggcuucagcugcucguuccagggugagaccaccguaggaaagcagugaucaaucagcagggucugugacauguuggguaccuaggauguuaagaguaagaacuagcagguggccagggcucugaccaagggauucucaucccaucuuacggggagugggagacuggagugagcuaugaggaugaacaggaaccucauggccagugcuccucagagggcauagucuucaagguggccuugggcugguugugcacaauuuuaagagaggcagggagccuugcuggcugccugaggcuugaguaaggaccugccagcccuuccuguuccaacccaggcaguggaggcuguacaucacucuucccuccugccccacuuugagacaggguuuuuguguguaccagccccagccguccuggacucgauuuguagaccaggcuggucucaaacucacagagauccaccugccucugccucccgggugcugggauuaaaggcaugcccucacucccugcagcaccucauuuuuuuuuuaauggcugguuucaacauacacaacagcauacagcucagcccagaggucaugucugagagaaguccacucaucaagcaaacccccugaugacuguuuucacacccccggccagugaguaccugcuucacaagcggcuugggugaugugccccguccuucucgugaugucuacaugcauacuuuauucccgaugccuccugugagauguuaucucaggauuuuccauuagcccaagguggggugucggggaggggggcuccgacuggcggcuggagcuucuuccuuaauccuauuuccaaaccuaucaaaagauugauaauuucuugucugaaacuuauaauuucuaaaauggaacauuuuaagacguuaggagcacaaguagccuguaaauaccaggauucgguucauugccccauccuguggcucguucugccugguucucagcucucuguaccuggcugccugccugucuguguggguugggcucagguguaggccucacuuagagggcagggccaggcuggaguggaagacaacugagagaugagcuguucuguuccccugagcuggccuccucugcucucugcggucugugccccaggagucuccaacccgacaauucugcaggauacagaccaauuucuacaauguucuugagcccaguguuuuucagauuauggguuccaaaccauuauuagaugaugaagucaauuuucuguuacacccacgugaaaacaucagcugcaccugugcccgcccguccucccuuugccgaggacgggcguuaacugugaggcucuagccauuuguaggacugccucacagcuucugagggcugaggugaugcgugccaucgugucacagcuagaugggucugcaggcccccuccguggcauucucacacccuacuaugcuuucugaaagcaaaugguacaacaucacagcaaggugggaccuguguccagcugcaggcagauggucauggucagagggaggagcugcuggagaguccugacagugauugagggaucacaggagcuccugaccucagugcagacaggccuuccguggagcuuucugguccccagguucagcuaugcuucccuagucugucucccucccccucagaacaugaacgcuucaguggggccagacaugagccugccuuugcucaucugcgccuuuggaacuagcaugauacccgccugugaccagugccucagagaccccgaggcaagugugugagagguccugcaauuucauggucuguuauaccacauaaaaccuucuccaugacuacaugucacccuagagaagacauaggacucuugacucuagugaaagugcccacaggaaggagcugaagcaagacugacuggugaaugucugggggaggcgcaggcuauucuagagccuucucccuaagaauaggccugcauaugaggaugacuggguccugucugccaugcugggguuucucgggcagccacacuguucacugcuccacaggcuggguguccucacagcugcagagaguauuccuaaggaggccucacaggaggcugugcaaacacccugucuuaggcuguggcguuuucuacacuguagagaugugccccucucccgauggccagugauucugcugacagcagugggacucagggaaggaacguuuuaggcguguugagugcgugggcuguugcaggagugagcagugaauacccauagcccagggguguuuagccuccuaggacccucuucacagggagcaaagggaggagggcauggugauucuagugaggucagaacagucagcagagcugggcguggccgcaggagcaucauccucagcuaccuagugaguuugaggauagccugggcuacgugaaaucgaucaaccaaaagaacagucagcacgauggguggucuaagucuagcauccaccuugcccuucccuccugccacucaccauagcaccauagccauugacucuccuggagccuccaucuguaggaggaggccuagagucucccucucucucucucucucucucucucucucucucucucacacacacacacacacacacacucuucccacacccucagcacugucucaggauagccuugcccugggcucugguuuuggacucccaacaguccaaacauuuauccuguggcgccugauugcacaguggagucuuuuauuaauuuauacacacauuguuuccuuugccugacggggauuguuuggggacaugaccaaaauuccugggaagguaggcagacagagaacacccccuucccagaacuccauggcgccugaguugccgacugucuugcgaggcacugagugaagugugugcuugggcuuucacucuugucuugcagagucuuggcuuccaugugacgacguucagggcccucucagcuacucuugauuacaguuguccuccugugaacgagccaaggccacugucgcucaaccuaacacuugcugccgucucuggcgacacucuggucucguguccgcuugucccacacccucugcuucgcuuuuuccaggcaaaguccgguggccagacuuuaaccaggaggcauacguuggcgguacaaugguucgcucugggcaggacccguacgcacgcaacaaguucaaccagguggagagugacaagcugcacauggacagaggcauccccgacacccggcaugaccaguaagucucugcaagcaugcggggagagcuggagaaucuccucgaagcgcuggauuuccucacccaggugguggugguugucagagcaggcaacauccuggagugagugaggcucauggcucuuggccuucugcaggggcggcaggcuguuggccagcagagaaagcuguaugggccuugugcuugcugaucuuuuaguauuuuuaagcugcacucauaaaacacuuuccacagucuuggaaagaagaaaaucuaacuuccucuuacuggggacagcuguaguuaggaacauucuggaaaccggagaagagauuaacuaaggucucagaacagggagggaccaggaggacaggagaaggugcugcacccccaacacuguggagaagggccgauuucaggccucgggugggggcacccugacuccgcugggcucagcucgaagcacucucagacauggagacuauucugccacugcuuacaaggaaaggggugccgaaggccuuggucauuucccccacaucugucuuuaugucccagagaaaaagcaggggcacuggacuaggaggugcugacgacaaagccagaagggcaagcgagcgucuauuugacaggaucauaguccccucagagaccggcucugcuggauuuguaagggaguuucuagauuagguucauugccgccgcgggucucaccucacaggagcagcauaagugugagcuggggucccaggaggaauagaaacuggaagcuagccgagcuucgacuccuggcagauguaaggugcccagcugccucacguuucugccgcaggagugcugcgccaugguaaacugcgcuuagcauugugagccaaaaugcacccgaauuucuucauguugucagguuauuuuuuuuauuuuuagucacagaagugaaaaaaguaccuaaucugggcucucagccucaggacagagcucagcagucagggugaaaugacaccuggcuaucugagaugacugaaguuugagcuccgugugaccggugagcuuugucaccagcuggugcuagcuggcuuucccacuaagauuucaccauggcuugcucuccuuugagcaggaaaaggugugguuuggggcuugucggcagggggcugggcucugagcugcugccucuccugugagcuucugaaauucccucagacucugcagacggauuuucuuucaguauuucuggaaugauuguuuacccaaacuaauuuuccucccaggauggguugauuucugccuggucugugucggucggccuccuuugcuguguugaagccguggcaggguguguguguuuccccauuggcugaauuggguuaaauuaaauccugacaggcauuggccacuuguguuggccccgggaauccaucacagggcaucagcggaaaguaucaggcuuucucuucagcucccugagguuucuauagcaggaacaccaugagccuuucgugugagagccuggcuuuaacucugaagaccucacacaacagaacucagccucccaugucuguggagcuggaagcagaccaaugagagcagauucaggaugagacacccagacccuauccgacuggcacuuccgucugugacuucuguccccugcaggauggcaggauggcgauuguucugugcucuuuuggcucacaggaccccaccccagagucuucauucccucugaccagcagccagugggagcauggguguuuauggaugaauugacauggugaagucccgagccuccaguguguuguuguuuggagauagcuucuuucuuaggcaugguuaagguuaaauaaaguugugagaauggccccuaauccacuggaaucucaguaagagaaugaaggggaggaaucggguaggggaagagggggagauggaagacauuaagagugagaucuuccccuugaccgugugaggauauggugggaagauggccaucugucaucccagaaagagucuauaccaagcaccaacccucugucauuggaagguccacaugagguaaacaaacgcagacagaagagaaggcgaccuccgcaggcagccaugggcagagguggcccagcaggucccgugugacucagaggucacggugucugugggucugugagccuuccuggcaucucucagcaauggauaggauaugagccaggcaggucucuuagauucugaggccacuuaugagugcuacuguguggacagugugcagcugcuuccaagcagagcuggagguuggccgaugucuccucucugccaggagcucaagguaauuuaagauuucuucugcugggacaccagcaagcccucauggaaacacaccgucagggguuucuuccugccggccaaccaccaccacuguguuuguuccacuaaaucccacgggacugagaucccgucagccuuccggcaccaagucgggcucaggguuccucuguuucgcuuuagcuugaauuucaaacauugggacuuugaaauaugcuugcaucucaaacuaaaaggugguucagagauuaugguguccugcucaguuccccuccccaccuucccauccccugaggaggagcaucuaaggagggucuguucagcaggcuuccaaacuagaguaucucaucuuugcucaguuugcacagcaugguugcucugcucuggugcgccgagagaucugacguaaacccuucagaaggucuggcuguaaacagagcucacacuuggggacaguacgcuccugagggugucacuagcuucaagcaggaugucauauguugguuggauguuggcaugcugugugugcuugcugucccugggucaucagcacuggccauguucuguuagggccgggcugggacuggaacugugugcuggucaucgccccaacucuaccgcuguuacucugucaaguaaacacugcuaaugccaagaguggggaagcugucacaggagcccgcccgccagcacaggcggaggcccgugagaccuaggacuuuccagugugaggcuuaagaccugggcgagggcagugcaguccuagaguggcugaggaaccagaggacccuuggucuucagcgucuuauauguguauacugcuggccugacauacuucguuggcaggugucaucucucugguggggaugucacaugaggucuccguccuggcuuugcuuccugcacacauucucggaccuucuacgcaacauguaugaaggcgccucugguucacucuggugccucugucggcucuaacaagccuugucuuguaggaggacauucaguccuuguguuugaugugaacucuggaguuuaaggccaguaucucaaggugugccgaguccugcuugcuauacuuucuccuccuguucugucucuggguguuucucuuaccaguuaaaauaucagcuacgauaaacuagcagaguucaagcugagagaauguuacauuuugaacagcacaccucaccacccuaucuuucuuuauaaacacacacgcgcgcgcacacacacacacacaguguaauuucagcaaauacccuucauauccaagccuuucuucccauucucauuccuuguuccuccccauccagccuuggccacuugucccucagugucccugaaguaaucguucacaguggcuccucuuggcaccagcucagagcacuagauccuauugguguguuucacuuguuucugagacacucccccagccccagcugagagugcaaaccucuugguuggccguugcuucugcaucuuucuuugcucucagucacuguguuucccaccguuccuggugaagauagcuaugacuuguucuuuauggagcaguuugucuuugcuuauaguuguacuuuaagauacuucucuaugcuuuuuaguaauuuguaagaauguguggacauugccuucugagacuugagccuguuugggguuugaagggucugagugccgguaacuuccucugccacccuugugagcuccuccucuguccccaaggcccuugucacauucuuguuggguauucccacuggccuucugcccucuuucguucuuauuguuuauuccucugucuccaugcacccugcuuccugcauguauuaagucugccugaaauccuucuguagacagagaacauguagaauugccuuguucugguagugaauagggacagagauacucaaaggcuaucccugguguuuccaucccccaaggaagauaggcuuugcagauaacguaggcagaucacucuugugccaugcagaacugaaccacggguuggguuucuguugggugggagcagucugaaguguccaggccuuucuucuucuaggaagcagcuccuaggauugccacccuaaucucagucccauugucaucagcaaguccugacuuggguccuggccuccucuccacaaggccauugcucuguuggauguauucugccuggcagguaaggggagggcagcagagggcuggccccucucucucggggcaucuggcugccugcagucucuccagcacuuccaaggcaguuuccgcaucucaucccugccucucugcuuuccaugaguaguuuuguccagagcaaagaacuuuauugucucugaaugcagaggaacaccugaguguuucauuuaguucuaauuuagcugggaauucacagcuccugcaucucacccugagcagaagugucaugaacauggggacggacggcguggacguggggacggacaccaugacucuguuaguaguucugucacuuguuacucucagaccacggugaaaaugaucucugaccccgggcuuuuaucugcagagcagucacaguauaaccgugacugucccucggcugucaguaagcuccgacaucuguggaaauacggaaaggcuugugaaccccuggcuucugugccgguguuggucauugcuguccugugaccaguggcuugugggaaucagguugagcagaccaggcugugcucugggaagcuuuguucuugacucguguggcacgccacgccgaccucgaggacugacccuggguaugcuguguugcuucauugcuguguggcucuuucuguagcagaucagcagaaaaccagguuaaggaaauaccuuugaaaccaugaccugccuacuacugagggaaucagagcagggaaaccagacucagcaggcuggccggguaaaucaggucaacccaggcuggcccccgucggcugcccauuugaaagccuuacgcguuuguuugcaaugcuggaauugaacccaggggcucauacaugcugggcaagugucccccacuaggguacaucuccagaccuuuuuccuuuuuauuuugagacagggccucaccaacuuaccuuggcugauuuuugaacucacucuauagcccaggcaggccuuaaacuugggauccuucugccucugcccuuugcccucugcccucugcccucugcccuuugcccucugcccucugcccagcucggcuuacaaauacauaguggcaggcccaguucuuuugucuuugaaauggaaaagcuucguguaguguaugaagguggcagaauggcacgauaccuuucugggucaguuggccuacacucuacgcuuggucacgugauacggugucucuugcugaucagcagucaaggacauugauuaaugaaugauccugucuguugcuuguugcaaaccaugugcccuagagauacuggacuuuagugauagaccccaugguugcccagaacccucacuucagucuaaaaauuuuaaaguucagacuucuacaauaauagccauuuaccuuaaugauacccuaccaaucaaccacaggaggcugguguggccagaauguaugugcauacacauguuacugugugcaugaaugugugcgugccuaugcgcuuguauagcgaagugaguucagaggcacguugugaggacauuagcuugcccucuuuguguaggcccauuugugccauggucacagaaggccagugcuugccaggguaucaaugugucucucuguuccagagaucgcagggcagggccugcggguuugcugucuggagaggagcuggucuccgcucccaggauugccccuuggcugcugugugcuccgggagagggaagcagaagguggaggggucgaacuucccguggaaugauguaugccaagagccauggugccugggcuugccccgugcgccugcucguuccucucggggcuggugcgucuggcaccaguggcagagagaacacggcacgugucugacaggacacugcagacacacgggcaugcaggcuuucuuccagcaugucaggccccucucaugcguuaaaauuugcuaccaaacgugaagagaguuguccacccguggccuuuucucucuguuaugauguagcugugggggacuggguccuuacuaggugcugagaaggggaugguccaugacagaggaucucccuggucugugcagagcagccagcaucaccucuaagggggccgcagccacuaggaaagcugugguuuggggguuaccuugaggucugccuugccaucucccugcucauggcuguuccugugacuggggugcuggcucucuggccacuagcagagucccuaggccgcccaggacuccaguuuccucuguuguggcgccggaggcuggcacacacggguauccucgggcagaagcucuguguccucaccugagggcuuacuuccugcaucaugcuuggccuuaguggcgccaagccacaggagucaggguaacauaauggcaaugacaauauuggggacaagcgugcuggcagccaccacugcugcuggacgucucucaggcagauacgagcuggaucugccacaucuuguauggaacagccuugaguugcaaaccccccuuguccuccuuucuuuaaacgcuccuaguuucuuagacugcuuuuucaauuauuauuuugaggguguauuuuuuaaguagguauaucuauuguauuuuauaaaaagcaaaaaggaaaccacaccagaaagcuaagaagcacucacagccuccgaaggucucugaaggccgucccuccugacuuguccuuguccuacugcugcucaaugccagggaagcccagcgcccaucugccucugagccucacacgggaagcaauuccugggguccuuuuguggccauagcuuccacuccguguggcuuugugccccccaguuuaugcucaugcacgcaucucucucaggguagacgaggacuuucuuuucuuuuguccguacugaccacguugggugaaugucuuuagucauaucuuuugcugacugauuugaaagaagauauaacuugaaagagcacuguguugcuugguucugacaaggucccaacguuuauucuguguagggccuacacucuaggcugauggagacugccgcuuaguuuggaguucgguuucuaagucagacuuuguggggccagcgcccuggccuucuuccuccuccaguuugauggcuuugguaaaugacuggaaugaucggaaggugaaggccugcaucucuucugcgcuuccgacucuuucauaggacuuguuucuuacacuucaucugugaacacacaccucucccauggccauuuuaaucaugcuaauccuuugauggccucuaagaaauuacauguggugugauguuggcaugugucgaccuuucccauuaccugaagaugucuggagaguuugucuucccagaagacagugcugugugugcauuccuacgcugaggucuccagccaucaugaaaccucugucugucaccacguugaggagugggucuuccucccucccaucucucauccuugugagcagagcuccuauuugucucagauucgcccacaguggaaggggaagccccgcucacccacugaguucuguacagacuacuuugugugucccaugcagaacuguccucggauccucacauggcccuugucaccuuaaaaucacaguuacuguguuuacccucacaagaucaggcuuuuaauauucucuggggggagcuugccaagauacacgagcagcuuagacuugaagagggcagagaccucuucaguuguaucacuuccaggaaccuuccugucgccuaccuccaaacucucuggcucucugcuggucuuccaucgacaccguaccuggggugaauacaugucugcucacuucauucuggaaaguucuguaacaccagugcauugggguccgccagcccccuaggcuccucccacauacccacaccgugagcgccagagcucaggcugcagugugccugagccucuggcguucuugucuuaugaaguguaguguuauugucucagcuauuuuuaagccuacuuuaaaauaaccaaaauauugcuguuucccacuugucugaaguucugcucuaacuuuccuuuuuuaaccuuguacguguuuaggcgacagcuucacaauuguaugauuuuuuuuuuucuuccugucaguuuaaacguaagccauugguuuucugcccccggcccguaucguucagaagccagauguuacaacugcauguuauuuucuugcccgguaccuguggccuugucaucacugucacugacucucuguagcuagggauuuugcugcagauguuucuaaggccaucacacacauuucuucccacuuggcuuccacagcagccuuagaaaguaggugcauucauuauuguuccuguguuguauugacgagaggacugagaguuagaucuguuuaagcuaaggaaguggggggcagcaugaacacaccugucugcagggccaugccucacuucgugugugugugcauguaugugcauguguguaugugcucacaugugcauauaaguaccuguguucagcuuagaugccccagccucagucuucuuacucacauguuuucuagguguguuuaacauguuuuuaaaguacccagagcugucucagagugcagaacaggccugcugcagcaggcugguugguugcccuggaaauguugagccuccugaaguuuggaugccugcuucuaugucaucacaggcuucugcucacgucuaagaagaucuguguaaccaacggcagugcagugcuguaaucuggcacacgggaaggaacguaaacuuacccgucguguaacauauuuacuuugccacaccauucggccaggccggaguggcacagacaggcugcuuuguguuauuuccuuuuguuuuuuacacugcacuggggguugggccaggguuugcuaacacuaggccagcgcucucugcugagccccagccccagcccccauuuucacucaacuccccauucuguagcucagccugaccuuaagcucccuauucuucugccugggccuugucaguaguggagacagcagcgcccccucuggcccugccguuuagucuccugguguguuuauguugucuguuuuaccccaagucugcucaguucagaacugauucagagacugaaucaggugaagcucaucuggcucaugguucuagaggcugcugcucuaagccgcugcugcugcugcuuggccccuggugagagccugcgcugauuuacaaggcagccuugggggagccgugggcaggaccccaugcuccuggcuuaccccuucuuccaguagacuuguggaucuugaaucccguggguccgucgccgucuuugacgcagacacaguuuuguuuacuagccaguccuugcuuuuuuugucccuccaguugguugacagaauuuguuuucuacuuauaacucaauuaguugccauuuucagcaagaguaguaauuagacaaguacugguuuaauacuaagaauaaaacucugcccguucuuuaaugaggagcacauaugcuugucucugucccaaucccuuuuuguucuguuugagaucugggcauuagauagauuaugacagucaucuuaauuuuugugauuuuuuuuuuuaauuugugugcaugaguguuaugccugcacgugugucugugugccaccgugagaacagugccacuggguugugagccauccugugggugcugggaauuuaucccaguucucugggagagcagccggugcccuggaucacugagccggcuccccagcgcccugucgucguccuuccaauagucgccauccuucuuccagagaguuuagucuggaggauggagagauaucaccuaugucucucaagaggacgcagguuucauucccagcgcccacaccuggcggcucacaaagcuccagggaaucccaugcccucuccuagccucugaggaugcugcauauacacucacauacacguagagcauuuucauuugcacaguguuguacacacagguccaaaacugcacuggugugaggugguuucaugcuuccuccugcuuuguaacuuguugccccuuuaaguuuuuuuuuuuuuuaaaugugauuacaccuuuuugauguuauuugcgugcgggugcacgaguggcagugcacaugcagaagucagaggacagcuugagguucuuccacugccuggcucccagggacugaccugcauuugccaagcuuggugguaagcgccaaggguugagcagcucaugggugcugccugaagagaugggguagugaugauguccugucuauagcaugaauggugacggccaccuccacgcacccagggauuaaauaccugucuauccuuaucucugaaaacagaggauccagcauggccugcaguugccagcugaucuguuugacaagggcagaacauugaaggcaucuguggucaggcaguuuccagaccuccugcugggcagagcucaggaucuuggccauccgcuccauguagggagaauggccacccuacagagcuccgaggcucuggcauucggccuggaagagauaagcacaggggggaacguaagccgcucacccaggcaguucaugggaagguugcccuggagcucagccacuuggaugccagaggagcggagcaaacggaggcauggauggcuccgugugaggcaggacugggccaucccacguguggaagcuguaguuggaggauaucugcagcuggggacugaggcaggcaucuggggaacccaggcaggcaucugggggacccagacaggcaucuggucaagcaagggaaggagugcauugugguuccuguuggcugcucugcagcugaacuccugggagagcucugucaucaggaggaaugaguuuaaagggacaggucuugcuuugacucucaggaauggcugcuggugagguguucuuagggagauuaagggagcgcucacagcacuguguaaggcuguuauuuucucaaaguuuuccauuaaaagcuaacgucuggaaaacggaaggugguggaaagugggugauaguccugaugaaagaguuucacugccuccugcgacagcucagccugcagaaugcaccccaugaggcucugcagguucagauuuccucugugagcuggcaccaccucccaggcugcccagccugaagugugccaggccagcuacuggccccgucugugcuuuugugcugaacccccagccucccaaagggcacggagcuuuccgaggcagggcggucagugaggcaggcagcgucuugugccaugaggugaugagugcugugguuuugaacuuggcuccucugauguuugugguauguggugccaggacuauagggcgugagaaagcuguuuuagguuaauaauggugacaugagauaaacaaacccagggugaacagggcuugucagacccuggcaaccagaccuuaaggagccuaauuucagagcagucugcaaaggucauuaaguauuuuaggguucgguucucugguguuagaagacccagggcauucuggguagauaucaggacuggcuaggagccagcugggaccuggauguccgucuugccccugcuguugggagggccacuaagcauuuugguuaagcaagcauuauauaacagcuaguuugguucuuuuaacuguuuuuuuuuuuuuauaucugccucaauuuuuaauucagaaguuaucaaauuguucaccuaggcuucuggaaaauuccauagcaaccaucuugaaauguagagcugucugugcuauuuugcugggcagagcuugagacauguaucuagcucagguaggaugggguggggcuguuuccagcaagcccauucuguguaucugacugcggcugggucugccguaugugccguuggcugugguuagaggcaggaacucugcuucugcaguaugcugcugccaugaauagcaucucuccacacaguguggaggucucucaaaaaaacaaaaacaaaaaaacaaaaaaaccacaaaaccauaucuucugacaacggagccauaccacuccuggggauuuaccuagaggacauucaagucaagaucacacagacagacacuugcacauugacaauuacagcagcgguagucacagcagccacguuacagaggcaggccaggugccaucagcguggggaaaggcaaggacacugggguuguuuucagcuguaaagaaggagccgucaugccauuuauaggaaaauugaugcaaucauauuaggugaauaagccaaucucaaaaugacagacaucacacgcuuucucuuauuugcagauccuagacuuuauauagacuuuauauacauaaaaucauguauguauuuaugacaggaagguagaaaugaagccgucuagguuggaacagaggaggcgcuugggaagggagggagagguauaugggaaacaggcuuaacacaacuacauguguauaugaaaacuuaaaaaauaguuuuuacaaaugagucuaaggguagcugccucagcacagccuggggcucuuugccuggccugcuugguuacagguuacaaucaguguuccgcagagccaggcaccugcaugugacucagcucuggguauccccggugagccugcuauccccuggccagguccggcuuugugaugguggucagcugucuguagcuuuccagcagcugcucacccuggaugccagcucaggaguggggaacguguuuccagcucuggcuuggcuagcacuccggccacacaacaggcuagaugacuguuccagacacuuuggaaacauuguaucaauugccaaggcagccacugagaugacagaucugucuucccccagcugagaggaacuggggggggggggggcgaauucaggcuuccagugagccacugccucugcucagggccuacauccucccaguguuccugugaaagcaguccucacugcacuuccgugccccagcugggaagcugaaagaucuaccuuaaguucuucaggguuuugagacuucugauuguuagcaugcuguagagacucacacgucguccggugaguggcaaaggcagaaaucagaccagccacagggcucccagcuacguuaucuucccaccucagcagcaggaacagaccucagcucaggacagaguggggcacaucucacugucuucacagagccaggaggcuguucccuguucccaguuccucuuggcagaauauagaacucccuacaucuccaggugaggacuaaauucauucaagucaacuugguucuuuauaugggguagccuggucuauuccaacucaaggugucagaaccgcaggcuaacccugaagcagaaggaagugggggagggaggcaaagugagcaacccagaggaaacagaggacugugugcagcuucucucagauacgcccccaacgaucuguaacaaaaccagaaaccucugauagguuguguguucaugagacacccagagcagcuaagauaauaagacaguugcagguacaugucuacgaaaagaaauguaaauggaauagauauuuuucuaggaaaauauuaccaaaaucacucaagaaauagaaggcacgagcugggcaugguggcacacaccugccaucucagcucucagaaggggagaagugagagguugcgaggccuugggcuugcgguggggugagaugagagcaggagcgaaucacggcaaagggugaagagcguggagugacucaguacacgguuaccggugcuccuuacuccuugacggagacuaggcagggacagugugugugucugcuccuacgugggaaccugaccacagcagggugguguggcaaagcugugugcccaggcgagcagcgacuauguguccucuccgucagcugaguccucggagguugauaccaugcuguuuagggauguauauaugccuuuucucugugugauuaguuaaaagcauaccuaggagugacagcgcaccaaaucuggguuagagguucccucucccgacacuggggguuggaaagggccugaaagggugguaacuguugccugugagcugccguaaagacaggaccacagagugaaggcccuccugcuugucacugucccuacacgggccagugagcuacaucacuaauguccuggugucugucuuaauuaggguuuccauuguugagaagagacacuaugaccaaggcagcucuuagaaaggacaacauuuaaucagagcuggcuuacagguucagagguucaguccauuaucaccaaggcaggaacauggcagcguccaggcagacauggugcuggagaagaagccaagaguucuacaucuuguucugaaggcaaacaggagaagacuacugucuuccaggcagcuaggaggagggccucgaaggccacccccacagggacacacauccuccaacaaggccacaaguagugccacucccucucccacggccaagcauauucaaaccuaugagucuauggggacauuccuagucagaccaccacagugucacacggggugagaagaaacccaggaacccucaucacccuucugaccguaucguugcuaggacuugacccuccccuuggguauguacauguucuggccgguuucuuccuguguauccucagcuucaccugugugaugcccguggauaacgccaggaccaguaacauguauuacuggccacagugacauguauuaaucccugcaaaugacccaacggcauuuaggaucauccaguguaugucugcagcauccgucugucccugggagucagcuggagcuuugauuuaaugucagaaauaggaaagccaagagaaaggaaaaccuuuugugugugugaagugcgaggcacauccaggagaggcaggauccuucuggaacucuuuagcuaaacuaaggguuuucaaaaucuuuuaauuugacuuuuuaauuuccauacacacacacacacacacacacacacacacauuguauuuauguaguuuucccuagccccuccccuguccucucucaaauccauggccucuuucucauuauuguuacacacacauacacacacauguauauaaauacaaccugcugagucuauuugguggugugugugugugugugugugucuguauguuaucuuuaugugucugacuugucaaguugccauuuuaguggacaggaagcuuccagaaugacagugccaguaccaagucuuuggagccucuagugaaccagggcccagagugggcuucugcgugugucugggagaagagacuccagcugccucguucucuugcuguugcucgcucuccauccugcuuggcugggaggaagcacccuacagcugauggacuuguagcagcugccacccugguucccacugccuccagagcagcuaagacuggcugacagggccaagcaagacucuuuaaaugcaaaauuaauugcuucucuuuuuaaagcgguuugguuccuccggggccucaucuggguugaguguggggcuuaucuggaucugugcgcacacucgcuccacccgugggcugugagagccuucagcucgcacuccuuaagaaugggaucucgcugaagcuccugagugcccagaccugagccugagccuuaggaauaugcagaggaguuuuaauaaaacgcuguguagcagcagccugcuuguuccagcaaaugcuuccagagccccaggagacuuccaaaagcuccuggaagaugagcuuccugcagagacgaggagaaugagagacuggggcgugauuggaugggcccggaauccagcgcucugagagugaaaaaugcuauccaucuucucacggucccacucggcccugugggucccuggagucucccaacccaggucugcuggcucagucacuccugggcuacguggggacccggguacagagggcagugagccucgaagcauggagccucucccccuuacagcauuacagauuggccucuugacagugaagccauuugguaauuuguuuacaguugaaacuugauagauucuucguucaucuaccuuccugcuaauuuuuaucaauuggcuuguccaugaaggcucgucuacagugagugagaucagaugcuaacuguagaauucguucccugacuccccacaaacaacugcuauacaauuuuuugugugugauuaauuaaaaagaauguacuauaaugacuaaaauuaaccgacgccccuucugcaauugcagcccuaauugcuuuauaauugugcugcuuuucuugcugcugcucacagacugcagggcugggcuccucucgacaguccuggggaagcacucaucucggggcaccugccuugcccucuccacaccucucuacugguguccggcggcugcuaugccagcauccagcucacugcucagcaguugaguguugagcccugacugagcuccaggguucuuccagaauccaccuccuuucccacugauuuccauucaagauaacugggggaaucugaugagcugcaggguaaacugagucuucgguguguuggacccauggaaggcucugccacuugaagagaugauaagggcaaggagggguccagaggcagggacuggauuuguggguucccuccucuucaguacgcccugucaacccggcugcucugcugggcuccuucucagucuggugucacuggcaucaccauuggccacuugggacucuggcuguacucagacacagcugacagugucccaaggcucugacaaggucuucacccuccuaggggaguuguguagagacucugggacacugcucucugccugcauccccagaguggccuggaagaguccacgugaguucugcugagcugggucuuacuuuacugaguauuuugaccauguuauacuuguuauccucaucagaagaggcguggcuuuaaaacuggucuucauuggcucaaguguaaggcguccacagucaacgcagaggcccugugcggcuugccaucuuugcaggccuagguuguuauggcccuguacgugagacaggccuaaggugccugcccaccugccaguccggcuuccaugacacagccugcuccucugucaccagguuacugggagaaggccuggcaggcaguaugaaggacggcaggcaguggguccuuugauacugugagagccaaucacccaauaggcaccuugccuguuguaggcaaagcucaagguaagaagaaagcaauggcuggcuggcguaggucccccaaggggggaaaaaaugcugaggacugaggcaggcguguggcugaggagugucugucuggaagugggaggcuauuucacugcuuuagaacacgugccuuacauguuagaaaucucuucucaguucauacagcuugcagaacgcccuugucuguaagcagaaccuggcuguagcuccugcuuccauaugugcgucugugccagaaccucccacagcuggcaggcuaaccgcagccucucggucuuggcagcccacucugcuuaucgagcagggaugauccgucauugcgggguguauccuuuguucacagggccggucacucuguuuccucaggugucagcgcaagcaguggcgaguggaccugccagccaccagcguggugaucacauuccacaaugaagccaggucggcccugcugcggacgguggucaggugaggccaacggauagcucccagcgucucaugggaaguguuuggggcaccugacaauggcugcaccucaggugcaucagcuggggcuacagacaggacaucagcugccaagcaugggguagcuguuggcuccucgagccaaggccggggaccaaaagagagaggaaacuuccaagcagagcuccgcccuuacaaggcuccguuccucugucuuuccucaguguccucaagaggaguccaccucaccucaucaaggagauaauccugguggaugacuacagcaacgaccgugaguuucaucagccuuccugguuuggggugucugggaagagugaccuaauacagucuggaguggaguagggaccuaggggcagaaaagagauguccucuggagacccugggggcaggacuuugcauaggugaccaaguauguggccuuccagcucagaaccccguguagacucagggaucacuauuguccaccucuuuucucuccuuagcugaggacggggcccucuuggggaaaaucgagaaggugcggguccucagaaaugaccggagagaagguaaggagguccccccugcucgucacuugugaagcagcgugucucugcccucgugagauggugugucucucagugccugugcggugguuucucgcuagugugacagaugcaguuuaaagaaagaaguguuuauucuggcucauaguuccagggaugcaguccaccguggugacaggaacaugaggcagcucgucacgugggcccacagcaggcaggcagagaugggcgugggaacucagcucauggguccuccuuacacaauccaggaccccgguccaugagaugcugccaccuacuucugaccuaaccuuagaaaauuccucucagacauacccagaugucugucuccuuggugauacuaaguccugucauauugacagucaagaccgaccauuacaugccagccucugugugagugcaauacccucucuugcuccagagggaagaaaagaaaagaacgcuuuauucagaaucagauauacgggaacacagagcgagucagauuguuccgaacggcugcugugguggaagaggggccgugugcuuagucacagaguacaaaguccuaagucgguacauaaacaaauauauugguagggacaugaauuagacagaucacaauagagcggaggagccucugccgucgugucagauguauugugguuggugguuaacagugaucugcuggcgauccggcggucauagacacuggagaugcuugguccuaaaugaagcuugguaccgaguggacaggccgcuggggcugagagcuggcucaacaguuaaaagagcacugguugcucuccgggaagacccggguucaaguccugucuguaacucccagucccaggggauccagcauccaauccuugucucuucaggaagaaggcacauggugcacagauacacaugucuguaggcaaaauaaacccauacacauacaauuaagauuuaacaaaaacaguagcggccaaugacuuacgaccugcagcauucaaacuuucccuuaaguucuagucaguauuuaucuucuacacagauauggcuucuucagauuccaguucccacccaccuuccuuagcccacugaaucuacuucagggaaaucucaguuuaugugucucucccuccaccagagccacccaagagcccugucucaguagaugcaggaaggauagucaaagccuaaguuaauuggaauuguuuguacaugaagcuauauuuucaaaucacauuuauauuuacacauuuggaaaguugacuucugucuucugccuguaaagucccaucaguggcuuggcugcaaagguuuagagaaaauguuaaagccuagcuaugaggaauacagugucuccauguuccaggcaugccauagaaucacagauucaacuuugacagcucacugaaggagaacugucccaaacugggagagagagagcugucaucucaugcugaugugacacugcagacgccagcugucagucucaucugugugggaagcuacgggaacaacugccuucccacagccaggucuggaagccccuuggggcgucucgggugugcugcugcuguuuggccucacccucuuccaguuuccagcaguuacagagagaugacacucuggacacuccacugugugaggcugacguggucauucccuggucggcucagacucucuuccaggucuccauguguggcuccaggcacagcaggaagaaagaucuuuuuuucuuuuuccucuucuuuuuucuuuuccacuuuuugcguauggguguuuuuuccugcguguauacuacauucaaacuuggugccucuagaggccagaagagggugucagacccccuagagcuggaauuagauagaguugugagccgcugugugggugcggcaaaucaaacccagguccucuggagaaacggccagugcucuuaacugcuaggccaguucuccagcccagcaagaaucuuuuucuuuuuaauauuuaaaaauuccguguguguaugcgucuguguggguaggucacaugugcagguacccauggaaaccagauuagggcaucagaucccuaggaaccagaguuagagaagguugggugcugggaaccaaacauggguucacugcaagaucagugagugcucgucaccacuaagccaucucuccagcccccaggaucuuaaaaaaaauuaauuaauuuuaaaaaaucauguauuaaacagugugugcuuugcacugugcuagacgcuagagaaugcaaggauaaauugugacaguuauucuuccugccccucgggugcuugcauuuuaauucuggaaguaaauacacaugugaaacugucaugcagacugcuaaagaucgcagggcagcacauuagucauggugggcuccgagcacugcuaugucacugauaagacuggcagccuuaccguccacucgugucucagcaccaccaguggggaccgaggcuuuagcaugugagcucgugugcagagggguggccucaacaucucagucagacacugaagacuugguccuacacaugacgagggugcuuuguuugcacacgugcauuugggguagauccccuauuuaucuaacaguugagcucuaacugugaccuucugcaguuucuguaggagggcagagauguuuuccacacuuuguuuacuuggcaaggcucaaaucccaaacccuguguccauuggaggagagagcagcugaggccucugccaccuccggcuguggccguccuugggcugcucugcuccuguggcccccugagccaggagcuguuagccacaggcuuccaggacuuguccccagauugggggccuucuuuuccuuuccagccuccguagaagcccugcccuuggucugcugacaccucaagcugaaaggacugcacugcagcagaggggagggcaagcccaugcggaccugggccuugcugcgccguuccugcuuucaggccuugaauccccucaaguucccuuuuugagugacuucuuggaagcccuuucagacaguuuccacuuacguucagcucugcaguuguagcaguuacccgaggaaggguuugaacggcuuggaguuggaaaucucgucuuuuuacccugauguagcauauaguugauaagagucauugaaaauccauuuuucuuguuuauaaaggaacuuaaaauacucguccuugcucauuguaaggagccccauccugcccaggugcaaagugucuucugggcucaguacauggcuaaugauaagacuguacaugaaguaccuguuauaauugaucacaagccguucgggcagaauggggccaaagaugacccugguuuuuguaucacagccacacggguuugacucaaugcccuguugucugaagacaacgcuguuuucgaugcaguugccaggcccaccagaccuggcaccauuagcucucaggguguggugacaccuuugcuaucccagccaaguagggaccuggagccucgacagcagggugcuuuaagccauccucuggguauuugacaagggugaugucuauuagaugaagaaaggccuuuuucagggacaguagccuuaggaaaguuaucuuucccgucaccugaugagccauuugaaguccagccuggaaucuaucccauugacugcuggcauacagcuccucggugaugaggcacagggacugcuagcugugccaggcuagcucucagguagagcucccacuacucaugcacuuugaauuaucuccgcaggucuaaugcgcucucggguccggggugccgacgccgcccaggccaagguccugaccuuccuagacagucacugcgaguguaacgagcgauggcuggagccacucuuggagcggguugcugaggugagccucugucacacagaggguuuguguuacguacacuggcugcagguuuccuugucacuaggaaagaugugaugcccuaaacguuguuucccgaugucccaugggugcaggacugucacugcaaccaaagacagcuuucauggagcuggcagaagccuggcaagaugagguggcuggucaccugccacacacacaggcaugcaugugugcacaugugcaugcaaacaaagagaagcaaacaagcuagcagagugccccggcgggcuugucacaugaccucuggccaugcugaggcacauuccaccuuccggaaguguccgcacugguacuguguuuagcccagcguuguuuuccuugcccucugcuugucuuauugacuuucuuuccuugcugcuaugaaagugcuuccuugggggcaauguagcaaaugaaaggaaacaggaugagacgcucugcccgccaccauagcacacguagcaacagcaagucacaaaauaccgagcagccaagagcuguuagaaguccacucucugcccuuuacuggucucaggcagccgcuaggugaggagacugagcuucagggggucuucaguaacauccggaaucacacaggaggcagggucaccacucucuaacacacucuccuguguccuccccugucccugccauguguuccccagcuuggccagcugaggagagugcgggccaaugcgauggguuccugugauucucuucucaucagaaggaauguaaagauuagucucguauauccagggccagccugaugggagcacagggguggguuacugagugaugcucuagucuccgugguccaaagcuugcuuucccgucaaccugcaagcaugcagguggggcggggcucugucaugcccuuggagagugcuucugagcucugcucauccuguugcuggcccuucagcuaacaagcguucucuaaguaacucaagagccacacucgcucucucucaugagcagucagccugaggcagcacugagcaggaaggucagaggaggucggaggccucguguuggugcucacacaguggcucuguggaagguagccauggucgguacaauaacagaguugaguucagaaauggaaagugcagucagcugcugugaggugaugaaaccccuuccucucacaccaguuguacccagaaaccgucccuggcuuuguaguguggacacuugagccugagcuaugcuggugcagcucacgagagggcaacaggcauaucgugguugcgcuuaguucugugacacugagaucuccccuuggagccacugcacagcccuggucugugacagggagaagaggcagcagaagugucuagucagcuguccccucucaugccgccacccugcacaaccuugggacaguggugucuguugggaaggccuguugggauggcagcucuugcuucacuggggucguaacuuacaaguaucuuuccuuccuuugucccccucaggacaggacccgaguuguaucccccauuaucgaugucauuaacauggauaauuuccaguaugugggcgccucugcugaccucaagggugguaggugucagccuugauugguccaccugcuggcugguccucugaccauugcugucccaugaucagcugugacagugauaguggagcucacacugugaugugggcucuggcugguuccuaacagaaaggacuggccaugcgucccuggcaaccccaccccccacugugucucacucgugcgcgcgcgcgcacacacacacacacacacacacucacucucucucucucucucucucucucucucucucucuccccucuccccucuccucucucucuccccacuuuccccucucucucuccccacucuccccccuccuuccccuuuccccuccucuccucucucuccccucuccccccucccuccccuuuccccuccucuccucucucuccccucuccccccucccuccccuuuccccuccucuccucucucuccccucuccccccucccuccccuuuccccuccucuccccucuccccccucccuccccuuuccccuccucuccccucucuccccucucuccccucuccccucucuccucucuccccucucuccccucucuccccucuccccucucuccccucucuccccucucuccccucuuucuccccucucuccuccuccccucucucuuucucccucccggagcugcuauaacuaaagcuaggagaaucugcaguugccccugggauuggagcagaggagccucuacccacuggugggcuggccugaaaggcuccaaagcugagaccagcaagaggcggggccugagacacccccaaagagccaaggacuggcugacugggccuggaaccugucucuguguccucugccagggccaggcuuccucuuguagccuacaugcccagccagccugccaguuugcugcccuggaguccugccauccugccacuggcccaucacugcccacccaccaggcagcaguccuaccuuuguguucaagucuggaugcuggcccucccuucccagccgcccagccacagccugcuucaccaguggguggccuuugugugaauggaccaguaucuuguaggaccacacagccuacaaaugucaccuucugguaccgcucuagggacccaagagaaauuuguucaagcuucuccuuugccucuugggaauugcagaggcuccaguacuucucuggugggagggagacugcaguagacauaacugaggggucacugcuacacacaacguggagcagguuauacuguuccugaucuagccccuaacucacaaauagcaagggguaggguggccuaaggagcuaagcuggccaggaacacaagcuccuccugccuuagcaucucaugagcgcugcuaggauuacaggccugcacugugaaacacagcaugucagauugugggagcaguuuuaaaguuaguccuggucuaggccugaagaaccaugggucccacagagacacuaugugcugcgcugugguucugugagccaacugugauucauccagcucugacucacccccccagguccacaggccugugugcacagagcagcccuguccccagguucccaggccugugugcacagcccuuguaggugcaauggcaucacacaaacaccaguccucguguuucacauuuguucucacauuugaagauuagaaaaccccagccaggcaugguggcacaugugugcaaucccagaacucagggggcugaggcaggaggauugcuacaaguucaaaaccaaccugggcuauauagcuauacccuacauuaaaaaaguaaaaaaguuuagaggggcaagaaagcugguucacagggccagagugcagucccuaacacucaggugaccuguaaccccagcuccaagggcuccagcccucucuucugacuccacgggcaccagcacccaugugcacauaacugcacacagacauaccuguaguuuggaguuuuuagaggaaaacucagagcccuguuugcuuuggagagcugggaagauuucacuguccuucacaccaccagcuaccaaguucuccucccccguccccuccucccucccccucguucuuuucuucuccccauugugguuguuugguugguuggcagugaguuccauccacaugagcucauugucaacuacucgggugggaaagccaggagugagcgaccgaccgucucuucuucucauugccgccguucuuuucugggcuggcagguuuugacuggaacuugguguucaagugggauuacaugacaccagagcagaggcgaucccggcaggggaacccaguugccccuauaaaguaagugcggccuuugcaggaagcccuccuaggagagcccagacuccagccccuguugcaguaugcauccaggacagugaggcucugugccucccacccucuggguuccuggccucccuucaaggccaacaucugccaccaggucacacagugaaggaacuuagguccuuuuccucagucacuagcucccaaggcaucucugcugguucuguauuggcuccuguuuauggugaaugcuaucuggagcagaguggaacuguaugccauggccuuaaguguuacuucugcgguucuuagaauuaccuuguaaguugaggcaugugagucucaagggucccagccucugugggaccccaagcagugacuagaggccaguggaggaaugaaaagaccccuuugagagugcagcagaggauggagguccagccugugguauggucuaaccuugcccuugcucccucaucuucucagaacuccgaugaucgcuggcggccucuucgugauggacaagcucuauuuugaagagcuggggaaguacgacaugaugauggacguguggggaggagagaacuuggguaugugugccccucccccgcccaggccccaacugcaccaaagcgugggaggcagggugucaugucagcauuuagggaggcccagagcagccagccccuccguggacaacccaccuccuacacaccugaccacggggaugacgguaagacgugugccuccugucgggucaucccugcacagacagcagaugcugucgccuccuuugaccuagggguucucucgggguucagaauacaugccucccaaacugagaaauaagccgucuccagggcucugguuaacuguagggugcuaauggggucaggcagcugcuguuuugccuaaauguaaucgugcaugucauguggaugggcucugauauucagacccuucuccacuacuuuuaggaauaauuauuauuuuuuuaaugacccuuggagaucauguuugcccaggaaugagacauggacgcuguacagguggcggucugugcaagugucuugcgugacgaaggaaaagacucuacuuagcuuguucagucucugcucccuuuacuugaggccuuugauuucaagugcuugucguucagaacggacuccucucacuaucaagaguuuaguuuccuucguccuuacgcaguugugcccugggaggagaggggaccaggacaaggagggaaagccacauugcugucacuuugaguggguuuucuugugacagagacuuugauagcuucuguuggcuuaaaagagcagcuucagcuagccugucuuucgaauguguccuuugaaguugaaguugguggagacguuucaucugguaggacagcucugcccagcaugaugaaagccacugccaccucuggcuccguggggagaaggacaggguggagaguccggcuccuuuccaaguuucagugcaguguugggcuuggguggaguuuugugagcaagaaaggcuuuguagugaaccugaaagguccuugagccucuuguacuguagguucuaacagcuggagccacccagugggccaaugugugucaugggcucaggaggccacaucucagggaccugagagcacagagugacagacauagucagccucccuccugugugucuugcuaagguuagggcaggugacugucccuggucacuacccuggaaacuugguugacaucuggaccugcugauacaugagagaaauaggcagggacucuuuuuuuucccugaaggaaagcccagugcauccugguacucagucaguugacaguaaguagcguggaggaccauggucugugcacacaucuccagcugacaguugcugagauacuuguggucuuagugugggaggugucugcuuucagaccgagagucaccguugggagaccucuugucccacagagcuuuccaugcguguuccgucuugggugugcuguggaggccgccuguccaugaugccccagugucuccucuauaaaagcuccagguccugcucugcagaggcaccccucauggguccccccccucccccagcaguugaaagugaggcaugguagguggcuacccacggcacggggacagcaauuaugaguucugaugguuaccaacuucccuuccugucagagaucucauuccgaguguggcagugugguggcagccuggagaucaucccgugcagccgcgugggccacguguuccggaagcagcaucccuacacguuccccgguggcagcggcacugucuuugcccgguaagacgugaaaggccagcccagaugucugcugucugcucagaagacccugguacuguguggggacagugauccuugauaggcacggccccugagcugaggaaaggaauagcgacuagcaugccagaugggauuccagugaggggagccggcucagugugccccacagaggucucaggaagagggagcgggggcguggcagaggagggugauagcuggaguuauccuaacugggacaucaggggaugacuuccauuggauagucacaaaaaccucagagggagagccuggguuugugcuguaucaccucacgguguuaagaacaggguugcguucgcccaucacguacugcaguaaacagugcuacugcuggguuaucacaaggagcugcauugcuaacuaacuguccgggugcugacacaucugggacucacgugccagccccugccaagggcuguccugaugccccauguagugaaguuaggguaagacgugaggaugaggcacagaggaacaguuccagucuggugacaacagagucccacggcccggccacugcuucaggcuccuaccucucagugucaucugaugcaacacgauuugagccugaguucuggagagcagacauugaaaccuucucagaaggcggcucauacugcacuccagccaggagacaucaaggcucaucacugauggauuaccaaucagcaauagauguuaggaaaccaaaaggccgcuugguccaacuagauucccccuggaaauuuuucccaguucugacauuguagcacacaccuuuaauccccgugcucagaaggcagaagcagguggauguccgugaguuugaagucagccgaggcuaagacggugaagcccugucuuaaccaaaaaccugugagucagaccucacggggcagacagacagcaaaacccauaagccagacgaaauacuucuaaugcucaucuggucagcaccauggggaugagaacuugggcuaacagggacaggcggagggcaggggcggccccaggacauggcuccacccccuaccuuuaaccacacacccccaccacccccaguaaugcggccuuauuuugacucugccuaggaagguagcuaguggucaguaggucagagccuuccggaucucaucaaucugcuccucauagacacagcgggacccagaggucugcguccgucaucugggugcuucucagugcacagaccuacucaucugugagggugcacuccacagccaccccgcagggcuacuagguuuuccauuaucaacugaaaugaggacguuuccacaugcguaccauuccugguuaucaaccuugagguaaauucugggcuuagcaccaggaaccuaaggaugcgcacauuuacaguguccggucucucaguggcggcaguccgccccucccccauccggggacuacgggaauauuugucacuuuauggggaagacggaggccccagguggaaaugcauuuaguaauuacagcucagacagugugacagguugagcauucagaagaccuuacugcagagaaaaugauucaccuccagggcggccacugcaagagcauggugggccaugucuccccucgccugagcagagggucuaucugcggcuaccugugcuuacggcgacccuuccuaacugucauggaagcaagcucucuuuaugcucuagagcuaagggcaagucuccgcaggucuggggcaucacgcucccacuucuuucuacugccguuucuaaucuacacaugaugauaccucccucagaggagaggcagagggaguuaggggaaccuaguucacuuucccagcaugccaguggugccauauccacucacaccguggaaaacuggggugaccagagugccauaccauggucucuacuagaggccccuucuccguggugcagcagagaucauggcguacgagaccgucaguaugucugugcccuccugcuccugcuccaggcugacucgugcugagugaugugacuucagcugagcacuucccacagacccugagguagcuguggcugcaccaugccacucuggaagcucugucauucacacucccacagacggacagggacaggugacuccagggaaaggaugggaguuauagcucaggauggcuuacuuuguuuucaggaacacacgccgggcagcugaagucuggauggaugaguacaaacauuucuacuacgcagcggugccuucugcacgaaacgugcccuaugggaagugaguaccgucccccuauccuucuaauagagacacuggcagagguggggauagcugccacccuguccuccuaguggggacccuggcagagguggggauagcugccacccuguccuccuaguggggacccuggcugaaguggggauaguugccacccuguccuucuagugggaaccuuggcagagguggggauagcugccacccuauccugguggggacccuggaacagguggagauagcugguacccuguccuccugguggggacccuggcagagguggggauagcugucacccuguccuccuaguggggacccuggcagaggugggaauagcugccacccuguccuccugguggggcccuggaacagguggggauagcugccacccuguccuucaguggggacccuggcagaggugggaauagcugccacucuguccuccugguggggacccuggaacagguggggauagcuggcacccuguccuccugguggggacccuggaacagguggugauagcuggcacccuguccuccugguggggacccuggaacagguggggauagcugccacccugugucuuccuuuccuccaguauucagagcaggcuggagcucaggaaaaagcugggcugcaagcccuucaagugguaccuggacaacgucuacccggagcugagguaagccuggggccugagugcacucugugacugcugaggaacaaaagugacuaaggaguccgcaagggcuugaugcuugccgugagcaaggcugggagcuggcugccaaggagagcacauggucccgccccacaggugcccccuccuuugcagcuacccuugcucugugugaaccugggagaaucccgaagcaccugauuugguuugucccuuucuuuagagguggacuauggaggcagaggcugucuccccgugagcacacuccucuccccacagcucccuucaggugcuccugccuucucaguguagaguagcauuaacugugauggcgucccagcuccuaccccaacacugcuccucccugggagcuggcaggagcucuguccuggggacgccaauggcuccgguggaggaccagcgggucucuggccacaggugcugccagaucuuucccauccugaaggacccgcccauuuccucuuuccacacaggagaaccaguugagguuuagagugugucuccucuucaucaggagaccacagccagugccucucaaaggugaggccaggcucucgucuccuuccuaaacacacaacuccccauacacucuauccaucuguuuagauuggaccacauaacaaaucccacaggcugggcccuacuggucaaggucucaucuguugagaaauaugaagagucagaugugaccucugugagcggcuuucuaagggacagccaacagcccagcuuguuaguaacucucccuuaccagaaacgagggaacaucucccauuuacuguuuugagauggaggggcauggcagggaagguucacucuguagcccaggcuggccucaaauucucacagaaauccucccucagccuucugaaugcuaggauuacaggcaugugccaucaugcauggcccauuuaacagucuuaaagaguuaggaauccagagacuggggccacaucauguuggggugacaugaagcuguccucugcugucuaauuugagaccaugugcagaggccguggcgagcagaaagcacagggcuguggaggugaccuuggcucuuaacaaugaaugacuuucaggguuccagaccaccaggacauagcuuucggggccuuacagcagggaaccaacugccuggacaccuugggacacuucgcggauggaguuguuggaauuuaugagugucacaacgcuggaggaaaccagguagguggggaguaugcuugccugcagacccagagcccucaucuagacacccugggcucuguaggaagccccagcccugccagcagccucagaaccagcugcgauguugcagguauugaaugaggccuugagcagcuggcucaugcugugggcugcacugcacuggcgagguacuacugagguagcaucagcacauguugucuaggcugugacuucccgccagcuucgccgucccugcagaguccacuaccauguacugcaccugcaucugcacccuguuugucccugauggguaccugcuuagugugugcucagccuccucaggugaagggucagugccugauggugaagaccaacagauguuggguucugauccuuggcaggcuuggugauuggcacaguuuauaccacucaaccugggguacuucaccccacaggccaucugggguccaugagccccuccucagugcuagaaauguuguagaacuauagcuagcaggcaccugugcaccugagcuccugagaugugccuacugugaacuaagucuucaguuuuauuuaacuaucgaauuuaaauccaagcugccacguguggcugguggcugacacuccagugcuuggaggggacccagaggcaaaggugacacuagcaggaguccccaccaugacugagucaggugccgcaaggauaggguucacccuuccugacucuggcacagggcaggcagcauagaugggcgcuguuaccugguuucuagcugugccucagcagcaaguaggaaaugaaagaaugauggccacacuuuuuaaaggauggcagcuuauaaaagcauuucuuagauauuuuacaaauucagguugcugaagguccagcacaagguggccagcucugcuucauguguagccaagucagguuuuuggaguucaguguauuuacuauccaucuuaaaauaaugaaguccacaauauccacaugugaccuuccuggccagccacauuugucaaauaagacagucuagacccucggugcucagagguccuugugacucuccugaccacaaguaggugugucuccagcuguugcccacacauaggugugguugggagggguucuggacuuccacaucuacagcagcagaccggggacauggaguugcaucuccacgcccuggcacaucuggaaggaagcacacuggguagagcagacagacuguagauaagcuacccaccacccuucacuguggagacagaacagccuaagagagaaggguccuucuacucacaucccacgcaguacaucacggcaugggaggaugaggaagccagccaccuuguguccacagucuggaaguggacagaaggugaggcugacuucagaagggccugccccagugacucacagugcagucaccuucugugaagaacuuccaguggcacagaggaacucauuccacggcagggauagagacagaaagaaagauccaucaggccauccugccuccaggcucacugcauccucuuucuccaaccucucugacuaucugugcuucuacccccaucccccucucccucacucccccccccacccuccccccacuucucagagucaggagcccucaugucccaguggcagcccugaaguuucagugucagcagaccaccugcuuauagauagcaaggcuucccuggcucaccaccucuggccuuguggcagucuuuguagcccuuacagaauacauucaugcgucuuccguuuucccuucugagggacacaggucaguggagccagagaagagacaagaagcccccagggccugggcagcucagugucccugugggaugcugggcucacugaggccuccacuccuggauccugaaggcccuguguggguggcuguuccucuaaggaucagguuacagaaauaacuugagggugcauuuacuuuggcuccuggauugagaguacagucaguccagcauaacuggacuugccagccagaguggccuccagcugagguggcaggagugugcacuuccccagccucccagaacagaccuaccagcuggggcccacacgugcccaccaaaacauagcgguuaccaagguuacaccuuagcagccaggcguagcuuugucccucagccgggagcauccugcuggcucugaguuaccccuggggccugagucaaguuucccacgugacugcagcuugacuugggguguaccucugacucguggucucucccaggaaugggccuugacaaaggagaagucggugaagcacauggaccugugccuuacugugguggaccguucgccugggucacucaucaggcugcagggcugccgggagaacgacagcagacaggugcguccgaggucccaggcuuucauagcgucagcagugaugggggccacgugcuuagccaccucacacccaugguccaguucauccccgcuggaggucucaugucacacggucccagccuccuuuccuuccucaugccacagagcgcuugaugugaaauuacgucauuucuuaagcaaaccauucauaaguugcuuguucuccugcuuaacuuuacagaaauucuaaucugaaugguuaacaagaugggcaugggugggcacaaagacuuagcugcagaguaacccauauucuaccgaaaguggacuuugggcuuugacucuggaucgucuccauagcuggcaguuagguaguauguuuuccugagguuuggggccaccgcagccuccucagcucccugucagucuccuucauaaagggaguggccacuccccugcggugcccugggcuguguggcugagcacugggggguaccacuugucucacuccgagcuuacagugagaucagaauccuaacccugguaacaguugagccucucuguauauugcuucuuccguggaccagagcuuauugcaagccuuggaagccaguucugucuggcauauucucugggggucuuggacaaagcaccuuccuaagcccugcagugacaaucacagugcaggcacuaaccgucccuucuaacuugcuacaggggaguguagccagucuccccacggucccuccccagaagacaaaugugggggaaacugaggcacgagggccaccagagcacggcucagcauccuuucauccaccugauugcacaaacggaagcagaggcccagguuccccgccuaccaccaccuagcaggugguauggggccacagucagcguccaguuccuguuuagauccuaggugauggagaaaugcuugcaaaggguccugucuccccaguccaucccuaaaucuauucccauaccugagugccaugucccugcucccaguccacccuguguucacucucuaaacaucgguuagugcaguuuauaacuugagucagacccuauagaauaagauuguaaauguugaaccagggaaggccacuguacccuggacccaccuaaaauacagccaggcuuugcgacuguaagucagugguaaggugagacuuuggucuggucuguugaccuuuaaggaagaggaaauagaaacacccgucccacguucugugggguccuuaacugagcuucuaagacagggucggcuugggcgaugaguccagccuccagcuguggagaugugggagcgcugcuccaguaaacccaccacacugcagcaucccaucagguggaugccagcguugaagaccaccuuccagggacagccgggagugacuucauuauuuucuuagcacccucugucuaguggaugcuucaacacaugacagacagcccccaccccaggagccagagucggaguauguucucuccgcacgcuuugucagacucuaggcaugcuuuccaugacaaggaaggggacaccagaaaacugacagcagcggggacaggcggugcagguuggcagagccucucucagggugaccgcuucugacuuccacaguuggcaucugaugagcagguggaaaauacuccgagggcugagagagccacucacacacacccccauccccgugcuuguggcaggucucccucaugcugcggguccugcuuugcugcccccuggcccgccacugagaggcagcuccuuggccugucucuguggcaccgcacugucuggccagugagaacauugugcuuccuggcacguguaugugugcauuugcacagucaaaaggggaggggagcaagagugagaaaaucucauuccaccgugucaggaauuuuucagaaauacuuacuccaaggaaccuuauugcguguauaaaacaauaacuagagccacagaccuuguugaugagagaggagcuguggggaaagaaagugcgugugauuuuaaaaugaaagcauaaauguuuaggauguuccuaucacuugcuaaacagcagggucagagugcuucagacuucuugaggcuguuaggccucugugcuggcuacgguuggucgagugugcuagcauucggaggaacaucauggagguggcaugugcuccaagagugacacgugaagcauggggcacaggggcagccgggauucaggagcagagagaaagaggauggagggcuggagagauggcuuagccguuaaagacuaggcucacaauccaaaauauaagagaaagaggauggaaauagcagguguaugccugcagacccuaugcugcccucaacaccucccccgcugugcucucucuguugcagaagugggagcagaucgaaggcaacuccaaacugcgacacgugggcagcaaccugugccuggauagccgcacugccaagagcggaggccugaguguggagguguguggcccggcccugucacaacaguggaaguucucacucaaccugcagcaauaagaggcccccggggcccaacguccacccgcacaccggcccaguuuguugaucacguaauuacguuucugaaacuuuccgcaaaacuauauaccucaguguuccaucacggucugacagucuuaagucucaagucuucaucgaggcaugagcggggcagacagcagugcagaagaggaaaggagccccuggggcucaggacagagggucccucccaaggcuggcgcccucugccucccucuuucugcuuccugcucacaccccagcacuggccggaacaagugggcaagcagcaaucauguuuauaucucagacagaggaagcaggggcaggcgcccccacagugagagcucgccaaucuccacucuguuuuaccuauucaaaaucgugugugugugugugaaccaggcaugguggccagugccuguaaucccaucacucaggaggcugaggcaggcaaggcccugucuaaggaaaaaaaaaaaaaugauuuccacaaagcuggccuuuccuugucugucccugcacccgggcucagcuggccucccagccacguccccucuuccauugacauacuugcuguauuugaacgugaacuuuccucugguggacacuaaauagagauaaagagaaucaugguccguucccuacgcuuccccgacaucaucuugugaacccugcaacgcagcgcagcccagagcaaaggugcaucucuggggccucaccagccggcccacgcugcuccuccaguaggggcauccccaaaccacuggccccacccacaagcgucaauguuuaacuucagcgaggggaucgcagcuggguuagaaagucugcuuugugcccauugucaucuguaaaacuaaauaggucaccucuuuuggcaaguauugcuuuggguuuucuuuuaaaauuagauuucuuuucuuuaggaaaacucaaccccacagcuucuaacuaaugugagccagcaggacccuacugccuugugacagaccagggacacuggacagcugucacccacuaucccuaggcucacagugguuugagacccuguauguugggucuuugguacuaagcugccggcagagcacagaagagcagcucuucagccuguggguggaccccacgugcccguagcccugguguggguaauacccccgguacauccacaggcaacugcaggaauuauggguagaguucagaucacaaggccugcgcacucccacugaggaccuaggcauguguuagccacagaggugaccuggauguggggaagugacaccuggugggcugcaggcaucauacgugcucaucucggguaucccagagaucucgggaaucagaguuccagguggucagagggccuguaggugagugcugugccucccgccugcuccagaagggggguagcugguuucuucuaccugaggggcuccauguguguacucaccauguguguauucgccaugaccauggacccucugcgaaggccuggccaggugcugacccucugucuuucuaccccugccaagcaaccaacagaagagacauuguaacagacagggugcccacaugucuaauuaaguucauacaauguccaccuuccaauguaggcucugggaacugucacucccagguacaggugcaaagcugucaaggacaaggcaggaguuugcuggaguccggucaccacgaccuuugcuaacccugacacuccugcacugcuucuaucagagugacuccacagaugugagacaacauggggcgucccaaccacacguguaccccaccccacccuguggccucuuaaccuuuguaccaucugauugucuggccaccagggugccaacucaacccagcuccgagcagaggggggugugggcagggcccgucggugagccauguuuacaugacagugugccaaagugacucgccgagcuuguauugcuuuguagucaucugggcuaucccacccucccaacuccuguuuuuaaaacuaaaaacucccaggagcccugggcgcacacaggcaaagguggcugucuucuguggugguccuugagucuccgugaagcugaaaaugauggugucugugaguauguuuugcaaauucaaaauauaguuugguaauuuuuuuuccaguugauuuuuaaaaaaacaaaacaaaaaacugcuguacagagcuuguacuuuguccauuuuauagauggaaaccauccuugaaauuguuuaacuuaaauaaagagaagauacuuuauagauaauccucc

SEQ ID NO: 4885 - RNA, 1378 nt, Mus musculus
gccugauugcacaguggagucuuuuauuaauuuauacacacauuguuuccuuugccugacggggauuguuuggggacaugaccaaaauuccugggaagguaggcagacagagaacacccccuucccagaacuccauggcgccugaguugccgacugucuugcgaggcacugagugaagugugugcuugggcuuucacucuugucuugcagagucuuggcuuccaugugacgacguucagggcccucucagcuacucuugauuacaguuguccuccugugaacgagccaaggccacugucgcucaaccuaacacuugcugccgucucuggcgacacucuggucucguguccgcuugucccacacccucugcuucgcuuuuuccaggcaaaguccgguggccagacuuuaaccaggaggcauacguuggcgguacaaugguucgcucugggcaggacccguacgcacgcaacaaguucaaccagguggagagugacaagcugcacauggacagaggcauccccgacacccggcaugaccaguaagucucugcaagcaugcggggagagcuggagaaucuccucgaagcgcuggauuuccucacccaggugguggugguugucagagcaggcaacauccuggagugagugaggcucauggcucuuggccuucugcaggggcggcaggcuguuggccagcagagaaagcuguaugggccuugugcuugcugaucuuuuaguauuuuuaagcugcacucauaaaacacuuuccacagucuuggaaagaagaaaaucuaacuuccucuuacuggggacagcuguaguuaggaacauucuggaaaccggagaagagauuaacuaaggucucagaacagggagggaccaggaggacaggagaaggugcugcacccccaacacuguggagaagggccgauuucaggccucgggugggggcacccugacuccgcugggcucagcucgaagcacucucagacauggagacuauucugccacugcuuacaaggaaaggggugccgaaggccuuggucauuucccccacaucugucuuuaugucccagagaaaaagcaggggcacuggacuaggaggugcugacgacaaagccagaagggcaagcgagcgucuauuugacaggaucauaguccccucagagaccggcucugcuggauuuguaagggaguuucuagauuagguucauugccgccgcgggucucaccucacaggagcagcauaagugugagcuggggucccaggaggaauagaaacuggaagcuagccgagcuucgacuccuggcagauguaaggugcccagcugccucacguuucugccgcaggagugcugcgccaugguaaacugcgcuua

SEQ ID NO: 4886 - RNA, 1378 nt, Mus musculus
uaagcgcaguuuaccauggcgcagcacuccugcggcagaaacgugaggcagcugggcaccuuacaucugccaggagucgaagcucggcuagcuuccaguuucuauuccuccugggaccccagcucacacuuaugcugcuccugugaggugagacccgcggcggcaaugaaccuaaucuagaaacucccuuacaaauccagcagagccggucucugaggggacuaugauccugucaaauagacgcucgcuugcccuucuggcuuugucgucagcaccuccuaguccagugccccugcuuuuucucugggacauaaagacagaugugggggaaaugaccaaggccuucggcaccccuuuccuuguaagcaguggcagaauagucuccaugucugagagugcuucgagcugagcccagcggagucagggugcccccacccgaggccugaaaucggcccuucuccacaguguugggggugcagcaccuucuccuguccuccuggucccucccuguucugagaccuuaguuaaucucuucuccgguuuccagaauguuccuaacuacagcuguccccaguaagaggaaguuagauuuucuucuuuccaagacuguggaaaguguuuuaugagugcagcuuaaaaauacuaaaagaucagcaagcacaaggcccauacagcuuucucugcuggccaacagccugccgccccugcagaaggccaagagccaugagccucacucacuccaggauguugccugcucugacaaccaccaccaccugggugaggaaauccagcgcuucgaggagauucuccagcucuccccgcaugcuugcagagacuuacuggucaugccgggugucggggaugccucuguccaugugcagcuugucacucuccaccugguugaacuuguugcgugcguacggguccugcccagagcgaaccauuguaccgccaacguaugccuccugguuaaagucuggccaccggacuuugccuggaaaaagcgaagcagagggugugggacaagcggacacgagaccagagugucgccagagacggcagcaaguguuagguugagcgacaguggccuuggcucguucacaggaggacaacuguaaucaagaguagcugagagggcccugaacgucgucacauggaagccaagacucugcaagacaagagugaaagcccaagcacacacuucacucagugccucgcaagacagucggcaacucaggcgccauggaguucugggaaggggguguucucugucugccuaccuucccaggaauuuuggucauguccccaaacaauccccgucaggcaaaggaaacaauguguguauaaauuaauaaaagacuccacugugcaaucaggc

SEQ ID NO: 4887 - RNA, 7020 nt, Mus musculus
gggaagaaaagaaaagaacgcuuuauucagaaucagauauacgggaacacagagcgagucagauuguuccgaacggcugcugugguggaagaggggccgugugcuuagucacagaguacaaaguccuaagucgguacauaaacaaauauauugguagggacaugaauuagacagaucacaauagagcggaggagccucugccgucgugucagauguauugugguuggugguuaacagugaucugcuggcgauccggcggucauagacacuggagaugcuugguccuaaaugaagcuugguaccgaguggacaggccgcuggggcugagagcuggcucaacaguuaaaagagcacugguugcucuccgggaagacccggguucaaguccugucuguaacucccagucccaggggauccagcauccaauccuugucucuucaggaagaaggcacauggugcacagauacacaugucuguaggcaaaauaaacccauacacauacaauuaagauuuaacaaaaacaguagcggccaaugacuuacgaccugcagcauucaaacuuucccuuaaguucuagucaguauuuaucuucuacacagauauggcuucuucagauuccaguucccacccaccuuccuuagcccacugaaucuacuucagggaaaucucaguuuaugugucucucccuccaccagagccacccaagagcccugucucaguagaugcaggaaggauagucaaagccuaaguuaauuggaauuguuuguacaugaagcuauauuuucaaaucacauuuauauuuacacauuuggaaaguugacuucugucuucugccuguaaagucccaucaguggcuuggcugcaaagguuuagagaaaauguuaaagccuagcuaugaggaauacagugucuccauguuccaggcaugccauagaaucacagauucaacuuugacagcucacugaaggagaacugucccaaacugggagagagagagcugucaucucaugcugaugugacacugcagacgccagcugucagucucaucugugugggaagcuacgggaacaacugccuucccacagccaggucuggaagccccuuggggcgucucgggugugcugcugcuguuuggccucacccucuuccaguuuccagcaguuacagagagaugacacucuggacacuccacugugugaggcugacguggucauucccuggucggcucagacucucuuccaggucuccauguguggcuccaggcacagcaggaagaaagaucuuuuuuucuuuuuccucuucuuuuuucuuuuccacuuuuugcguauggguguuuuuuccugcguguauacuacauucaaacuuggugccucuagaggccagaagagggugucagacccccuagagcuggaauuagauagaguugugagccgcugugugggugcggcaaaucaaacccagguccucuggagaaacggccagugcucuuaacugcuaggccaguucuccagcccagcaagaaucuuuuucuuuuuaauauuuaaaaauuccguguguguaugcgucuguguggguaggucacaugugcagguacccauggaaaccagauuagggcaucagaucccuaggaaccagaguuagagaagguugggugcugggaaccaaacauggguucacugcaagaucagugagugcucgucaccacuaagccaucucuccagcccccaggaucuuaaaaaaaauuaauuaauuuuaaaaaaucauguauuaaacagugugugcuuugcacugugcuagacgcuagagaaugcaaggauaaauugugacaguuauucuuccugccccucgggugcuugcauuuuaauucuggaaguaaauacacaugugaaacugucaugcagacugcuaaagaucgcagggcagcacauuagucauggugggcuccgagcacugcuaugucacugauaagacuggcagccuuaccguccacucgugucucagcaccaccaguggggaccgaggcuuuagcaugugagcucgugugcagagggguggccucaacaucucagucagacacugaagacuugguccuacacaugacgagggugcuuuguuugcacacgugcauuugggguagauccccuauuuaucuaacaguugagcucuaacugugaccuucugcaguuucuguaggagggcagagauguuuuccacacuuuguuuacuuggcaaggcucaaaucccaaacccuguguccauuggaggagagagcagcugaggccucugccaccuccggcuguggccguccuugggcugcucugcuccuguggcccccugagccaggagcuguuagccacaggcuuccaggacuuguccccagauugggggccuucuuuuccuuuccagccuccguagaagcccugcccuuggucugcugacaccucaagcugaaaggacugcacugcagcagaggggagggcaagcccaugcggaccugggccuugcugcgccguuccugcuuucaggccuugaauccccucaaguucccuuuuugagugacuucuuggaagcccuuucagacaguuuccacuuacguucagcucugcaguuguagcaguuacccgaggaaggguuugaacggcuuggaguuggaaaucucgucuuuuuacccugauguagcauauaguugauaagagucauugaaaauccauuuuucuuguuuauaaaggaacuuaaaauacucguccuugcucauuguaaggagccccauccugcccaggugcaaagugucuucugggcucaguacauggcuaaugauaagacuguacaugaaguaccuguuauaauugaucacaagccguucgggcagaauggggccaaagaugacccugguuuuuguaucacagccacacggguuugacucaaugcccuguugucugaagacaacgcuguuuucgaugcaguugccaggcccaccagaccuggcaccauuagcucucaggguguggugacaccuuugcuaucccagccaaguagggaccuggagccucgacagcagggugcuuuaagccauccucuggguauuugacaagggugaugucuauuagaugaagaaaggccuuuuucagggacaguagccuuaggaaaguuaucuuucccgucaccugaugagccauuugaaguccagccuggaaucuaucccauugacugcuggcauacagcuccucggugaugaggcacagggacugcuagcugugccaggcuagcucucagguagagcucccacuacucaugcacuuugaauuaucuccgcaggucuaaugcgcucucggguccggggugccgacgccgcccaggccaagguccugaccuuccuagacagucacugcgaguguaacgagcgauggcuggagccacucuuggagcggguugcugaggugagccucugucacacagaggguuuguguuacguacacuggcugcagguuuccuugucacuaggaaagaugugaugcccuaaacguuguuucccgaugucccaugggugcaggacugucacugcaaccaaagacagcuuucauggagcuggcagaagccuggcaagaugagguggcuggucaccugccacacacacaggcaugcaugugugcacaugugcaugcaaacaaagagaagcaaacaagcuagcagagugccccggcgggcuugucacaugaccucuggccaugcugaggcacauuccaccuuccggaaguguccgcacugguacuguguuuagcccagcguuguuuuccuugcccucugcuugucuuauugacuuucuuuccuugcugcuaugaaagugcuuccuugggggcaauguagcaaaugaaaggaaacaggaugagacgcucugcccgccaccauagcacacguagcaacagcaagucacaaaauaccgagcagccaagagcuguuagaaguccacucucugcccuuuacuggucucaggcagccgcuaggugaggagacugagcuucagggggucuucaguaacauccggaaucacacaggaggcagggucaccacucucuaacacacucuccuguguccuccccugucccugccauguguuccccagcuuggccagcugaggagagugcgggccaaugcgauggguuccugugauucucuucucaucagaaggaauguaaagauuagucucguauauccagggccagccugaugggagcacagggguggguuacugagugaugcucuagucuccgugguccaaagcuugcuuucccgucaaccugcaagcaugcagguggggcggggcucugucaugcccuuggagagugcuucugagcucugcucauccuguugcuggcccuucagcuaacaagcguucucuaaguaacucaagagccacacucgcucucucucaugagcagucagccugaggcagcacugagcaggaaggucagaggaggucggaggccucguguuggugcucacacaguggcucuguggaagguagccauggucgguacaauaacagaguugaguucagaaauggaaagugcagucagcugcugugaggugaugaaaccccuuccucucacaccaguuguacccagaaaccgucccuggcuuuguaguguggacacuugagccugagcuaugcuggugcagcucacgagagggcaacaggcauaucgugguugcgcuuaguucugugacacugagaucuccccuuggagccacugcacagcccuggucugugacagggagaagaggcagcagaagugucuagucagcuguccccucucaugccgccacccugcacaaccuugggacaguggugucuguugggaaggccuguugggauggcagcucuugcuucacuggggucguaacuuacaaguaucuuuccuuccuuugucccccucaggacaggacccgaguuguaucccccauuaucgaugucauuaacauggauaauuuccaguaugugggcgccucugcugaccucaagggugguaggugucagccuugauugguccaccugcuggcugguccucugaccauugcugucccaugaucagcugugacagugauaguggagcucacacugugaugugggcucuggcugguuccuaacagaaaggacuggccaugcgucccuggcaaccccaccccccacugugucucacucgugcgcgcgcgcgcacacacacacacacacacacacucacucucucucucucucucucucucucucucucucucuccccucuccccucuccucucucucuccccacuuuccccucucucucuccccacucuccccccuccuuccccuuuccccuccucuccucucucuccccucuccccccucccuccccuuuccccuccucuccucucucuccccucuccccccucccuccccuuuccccuccucuccucucucuccccucuccccccucccuccccuuuccccuccucuccccucuccccccucccuccccuuuccccuccucuccccucucuccccucucuccccucuccccucucuccucucuccccucucuccccucucuccccucuccccucucuccccucucuccccucucuccccucuuucuccccucucuccuccuccccucucucuuucucccucccggagcugcuauaacuaaagcuaggagaaucugcaguugccccugggauuggagcagaggagccucuacccacuggugggcuggccugaaaggcuccaaagcugagaccagcaagaggcggggccugagacacccccaaagagccaaggacuggcugacugggccuggaaccugucucuguguccucugccagggccaggcuuccucuuguagccuacaugcccagccagccugccaguuugcugcccuggaguccugccauccugccacuggcccaucacugcccacccaccaggcagcaguccuaccuuuguguucaagucuggaugcuggcccucccuucccagccgcccagccacagccugcuucaccaguggguggccuuugugugaauggaccaguaucuuguaggaccacacagccuacaaaugucaccuucugguaccgcucuagggacccaagagaaauuuguucaagcuucuccuuugccucuugggaauugcagaggcuccaguacuucucuggugggagggagacugcaguagacauaacugaggggucacugcuacacacaacguggagcagguuauacuguuccugaucuagccccuaacucacaaauagcaagggguaggguggccuaaggagcuaagcuggccaggaacacaagcuccuccugccuuagcaucucaugagcgcugcuaggauuacaggccugcacugugaaacacagcaugucagauugugggagcaguuuuaaaguuaguccuggucuaggccugaagaaccaugggucccacagagacacuaugugcugcgcugugguucugugagccaacugugauucauccagcucugacucacccccccagguccacaggccugugugcacagagcagcccuguccccagguucccaggccugugugcacagcccuuguaggugcaauggcaucacacaaacaccaguccucguguuucacauuuguucucacauuugaagauuagaaaaccccagccaggcaugguggcacaugugugcaaucccagaacucagggggcugaggcaggaggauugcuacaaguucaaaaccaaccugggcuauauagcuauacccuacauuaaaaaaguaaaaaaguuuagaggggcaagaaagcugguucacagggccagagugcagucccuaacacucaggugaccuguaaccccagcuccaagggcuccagcccucucuucugacuccacgggcaccagcacccaugugcacauaacugcacacagacauaccuguaguuuggaguuuuuagaggaaaacucagagcccuguuugcuuuggagagcugggaagauuuca

SEQ ID NO: 4888 - RNA, 7020 nt, Mus musculus
ugaaaucuucccagcucuccaaagcaaacagggcucugaguuuuccucuaaaaacuccaaacuacagguaugucugugugcaguuaugugcacaugggugcuggugcccguggagucagaagagagggcuggagcccuuggagcugggguuacaggucaccugaguguuagggacugcacucuggcccugugaaccagcuuucuugccccucuaaacuuuuuuacuuuuuuaauguaggguauagcuauauagcccagguugguuuugaacuuguagcaauccuccugccucagcccccugaguucugggauugcacacaugugccaccaugccuggcugggguuuucuaaucuucaaaugugagaacaaaugugaaacacgaggacugguguuugugugaugccauugcaccuacaagggcugugcacacaggccugggaaccuggggacagggcugcucugugcacacaggccuguggaccugggggggugagucagagcuggaugaaucacaguuggcucacagaaccacagcgcagcacauagugucucugugggacccaugguucuucaggccuagaccaggacuaacuuuaaaacugcucccacaaucugacaugcuguguuucacagugcaggccuguaauccuagcagcgcucaugagaugcuaaggcaggaggagcuuguguuccuggccagcuuagcuccuuaggccacccuaccccuugcuauuugugaguuaggggcuagaucaggaacaguauaaccugcuccacguuguguguagcagugaccccucaguuaugucuacugcagucucccucccaccagagaaguacuggagccucugcaauucccaagaggcaaaggagaagcuugaacaaauuucucuugggucccuagagcgguaccagaaggugacauuuguaggcugugugguccuacaagauacugguccauucacacaaaggccacccacuggugaagcaggcuguggcugggcggcugggaagggagggccagcauccagacuugaacacaaagguaggacugcugccuggugggugggcagugaugggccaguggcaggauggcaggacuccagggcagcaaacuggcaggcuggcugggcauguaggcuacaagaggaagccuggcccuggcagaggacacagagacagguuccaggcccagucagccaguccuuggcucuuugggggugucucaggccccgccucuugcuggucucagcuuuggagccuuucaggccagcccaccaguggguagaggcuccucugcuccaaucccaggggcaacugcagauucuccuagcuuuaguuauagcagcuccgggagggagaaagagagaggggaggaggagagaggggagaaagaggggagagaggggagagaggggagagaggggagaggggagagaggggagagaggggagagaggagagaggggagaggggagagaggggagagaggggagaggaggggaaaggggagggaggggggagaggggagaggaggggaaaggggagggaggggggagaggggagagagaggagaggaggggaaaggggagggaggggggagaggggagagagaggagaggaggggaaaggggagggaggggggagaggggagagagaggagaggaggggaaaggggaaggaggggggagaguggggagagagagaggggaaaguggggagagagagaggagaggggagaggggagagagagagagagagagagagagagagagagagagugagugugugugugugugugugugugcgcgcgcgcgcacgagugagacacaguggggggugggguugccagggacgcauggccaguccuuucuguuaggaaccagccagagcccacaucacagugugagcuccacuaucacugucacagcugaucaugggacagcaauggucagaggaccagccagcagguggaccaaucaaggcugacaccuaccacccuugaggucagcagaggcgcccacauacuggaaauuauccauguuaaugacaucgauaaugggggauacaacucggguccuguccugagggggacaaaggaaggaaagauacuuguaaguuacgaccccagugaagcaagagcugccaucccaacaggccuucccaacagacaccacugucccaagguugugcaggguggcggcaugagaggggacagcugacuagacacuucugcugccucuucucccugucacagaccagggcugugcaguggcuccaaggggagaucucagugucacagaacuaagcgcaaccacgauaugccuguugcccucucgugagcugcaccagcauagcucaggcucaaguguccacacuacaaagccagggacgguuucuggguacaacuggugugagaggaagggguuucaucaccucacagcagcugacugcacuuuccauuucugaacucaacucuguuauuguaccgaccauggcuaccuuccacagagccacugugugagcaccaacacgaggccuccgaccuccucugaccuuccugcucagugcugccucaggcugacugcucaugagagagagcgaguguggcucuugaguuacuuagagaacgcuuguuagcugaagggccagcaacaggaugagcagagcucagaagcacucuccaagggcaugacagagccccgccccaccugcaugcuugcagguugacgggaaagcaagcuuuggaccacggagacuagagcaucacucaguaacccaccccugugcucccaucaggcuggcccuggauauacgagacuaaucuuuacauuccuucugaugagaagagaaucacaggaacccaucgcauuggcccgcacucuccucagcuggccaagcuggggaacacauggcagggacaggggaggacacaggagaguguguuagagaguggugacccugccuccugugugauuccggauguuacugaagacccccugaagcucagucuccucaccuagcggcugccugagaccaguaaagggcagagaguggacuucuaacagcucuuggcugcucgguauuuugugacuugcuguugcuacgugugcuaugguggcgggcagagcgucucauccuguuuccuuucauuugcuacauugcccccaaggaagcacuuucauagcagcaaggaaagaaagucaauaagacaagcagagggcaaggaaaacaacgcugggcuaaacacaguaccagugcggacacuuccggaagguggaaugugccucagcauggccagaggucaugugacaagcccgccggggcacucugcuagcuuguuugcuucucuuuguuugcaugcacaugugcacacaugcaugccuguguguguggcaggugaccagccaccucaucuugccaggcuucugccagcuccaugaaagcugucuuugguugcagugacaguccugcacccaugggacaucgggaaacaacguuuagggcaucacaucuuuccuagugacaaggaaaccugcagccaguguacguaacacaaacccucugugugacagaggcucaccucagcaacccgcuccaagaguggcuccagccaucgcucguuacacucgcagugacugucuaggaaggucaggaccuuggccugggcggcgucggcaccccggacccgagagcgcauuagaccugcggagauaauucaaagugcaugaguagugggagcucuaccugagagcuagccuggcacagcuagcagucccugugccucaucaccgaggagcuguaugccagcagucaaugggauagauuccaggcuggacuucaaauggcucaucaggugacgggaaagauaacuuuccuaaggcuacugucccugaaaaaggccuuucuucaucuaauagacaucacccuugucaaauacccagaggauggcuuaaagcacccugcugucgaggcuccaggucccuacuuggcugggauagcaaaggugucaccacacccugagagcuaauggugccaggucuggugggccuggcaacugcaucgaaaacagcguugucuucagacaacagggcauugagucaaacccguguggcugugauacaaaaaccagggucaucuuuggccccauucugcccgaacggcuugugaucaauuauaacagguacuucauguacagucuuaucauuagccauguacugagcccagaagacacuuugcaccugggcaggauggggcuccuuacaaugagcaaggacgaguauuuuaaguuccuuuauaaacaagaaaaauggauuuucaaugacucuuaucaacuauaugcuacaucaggguaaaaagacgagauuuccaacuccaagccguucaaacccuuccucggguaacugcuacaacugcagagcugaacguaaguggaaacugucugaaagggcuuccaagaagucacucaaaaagggaacuugaggggauucaaggccugaaagcaggaacggcgcagcaaggcccagguccgcaugggcuugcccuccccucugcugcagugcaguccuuucagcuugaggugucagcagaccaagggcagggcuucuacggaggcuggaaaggaaaagaaggcccccaaucuggggacaaguccuggaagccuguggcuaacagcuccuggcucagggggccacaggagcagagcagcccaaggacggccacagccggagguggcagaggccucagcugcucucuccuccaauggacacaggguuugggauuugagccuugccaaguaaacaaaguguggaaaacaucucugcccuccuacagaaacugcagaaggucacaguuagagcucaacuguuagauaaauaggggaucuaccccaaaugcacgugugcaaacaaagcacccucgucauguguaggaccaagucuucagugucugacugagauguugaggccaccccucugcacacgagcucacaugcuaaagccucgguccccacugguggugcugagacacgaguggacgguaaggcugccagucuuaucagugacauagcagugcucggagcccaccaugacuaaugugcugcccugcgaucuuuagcagucugcaugacaguuucacauguguauuuacuuccagaauuaaaaugcaagcacccgaggggcaggaagaauaacugucacaauuuauccuugcauucucuagcgucuagcacagugcaaagcacacacuguuuaauacaugauuuuuuaaaauuaauuaauuuuuuuuaagauccugggggcuggagagauggcuuaguggugacgagcacucacugaucuugcagugaacccauguuugguucccagcacccaaccuucucuaacucugguuccuagggaucugaugcccuaaucugguuuccauggguaccugcacaugugaccuacccacacagacgcauacacacacggaauuuuuaaauauuaaaaagaaaaagauucuugcugggcuggagaacuggccuagcaguuaagagcacuggccguuucuccagaggaccuggguuugauuugccgcacccacacagcggcucacaacucuaucuaauuccagcucuagggggucugacacccucuucuggccucuagaggcaccaaguuugaauguaguauacacgcaggaaaaaacacccauacgcaaaaaguggaaaagaaaaaagaagaggaaaaagaaaaaaagaucuuucuuccugcugugccuggagccacacauggagaccuggaagagagucugagccgaccagggaaugaccacgucagccucacacaguggaguguccagagugucaucucucuguaacugcuggaaacuggaagagggugaggccaaacagcagcagcacacccgagacgccccaaggggcuuccagaccuggcugugggaaggcaguuguucccguagcuucccacacagaugagacugacagcuggcgucugcagugucacaucagcaugagaugacagcucucucucucccaguuugggacaguucuccuucagugagcugucaaaguugaaucugugauucuauggcaugccuggaacauggagacacuguauuccucauagcuaggcuuuaacauuuucucuaaaccuuugcagccaagccacugaugggacuuuacaggcagaagacagaagucaacuuuccaaauguguaaauauaaaugugauuugaaaauauagcuucauguacaaacaauuccaauuaacuuaggcuuugacuauccuuccugcaucuacugagacagggcucuuggguggcucugguggagggagagacacauaaacugagauuucccugaaguagauucagugggcuaaggaaggugggugggaacuggaaucugaagaagccauaucuguguagaagauaaauacugacuagaacuuaagggaaaguuugaaugcugcaggucguaagucauuggccgcuacuguuuuuguuaaaucuuaauuguauguguauggguuuauuuugccuacagacauguguaucugugcaccaugugccuucuuccugaagagacaaggauuggaugcuggauccccugggacugggaguuacagacaggacuugaacccgggucuucccggagagcaaccagugcucuuuuaacuguugagccagcucucagccccagcggccuguccacucgguaccaagcuucauuuaggaccaagcaucuccagugucuaugaccgccggaucgccagcagaucacuguuaaccaccaaccacaauacaucugacacgacggcagaggcuccuccgcucuauugugaucugucuaauucaugucccuaccaauauauuuguuuauguaccgacuuaggacuuuguacucugugacuaagcacacggccccucuuccaccacagcagccguucggaacaaucugacucgcucuguguucccguauaucugauucugaauaaagcguucuuuucuuuucuuccc

SEQ ID NO: 4889 - RNA, 50670 nt, Mus musculus
ccacgguuugaaacugcagccuuuaauggaccuuauuccuccaucuuccacccugucugaggaaacaagaaacguucuaaacgcucuuacaccugaaagcaaaacuagcucgcacacaaacacaacguaauccagugccugaacauggcgacuuucagaaaucaccucggcuuauuuuuuccaacaaagaaaagaaaaauaugguucagugauuggcaaauacugucugucaucuggccagugcuucuugucacaagccauggaaccgugggugcuggggcccuuccacaguucuaggggggcuggagggcccacaugugggggcauggcaguagcgaggcaccccacagaggugcacaggaaggaggucugaggaacacccacaccucugacagugaagacaagcccuguugguuguuggcuuucuucaucuuaauuauuaauuuuugguuucugaaguaaacauuuuuuugcuguaaggaaggagcaguauaccuuaacacaugggaaccaacaggcugccacuaauacgcauacuucccuuccuggucaaguagcuuuuccccaaaaaacccguuuucaugauuucucuuacgguucagaaaaaguaaagaaaauguuuucaaguauucaauuccuaucaaaaauugguaucaaaaguaauaaaggaccuaauuccauaauaauuccaugucuuaaaaaauaacuuaagaagugagaggccuggcccuucauguguauaaauccucugaucuggcuagaguuucuuuagacaccgugggguggaauccguguugagcaccucgaucauggaccucagagucgggaacgucucugauacugauggcagggucuuguaggaaggggaaauacuggaagagaaacacagggaaacugugacuauuagcaaugccuuauggggacccauagccuggguagaugcaaccaaaaaggcagagggcacagcagacccuucuauagcagcgaccucauguccugagcugccugaaagcgcagccaggacucuggggaaagaaauaauacuuucaugugcacagagcuccaugucacacagcucauauccugcuguagcuaccucacaugcugagccugagacuaugaggaugcugagccugacucugaggaugcuggcucaggccuggccccgccccuccugauucuguuacuugucuaagccuguuucccaucugcagcaguaaauuaaauccuuagcucagaauucccaugauccuugagaaacauugcauaccagguuugccaugaaccauaacugugcaacauguggcugugugguuuguggaaagauuugcugaaauuaccuaaaggaagcaggacccuccaccuugcggccacaucaacaaaccauguguaaaugaguaaccucaaaaacauacucugggacaagcuaagcaauguggaugacagacacauauuucucaguuuuaaacacagcucaaguggcccacuagaugacacaguggcuggugucauguaggcaagaagggauguggaauaagucacagugucuagcucaagcuuguuuguacucacugcccagcauuucuggagguacagcucuuaggcaccuugcuggauucuggcacaaggcgacaauguggguggcggguguuugugugugugcguguguaugugugugcguauuuauguauguguguacgugcgagugugugcguguguauguguuagcccuagguugacauugagacucucccuugacuccucuccacuguauuuauugcugagcucagaguucacagauacaggcuagcugagcuggccaccuuggucuugggaucuugucugaauuccaucugaccugugaccuaccacaaccacccagaauguuauuugggcucgggguaucugaacuuggguccuccagaugggcuuuauccgcugagcucucucuccaucucucucaucacucauuuuuaccuguaguaaaaugucuccaccuuaaaaccagagugcggagcagcucaugaaaugagcacaucccucagaggagggggcgucucuggagcuaggaccccgcccgugccuuccccugcaagccugcuccaaccacggccaugguuaccucuucaaguucauccagcuuuuugcuauuuugcugaaggccucugagccaggggcugucauggcuucaaagucgacuaacuggaaaagaggaggcgcaggacgugauaaaaggaaggaaaugguguggggucuagcucgcaugcgguccacagccagaagcccggggcgaggugcagccaugccugugccuccgccagcccagcauaccuucccuuuggggaucuucccagccacuucuuugccacuggccaucagcgcucccacaaugacugaauacgcaaugacacugucaagacaggacagacuucagccagcccuggccuauggcuaucacgcuaaccucccugcgggcguccaucaugaaaaagaaucuuacauaggaauucuuuggacuaaaaccuuaaauguuuaguuaacagaagaacuuugucguguuuauuuugaaaauauuucuacuuuccuacguaaagagcauaaggaacuugaggguccacaggagcaucugcgcucugagggaaggcggguucccaccggguugcucccugcugcuuucuucagagagcagcacacggagccucuccucuuggccugaccuuaaauccccuucaugguuggccacgggugugaucuuucuauuuuucauuuuguuuccccgagacagggccucacuguguagacuaggccggcgucaaucucagagacccaccugccugucuccucaggguuaccauuaaaggcacaugccacuauacccaccaaaaacgggacuugggggcaggggguggauuuuagaagaaacaaugggaacuucuugugauuuguagugggcuuuagaggcugugccugugacacaaacaaaagccauagcaacaguuucgaucugaaacugucauaggacgggacaucacuuaccuagauccucgagacaggggcauuaaauuauaaaaguaauacacuaaggauaagauuaaguugcagacagcaucagccuccuaggagaaaggacagagauucaugaacuucagccccaugucaggaacucgcgcugcacaagaucuugaccagcugcccucucucagggcuggcgugcuuaguuagaaagcuaacuuucuuucccacuucugauucagaccaggacaaccaguccauggagggcacugcccgcuuucgggugggucucccuuccucaguuaaaccuuucuagaaauacacucaucgauacagccagaggugcccccucggugacgcuaaaucccuucaaggugccagucacaaucacaguuuuacaguaagcagcaauucuaaugagggaacuuauagaccaugcucacaguggccgaccuggacaaaccucuucugaccacaaaccugcacugacgcaccgcagagcuaacaauauguacugugccaccccauugcugugguuguuaaacccuggaaauguuuuugcuccaaggaguacuagaaaggaggcugagacaauuacaauugauuucaggcauaagacaaacagccucagugaaacaggggaaacuguagguggggggugaggggguggggcauuugccaaagaaauugcaggacugggguguggcucagcagugaagcaucugccuagcacacuggaguucuuagucccauccucagcaauacauacgcgcgcacacacauguacaugugcacacacacucacaaacacacaccagguuccauccucagcaacacacacacacacaccccaggaacagaaaauaaaacaaagccaaaccuaccccgaauucugccgagagggucaguacuuugcccuucgcugucaggucuuuauaaagugcaucuauuucagcgugauacagcuguguccucucuucugugguuugaguuuccacagaaaauaggauauugccgacccugaaacacaagcacugcugucaauggcauagauuaaacaauccaaacagaaacuggagaaguggugugcguguguugugugugugugcgcgcgcgcgcgcacgugcgcgcacgcacgaaugcuaaugguggcugcucggagugcucugagcccuguugucacuuucccagccacucugcccaggcaggagcagaaguugugggaggcucaugaacacugcuacuaccaugucuugugcuuauguuuuugcacgcagcaccacuguggcucugugaggauaaacucacacagcauggacuuaucaugacgcuaucugcagaaccuccugguucucagaacauuagcuggagggagaggugagaccaggcuuggggacauaaagggaagaagcagggaaaagcugaaaguuuuaugggagaaguggccugaaugugggucuauccuauuuaaauucagcaggacacacagacacacauacauacacagagagagggggggagagagagagagagagagagagagagagagagugggggccuugugggaagaaggguuuagugggaauaacuggggggauaagaaggacuaaaagucacuacagacaugaaugaaacuaucaaagaagaaaugauuguaaaaugcuucucaguuggcggcgguugagaguaaugauggccagagccucagaugugcaaacuuuccacaaagacauugccacccucucgagacccagcaaucugcaaugcgugcaugguagcccugggcccgcauggacccguuuuccugcuguuggacaagcucuccggagccucugagcaccaggcagaggugcugugggaauucaaauggguugugugcacuuagccaggaaggaugcugccccaggcauauacugaguacacacauggcccagacacggcucacaucaggacaucccuccacuggccgccaccagccccacgucacacuggagcgaacauacuugucuccugugauggugauggugaagccgucauauuccuucccuugaucuuugaggcuggggacuuugguguucacggugaacccguccuuuguuuugguauuaaacugcuuucgagggaaaauaaaaauccauauuagcugcaguucucacacuguaacaugguucugucaugcagcaccacacacacauugggcugcauucucagcuccccugagcuacauaucgcccacaugcuacgggcuggacaugucuacuucuaauccguccugaaccuuagacuuagcucugggcuugucugaggcauucaaacugagagaccaugugcucucucuugguaggcaguggcuaacaacacuucuccuuucuuuagaugcaacacaggcccuaagugccucacaucccacaaaccuacagagcagcaggggccccagcagaaagcugcaggugcccuacagccaagaucuagcucagugcagcagcugcucugggguugguucuccucccagcgcagcaggcagcagccuugccagccaggagcagcaaugccagcuccugcaaccugaaaaagcaugugucccugaaaaagcacugugcccugcaagugcuccccagagccgcaggcccgaggggugcucagugguuccucuccagguguguuuuagguucacagacucuaaccucgcagaccacagguugugaggggaccuccucaaagccggccagggugucuccuaggaacacagcuucagaugccagcucugaguuaaaaccugcgaugcucugccuuuauucuagaauagugcccuccgacucuggcugggauggauggagcuggaauagggcaggcagugacagacaaaggacucugggcucuggcgggagggcuucuccugcagcaggccacaggagcgauggcuggaggcccacggcagggugcagcugggcaggacugacuaccagggcuuucagcugaauugagggagaagcgccuuucuucagggacuggcucucagaaaacaagugcaggugcuuucccguaugcccacugaauccuugccacaaacagaccagguaugaaugcacagucccaggaaaaggaacaaaccuggccauacugcugggccaggaaguggcagaguggagggcugagggagggccucugacucugguccaugcuccuggcuaacgaucuaucugcuggggccugagugcuuuucuaagucuccaguggcacgccauguuuuucagaggaagaagaaagcuacaaguuucccauaugcacauccauaauccggcugaagccagucugaagcuggaaacgcucccauccaaaggacaagcuccuacagacgacacagcagggcagugcugccacccucuggcuagguguugugaaugcaccuuggcacgcugcuuuccuuuccacgaucuguguaagcagauuucgucucccaccugaagucuuacuagauuuuagugacugaaauccacagaggcugacccagcgcagugccggucuccuguccgcaguguguccugccgccugucauggaggagcugccgggauacugaaggucagcaccacacaagugauguuaaaagccaccugagagucuucuuccaacaaaucugccauuaccgugucaugcaagacuuauggguauuuuugucuccuucugugaucuuuccuuuaguucugacuuucuaugucaaagccgcaccucaguuccauucucagagcgcauuucagauggaaacggacgucacgacuuaugcuguugcugcugcagugcugggaaucagacacgggccuacuagguaccaggagaggguacucccgugacucccagugaggcaccucugggagcaaauggagaugaaggugcucagagcaacuucccaccaucaaggccacagcucugucucagcucacaguuaacucugagcaaccccugcuacggcacagacuuccacugcagauguggccacacaacaagggcucccccgccccugccucagguaccuccucuucugcagcugcuggccuccacacgccuauccuacgggacaacaaacaacgcccacaggaaucugggggagacgggguucuccaacucuccuuuuaggaauccaucuaacuacagcugcguggcuuuugggccgcuggggaguacuggacuguggccacagguccagcgugaguauauuuauuuucaaguccuuuguuuccugaauugacugcgucucgaaagucgguucugguugagucugguuccagcgcuguacuugaucuggguuacugcuuacaguguguuaauguggggucucagaugcuauacuuuguaaguucugagacagcgcaacagucacauaugugcuuugguuuucuuuuauacaauuccuccugagauauauuuucaauuuaaguguauguguguuuugucugcauguaugucugugcacccuacaugcccggugccugcagaggucagaagucagaugcccuggcacuggacuuacagacaguuuugagacaccacaggaggucaccacgugaguguugggaaucgagcccggguccuugggaugauaaaggcagggcucuucaguaccaagucacugcuccagccccaccugagaugcuaauagcaaacuuaccuucauaauuggaaggaggucuuccacuuuguguaccuuuuccagagcuucucugacuuccaauaagcccuuuggauuauuugcucuugaagagagggggaagggcagagggagguuaaugcagaauacgauacgcagauccauucacgucuuaaauaacugcuccuaaggacaagcagcucaaugcugcaggcccauauaucccagggcaucucacugacagggucauccacccaaaucaauaauacaugugagaaaaucauguuacugacuucuuauccaccugcuccgcauccccuaagcagcgagcauuggccuggggcugacgcaaugcacuggaggcccaugugugggucccguauaaaugucauaccaucuaaugcaaaggcccugagcaugaagaggucuuuggagaggauagacagcaucccacacugggcaacagcaggagucaaugcgagccaacagguguggggcugcagaggcaugcgcggcgaaucaggaaaugcagcaggccaaugcgcaggcgcgggggucuuagcugacccuugauucuccuguuccaacucugcacuggcaagugugugguuucacuucucaagcugcucggaucuaagcacccugcugggggggcgccacacgguucucaugcucagcuggugacuccaccucaaaacucaaugccccgcgggauggacggaagcucugucggcaaucgggagugucacugugaugaguguuggccgaaagcacugccaaggccaacacugugaagccauuacucuggcggaagcaggcuuuaauuaaacuuccggucuaguucguuuggucugccugugguucaguuuucuuuuuucuuuuuuuauauuuuuuauuagguauuuuccucauuuacaugugguucaguuuucaaaucucacagauagaccacacaugaaacacaugggaccaaugcaucacagcaaagaggagaacuggaggcuuacccgugauaaacaagaauucuaucuuuaauaaaaugaaguauuuucucaaaauauuccagauaucucauauugaucacuugaccccuguaagguaaaagcgauaaaauuaaccaucauuuuacaaaggcuuguaaacaucaguuaguuccaaaaacaaagagcggggacaaauauggggaaguguaagagaggggcuugcuuugucacugugggaguagcgacucccaucucagcagaaagcuugggcucuuggaaucuguccuggcagaaaguguccagaaaagacguagcuccugacaggccacagaggaaggaaaauccuuagcuucaggaguucagaccugauggcgacuaccaugaguggcgcgccugguucucugggugcgcgccugccuauugaaugugccuggcucucugggugcaccugcguauuggacaugccuggcacuugugugugccugcguaaggacacaccaggcucuggacacgccaagcucucuguacacggcaggcucucugugugcaugccugccugucugagggugccucucgggccuuuuagcaguccuccuucccucuacccucuggagacacuauacuccucacaugcccauuccguuuuuuguuuuguuuguuuguuuucuucuuccccucucuugaagguguucgcgucuagcaacagcugagucgaaguccgucuacccuaggaaacaccacucccugcuucugacagcucccucacaucaaggucaugaugcaaggaggacuucucucccugacagggcacuucaguuuccagcuucucgcuuuuucuccuacuacucuuagacugacugggacaacuguggccucagcuagaagcagaauaauggaugccucugaugcuuuucugucagcaccucagagugucugcagcucucuucuaacccccugcaggggucugcaucucuacacuugcuccccaccugcugcccccucacaaaucuguucauucaucuguugcuacagcgaccuucgucauguccaucugucuugcuguucuucggcucaccacccaggcguggcucaccauucuggcuucuaccuaugucucgggccucaguuccugagacuuccugggaugcaguggcuggcagcuacaagggaugcgucacagcuuccuagucaggagggauucaccaguggguuggugcacggcccacugucuguccgagacaguucagguuuggccccuggauacaccgggugucccuuacuucucugcacuccaucaagucaugacaugggucugugacucaaguaccauucagcaagaacauaagcagguacacaguggccucaguuacagcaugugaccaaaucuagguaaaagugccacaaaucauuccauggggaacugaaaggagccaguaacaaagggaaaauaaacauaauuucuagaaauuaaaaagguuaagucuaaaaaagacuuuuauacuaaaaccuaaauuuaaaugucacauguuagauggagcaacaguuucuugaucuaggcuccuagagcuagaaauauuuuagauaugacucaguaccacauccgccaaauucaucuaaagucauguucacuaaauggcaggcaaacacuucgagcaucccugaagugagcucuucaggauguguuuacgccuguugucaggguagcuaagcccauaaaggaugaaagggcaggcauccacccagugccugacugcagggcucaggauaagacagaagcucccaucagggagcgaccucccuggugguccuggccacagcaggcucacgagcaaccuaggcaaauacggaauuccccaucugaucgauuucucugcuguuugacgacuucuugaaaacugacacccuccauccuucgagaguccacccuugagcgggcagggcucuaccugugcaggugcacggcaagcacuuugugccaguggaccagcaggaaagauacuugugggugcacagcuacccuggguguguuccccgccaaggccaccagggccccucacacugcuccacuccuacgcaaacacaagaaagcacacaggccccuaccugauuaaguugaugugguuauugaacccucugcugagacuuggagcuggcaucugauccagccacaggacaggcugguccggaucagcgauccuguggagcagagcucaugaggagugcugcggccuuacccacagcuuccaggauaaaccaaagaugggucucuguaaaagugagggaggagcccgacuggcuccgacuugugaaaaagagcacacaggccaucccagugcacaguguggccacaccaggcgagaggccagcaaaggcuggugagcuguaacgguucgucuaaacugucaacuuggugggauguuagagucaaccaaggaaacagcuguaauggugguuccagagagggcuaacugguggcuuagaaaccuggcaacccucgcuuuuauuuccugagcagcaggaguugaguguguucugaagaauaaaggcaacagugauuuauggcaagcuuuagcgggaaauaacucaguaucuuaacuuauagggugugcggcaacaggugacgcgcagacagccugguuuccaguccaggcuagaucuugaacccugggacccgggagugauccuggcuccuguuggaguuaccgcccccacaacccccacagaagaggcauagcuaucagccacuuaggaauagcaccaagccuucccacaugcaaauaagguuccccccaaacucucaguccaagccaaugagaggugccugcugucaaacccugaaucacccccagaacuguauauaaagccaugcagggaauuaaaggcaugcgagaacuauuccuuugagucuuuuguuccaagagcuguauguaacacuugggaagagaucuucucuccugagacccugccgcacuccucacugaauugucaacuuuuugcuggcccagccuggacccgacucaguucagagagggucggaguuacacucacuucccuuugcuggagccuucccacccggccuggacagcgaucucguggaaagccucagguacccaggcccacaguaggguuuaauuugguaagcaaagagggauugaaaccucucgccgagggagacauggucugagagaacuugcccacugcugugugcccacggguuaccuucuccacuucacagcaaugucgaacaugucccuccacugcagcagccuuguuuuuccauucaugcgaaccuuugaguugguccagguacgauguacggccugcaugacuuccagugcugccaggcccauggcuaagggaggacacaaccagacagcucgucagaacccuuuccaaggggccaauucucaccuuuccucucaagccugagggaccccauaaagaacaggacgcagcuggugagacugagcuuccgaugacacggcucacauuaaggagagccacugcuacccagcaaggcuuccuaccgaagcaggcggagccucgagccccuccuucccccguaagaaggaaagcugccuuggccugacuggcagugagggauugagagcaaugcucuauaucugcacaucgguaagagccgagcuggaagaacucacugaacuauccuacacacccgugcucugguccugugggaggcugagugcaguaaacaacaauuucuaagaggaagaugacguggcugagagacccuguuccugggcuacgauuccacuucaaguuuccagaauaccucuguguauccucuuguugggcaggaaccccgguguuucauacugcaucagcgagcccaggcggucagcuacacagaucagcuccuggacuucaggcuuguagcccucgaaauucugauguaacacaucucugcaggaaauaucaggaacaagauaaggacuuguguggcacaccugcacuaucgccccacuggagcucaacuaagacacacacaggaccaggcacagccagcuucacaucccaccacacaacugaaagaagcaaccacucuuugcaagucauguggccuguuugcuaccacaugcaagccagcacaccacuacauggcauauguagggcuccaaggcccccauuagcauuuguucuauaaacuucuccagacgcacggugugcagugccugacuaugucucguaacugauagaguauaaaggugcccaacaugugugcagaagugacacgggcaagaaagugucaaggugccauaugaacuacgagaaguagcuggugacauacaaacugcaacaggaacacgggcaagaaguuguuuauugaucaagaaauacaagcacucaggaggcuggggcagugggguuaugagauuaagucuccuuggaaugaaugcacacugaggcccaauccucccauacacaugcaaaagcaaaaugagccuccaguuggguuguggcuggccaugccccccacacggcacagcacuuaccuaaugugaggcugcaggccgggcugcucuucauagccgucuaugaggaaaggcagguucuuggcccagugguccuugaagcugcccgguagauccgagucaauguuauauuccgucagagggguaucgaggugugcgugcagauaucgagaauacucuguagacaggaaaggagcugccaaacccagacacugcuaaagaagcccuuacuagagugggucaccacauggacgcuuugaaccacacugucccuaacugcaggaguucugaaagacagcuucuggacuacagaaaccugcuagugacaagaaccaaguguacaacagccagcuuggguccgcucugauuacauguuaaccuuuccaugaaugaagccaaagagcuugucuuucugucucagagccugaaacacaagggaagcaucagaccgagccugggaucugucagcucugacggagaaaacgugugugcaagcucgccacggccugacugacaggcguguuugccccucaggcugucauucccagugccagcucugcugagccagaggagaguaagggacaagcugucugaaagauggcccucugggcugcugauacuugacucaguuauuaggaacuucaggauguucggaauaacgugugcauaucagucuauuuccaacuaucaagucaaugaaguccaagcucugaucaagacuggauaauaaaagaugagcacucaaacugagauguccugugauugcaaaacaccccagggguuaaagaccuagagcaaaaaaaaaaucacuacuuuaaaauguguauguguguauguaugagcguguauaucuguaaauguguauauauaugcacauguauacgagugugaguguguauguguaucugaaugcggauauaugccuaacaguguaggugccuuuggaagacagagauguuggcuccuccugaagcuggccgcaguggucgccacgugugguugcuggaaccacacucggguccucugguagagcagcuucucccuagaccuaagccguaacauuucucagaacaguaaugguggcucacgcaugcaagcucagcacucagaaggcugagacaggaggauccuccacagaaacagcgcuaggccagcagggccuacaagaugcgaugcuauuuaaaaaggcaagaagacaaaacaaacaaaaacccuaagaguuuccuaguaauuauaugcugaauuaaaacuuuaauuuguuauuagauuagguacaacauauuuuuaccaaguuacauccaccugcuuguuuuuacauuucuuuuagauguuuucuccauuuuucuuauuuggggaacugcauauguguguguguguguguguguguguguguguguguaagucugaggacagacugcaggacacaguucuuucuugccaccguauggguccucgggacggagcucagcuggacaggguugguggccagugucuuuacucgcugauccaucuugcauguugugugcgucucccacuuaacguggcuguuccuaacuuaagucugcaagcaugacuuacuucauuuuuuucugcuuuagaauacuuuccaaggcuaaugagaacaaaggcaaaauaugugggcaugcagacaacaaacaccuucccaaaucagcggggagaauauaugugugcguauacuggaggacacacguuuauaugcugguuaauauauguaugcacuggcuggucuuugucugugugacacaaaccuacauguaucguggaagaggaaaucucaacugagaaaaugucucaauauuaucagucuguaggcaaguauauauaguauugacgaaugauggacgugggagagccccacccacugugggugguaccauuccugggauaaugauccugagguguguccgaaagcaggcuguguaagccaugaggagcaagcuagugaacauccuucuccacagcuucugcuacaaugacugccuccgggcuccugcccugacuuccuucggugauggacugggcugacgaacugagcagaacaaacccuuuccucaacaagcugcuuucggccacgguguuuaacacagcaacagaaacccuaagaaacccuaagacuaagacaauguguauguaugcugggagagguguguguguggacacugaugugcaugugugugugugugugugugugugugcgugcaagcauaggaagauauguacacauacauaggaagaugcuuaugugaguauacaggaagaugugugugggaggaagauauguguuaaggaagguguguguguguguauguuacaguaugugugagguauguuuauguaugcauaggagauauguguguacauaugaagguuuguguguguguguaaauaggaauuguuucuguaugugugcauguguauagggaaauaugguguguguauaggaagauguguguguacaugugcauguguaugcauaagauguguguguacauauaaagagaguuuguguauauaagauguguguaccuaggaaguuauguguguauaggaaaguguauauguauacauaagauguaugugugcauaggaagguguggguauauauaggaagauguguguacauaugaagacgaauguguguguacaaaggaagaugugugugcacacauaaggugugcauguguacauaugaagaagugugugucugaguguguauauuggaagaugugugaggaugcuuuggaagguacgcauauguguacauaugaagaagugugugucugaguguguauauuggaagaugugugaggaugcuuuggaaggugugcauguguacauaugaagaagugugugucugaguguguauauuggaagaugugugaggaugcuuuggaaggugugcauguguacauaugaagaagugugugucugaguguguauauuggaagauguguggggaugcuuuggaagguguacauguguacauaugaagaagugugugucugaguguguuuauuggaagaugugugaggaugcuuuggaaggcaugcauauguguacauaugaagaagugugugucugaguguguauauuggaagaugugugaggaugcuuuggaagguacgcauauguguacauaugaagaagugugugucugaguguguauauuggaagaugugugaggaugcuuuggaagguacgcauauguguacauaugaagaagugugugucugaguguguauauuggaagauguguaaggaugcuuuggaaggugugcauauguguacauaugaagaagugugugucugaguguguauauuggaagaugugugaggaugcuuuggaaggugugcauauguguacauaugaagaagugugugucugaguguguauauuggaagaugugugaggaugcuuuggaagguacgcauguguacauaugaagaagugugugucugaguguguauauuggaagaugugugaggaugcuuuggaagguacgcauguguacauaugaagaagugugugucugaguguguauauuggaagaugugugaggaugcuuuggaagguacgcauaugagugcacuugaagauguauauggagaaaaagcaagucugugacuaauucaagaauugcuuccuuucuaaccagacugggucugacucaggaggaugugacauaacagaacgagaggccagagaugccaggucacuaacucuaaacaaugaaaccuccaugaaagguccuuucuuguccuucagugaucugagaggguguaaaucaugcuuccaacaaugaaucucacauccaacuagaagugugcuuuuuacucaggccaagcuucucugaguuuuaccagccccguagguaagguagcaagaacaucaggccugucucggaagacacugaggacccugguccugaaaccuccagcagcaagagacgcuagggacaggaugcucacccccaacucuaccaccucccaggagcagcaggacgccacagcacugagcacagaugccgaacagucccgccacugucugcuuaccucguagguacuugacccucagguacucugggcuggccuucuggccuggaagagggucauucagcauaacuuugguuugugcuuuaaucccuucguaaaacugccccauggccacauggcucagccccuucauguacuggcacacuucguuguacgguuccaguugcaggcagcgcugucguuuaggacaaacggcagaguuagcggcacaugggucaggaccgcugcuccgucuacccagaggcaccccuuccagguuaguuagugccacugaacugaggaacaagcagaauccagcgguggcucugccugcugccgaggcucaccuugaaguucuucagggccuccugcaggcuuccguggugguagagcaucauuccccgcagcugcagggucugcacgugguucugguugagcagcagggccuucuggaagcucucgguggcugcgucaaaguugcccaguucucugaggauugaacaaccguggugagcccugugcaggccggucagccauggaagccccggagagcagugcugggagcucgugagacgugacggagggcgugucucuggcuaccugagcaccucacacacagccacaguccucacaccacuuaguaaucugacacacuacaggaaguucaugugcuucgauuucucuaggaacaaugaaccuacugauuuccaaaauguguauucaaacuccuccccuaguucauuaacaagugccaaccccgagaauggcacugggugaacacucuucccaagcuagggaaaaguccguggaccauguucacagaaagugucaaacccauaggaucacaacuguaucccccggucucugaagucaccucagcgaacagcuaguaaaucaucaugcagcucgaaauuuugaaggaaaggaaaaaaaagagaauacuucagacauuaaguucuuccagaauggaaaugacugcuagcaaccgauuuccuuuuuacauaguaagcuuuucccacaggauagaaacaguccauauaccaacuuacuauaaaugagaaaaauugauuaaagacacaaugcauacuuccaucuacauaaucacuuuagaugguugcuuccaaccuacucucaauauauauuccuguacuggccaguucugugucaacuugacacagcuggagucaucacagagaaaggagcuucaggugaggaaaugccuccaugagauccaacuguaaggcauuuucucaauuagugaucaagggggaaaggccccuugugggugggaccaucucugggcugguagucuuggauucuauaagagagcaggcugagcaagccaggugaggcaagccaguaaagaauaucccucaauggcuucugcaucagcuccugcucccugaccugcuugaguuccaguccugacuuucuuuggugaugaacagcagcauggaaguguaagccgaauaaacccuuuccuccccaacuugcuucuuggucaugauguuugugcaggaauagaaacccuaacuaagacaauuccugacaauucuguagagcgggaggauaaauaaauaccacccaacaccccugugugccaggcacaacaccaaucuguagggacugauacccucugagagucugagcuauguacaccgacacagaccagggguccugacacggggcuuccucacaugcuuucaaaaccuaaaguggacaucuauucugagagacacuccccugucucagcccacugucacucaccuguaggccugucccagacuuuuauaugcaucgauaaagucaacuuucuguuucagagcuucuuugaaggccucgauggcuuccuauggaaaguaugcagaaaaugaacccauucacauaacgccaccugcauuccuacaggguuacacacaugcuacaccugucucugcaagaauuaucucagauaagaccgagaaggaggcaggcagugagcuguggggaggcucugacccuaacaguaaacaaauguaugucuguaagacgguucagcaggaccuggagggcuaaugaugucaucuucauaacaacaccauuucuccaauccauaauagucuaauggaccaaggaaacucaacagcucuaugagcuuauucaaaaugacagccugcugcacuuaaacugagucaacaagagugauugauauacacugcacauagaaaaagcaaaaaaaaaaaaagguuucuggguugguggggauuccuuggaucuaacagugcaagcaaacagcccacacgaggcuagagcagugggcucggugggcacaugcagcagugauacguggcugaggcccugugcugugggcucugagaggaaucuaggacacauugcacccacccaaauccucaugugagaggugccucuggaggguaccacucuguucacgguuagucacugcaccugcacacauggacccacugcaccugcacaugugaacccacugcgucugcacacaugaacccacugcaccugcacacguggacccacugcaccugcacacguggacccacugcaccugcacauguggacccacugcaccuuacugcaccugcacacguggaccuacugcaccugacugcaccuguacauguggacccacugcaccugcacauguggacccacuacaccugacugcaccugcacacguggacccacugcaccugcacauguggacccacugcaccugacugcaccugcacacguggacccacugcaccugcacacguggacccacugcaccugacugcaccuguacauguggacccacugcaccugcacauguggacccacugcaccuuacugcaccugcacacguggacccacugcaccugacugcaccugcacacguggacccacugcaccugacugcaccuguacauguggacccacugcaccugcacauguggacccacuacaccugacugcaccugcacacguggacccacugcaccugcacuuuugcauggcauuacuguuacuguaauaaaaaguauaaacacaucacacuuucccaagcacaggacaaaugguguuaagcagcuacugcaacuugaagaaaaagaccugacuugagacaacaccacuucuguccaacuagguguuggugggagagaauggccgccacugccaccacaugccuugcacaugguaggcgcucaauaaguauuugaugacuugcaaggcuucugccucugcauccaggcuccauguagacagaggggcggcauggccagagggguugguuucagacuccucugaagcaauggugggaaagagcagcugaagggcucuucuaacaccggauguagguacucaaguggccuagucugaaucuucuagagcuuuuauaauacuucaagucaacaaacacacauugagugccuacuguguaccagagccagugugagguauugagggguggguacaggugagcaaaucacucucuguccucuaagaacacucaguccagucagaacaggaggcugauuagguaacgggcuauuagcauaaauguuauaagcuaaagcagagauaggagagaggcucugggaauaagaaggggagcucccuagucuaaggacugagcagcaguguaaggagacagcacagugcuguacugugcacaacucagacagaggagugcugggaaaucagaacagcgcacaagggugugaguggagagagacaaagaaccuaguugccuccugcccaggcaucccagggcccuggggaaagggugguaacuauggcagcacagcaguggggggcugagcagggaggcugggucagugggcaucugggcaagagaugaugaaaggucaaggugagcgucccugaggagagaaagacgggucagauucagagacauuucugaaggcagacaggaucugguggcagcagguuaggaaggcaaguguaguggccacgguaggaagggcaggaaggcagcagggaggggggcuggggcguguuaagccugcagugucuguggacauccaggggaggugcccagcaggcaucugcugcccacuccacuuacagcaugcguggacgccacaguucuucagagucugauucucuucagcuuuuaagagucuuugguuucagguuccugccuaagcucugcucagcucucuaccucacucugccaaagagggacauagcagaaucaagauuuuaagccauugggaacaagagacuagcucacgcgaggcaaccucuagguacguaaaugcuucagaaccauuggcuuggucaaugccaccacuuccacuccaccaucaccauccucaccgcucacugggcggccaucacugggcugcucccaacagcucaaggugaagagcuuaaaauguacuuaaggcguggacuaaaugaaugaaaaguucuugcugucaugugccaagggucgauccaccacacuguacaguugugugacgugccuggccagguauggugcgcucaugggaaaucagcaugcgaaaaagcugaggcaggagaguuucaaagugaagacuggcucaagcugcagucaaauccuuucuuugacaaauuagauaaauaacagguuauaagauguuuaauaucuuuccaugaaagguucuuguaaaacuaaagagucaccuacuuaauuaauuucuagacugucauuggccugaagagauccacuugacgguauaaugugaguucaagcccacugcugagucuaaugcugugugucugcagauaccaggggucacucuuuuggcgcauaauucauucacauaaccugcaucuacaccucacgaggaugcgggugggacaagagggauuaggugcaacccugugaucugcuuggacagaaaaaccaccacaaagugcucucgucacuuggcucacugucccauguauauugguugacucagcaugacaggagggacccagugaccugggaaggcccacuuacugagggacuucgaaugcucaguuaaagcaguggagaucuggauaaagcaaaccaagucucacucuuugagccuguuucggaagccugccccgugacugugcccggcuccgucucgcggacagugcauuugcugguguccucugaaaagcacucauacuauggacgggacggucuuuuccaugggccccgaggcugccucugugcauucacuuccagaggcugugaggaaagauacagcugccaagugggaggcgcagcccagugugaguccuggacccuggcggcagccccgugcccacggggaagccuuucucucagacauccugggcgcuugcacaugaugugaagaauauauaaaggacuggcaaauucuuugccuuuugguuuucacuuugacgcgaguccuuaaaaagcaugcauaagacauagauuaaauuuuuccugauaaaauuauuguaauacuuuucucaugggaagcuaccagacucuggggggggggggcacuuugggaagagacagaagguugggucuacuuuauggauaggcaaggagccaaaagagcucagcuaugugucuagcaggugguuagggcucagagcaagggcacgggcucuuucaggcuucucuggauggccugugauggcuaacacagguggcugucacaggugcugucacuaccucacacuguguaggaaaggaacugguaaugaaccccaaguguuucagagcugcacauggccagaugcaaagacgagcagcuagcagacagacaggacauggguguacaggacagugugcgaggcagaacuaccuguguggugaagacacucauucuucuugcuuaagacacuccccauccugggcugugaacauuaguuagccuucaacacugggcucaaggccaccaucucugcccaggauggcuuuaaucauauaguguggucuccaacaagcaacuggcuaugcauaacucucaggccggccuaccuuccauccuguggcuuguauuacccuguacuagggcaccaggaguacccguggccuuguuggcaccggggcucaggcaggggagguagcaacucugugaucccuggcuacuggcacagccuguggcacagcagggauccccauagagacacaaggauguggaauggaaugcccaggaagaagcaacacacacacacacacacacacacacacacacacacacacacacagugcuaagaaaccagugacaucauuuugagaggcaucggaucaauuccucuaagucccccuccccacaagcgaagugggcacagcagcgcaggcgcaggcagcgcagcuucaccuucagaaguccucugugaaagaaaguuaggccuuuguacagcauggcugugggcugguuucuguucagcuccaaggacugcugaaaguccucgugggcugucgcguaguccuauggaaaggaggaggagagauaagauugucuuuguuagaaucuggaauguucucugcuguggauggacaguggguccuaggccuuuccuggccuugaaggaagugccacggcgaagggguccagccaaacuaguacuucucgcccugcuaaccgcuaagugguguucacagaggccuaauguuaggccuucaaucucagccuuuccaggaccaaccagaccaucuuuuccacacuagacaccucugaaaugaacaggcgguagguagugcagccacacugagcguuaagcugaggcucuggucuauacgugcucuguuaaaguacaccaauggucuaggagccacugucauaaaaacaggcucuugcuagauuagggucaccuaaaaagaagggucugcaggccugacagguucagacugagaaccgggugaauucaaguuguacuucuaagugcaaguuacaaaccaaagugucaccuuuucgugccagccuagaaauugaugcugcugacagcccaaucgugaaaccaugacugacacuuaauauucucuguugcauuuaauuucugccaaagacggugcucuugcagcugccuuguaacacugacauugaacugagcccguucuagcaaggaguggcugcugagaugaugggagaagugagguguggaccaaucuuuacagggcaaucaccucagauaugaaguacaaggucccccggugucgguacagccgugccgagggcugaagcugaauagcuuuagugagaucauuuacggcuucguuaauucgucccagaggggacagaaucuagaaauccaaaacaugcaaucaggaaaaguccccaggaccagcccuacacuguccgaguuuuaacuuucccacuccaucgagcugcaccccacucacaaagcucgcuggagcaggcugugagccauggccucaugcacgcacagguagauaagaugcucagaagggccacuaucucuguuucgcaaggggagauggggauguggcucaagcagccgccucgcuacugacuucacccuagguggaccagauucuugaaauaagaacccuuugcuugugcuacguccacuuuuuaaguaaaacacuggcacaugcacauucgaccgcugggacagacagacucgucccuggcagucacagucccugugggaggugagagcugaaggauauguccuaggaucccaggugccuugucagccccaagcucauuggccacacucagcagcaucucagggaaauugucugccuguuugagaagcccccuagagccaccacugagucacugugguccaggcggcacgguaacaucaaugggagcccagcacccacaaggaagucaccgagagagaagaaaaccccagugggcccauguccaugcaccugaccccaagcuaccauacuuccaguacgucucuguccagcgugcucuagggaagggcaugugcacccugugucacuaacuggccagcugcucugcaagagccuagcacagacucaggugggcccagcacaaacauuagcaguugcuuccaaagcaggagauggacacauggcccugaucucaucccaggaagggguggggcuaccacuuggaaugacaaccacccaucucugcuuauugaccuccuagguaaaaacuaucauaucuuggcacaacugucaauaucuaaaguaauggguuaauauacuuuuauaaauacagauuuuuuuuuguauuauuugcauuuguauuugcaagagcaaagcguucuucaaagcaccucuaaggcagacaaaggcaggcugcaauuuagcgcugaagaucacagcgaucuucugcagugcuguaacugugauaaauauugcuaugcaucauuuagagaauagaaaauacuguucuaaucaccaaucucauuuuagaugagcaauuagcuuuuucuuagauaugcaaauauuuaaaaccugcaagucuuagccgaguuccuaguuuaucagaauaauuucagacauccccagaguccugagagaaacaccagcaagcccauccagagcuggugagacacaguggccagcccgaccaccauucaagagccccuugcuguggggacagugcuacagccaucuaguccaaugguaagacccaagauggacaggaaaggaacuaaagcacugagaaagauuagauuaaaaccuaguccccggcagaacauaaaauucuuagagaccgagaucucaaaugcuacaacgagaggaugagaccucuagacggagucucggcgaccgagcacugugcuccuguacuuguuauauuuccugggggagacggggggugggggggagaggucacccguaucaaaaagccgacugcauucagaccaaccacacgagcacgugugacccgacagccuacaaguaccguaagaacguggauuuaaagccacaaagggaguccugccacuuuccugcuccugccguccgaaagccucacccccaugggccuggcauacucgcccagcuucugguguccacucggcagaugcuacgggcacucccccaggccugucuccaccuugagaucugcagcaaaccucccggcuccaggugccuacggaggcaaguccucugcccaggaacugcacaugagcaugcucuguuccuuugcuuacucucccuccucccuucuagaccagcggaaccgccgcuuccaagagcuaggcauuucuggcucuccaacccacuagccacuuugguuaaacugugucgcuuauaucuguaaaacgguguacgguaucucuuuaaugaguguccucgggagaagcagacaacgggaccacgcuuucacacucagcaccauucucgcucguugccucaggagcaccacucacuccgaggccgccugguaaccgccaccaugcuugcagggccucgggaacacaguccaguauaagggagcauuacacguuacaauggugauaauguaauaucagcuuccaaguuucagcuaauucaauaaaagagagagagaaagaaaaccacacucacuucagcucgcugcucaaauaccucuggacggucagguuccaaggcaauuacucggcucaguucaaacaaagcaagcucagcguucuuaauguccuugaaaagguauuagcuuaguaugagacucugcugcacagacagcggcaagaucuucuaagacacuggcaauauagucaccagaggagccgcugcuuggagaugaacacaacuuggggucugcaccggugcccggcugccaggucugcucaggggucacacccaagucuccccaccccauaggauggcgagcugaaccuggacgcuuaccaccagcucacagagggcagauaguaucugaacguaaccuagaucaaccuagaucaucugggggggggggggggacaccacgugggugccaaccugggaaacggcacccaccaguuuucugucaaagagggacagaaaaaugccaaguguugaccaaaaccaggaacccgggaccuauuugaccggccuagcuaaguucucuucagcaugcauaggcugauuuuaugcuuaaaaaugcaugcuuaagccuccacuaaagacaaguuacauauugagcaacaaaauuuagacagauggggacaguaagcaccaguuaucugaggugacauaugaccgaaauagucuugaacccucaauaccaugguuaccaaggcugaguucaucuggguccccugugucucagaaggguaugguuguaacugucauaucaauuuucuccaagccaguaccaacuuagcagaauuuuuauacuuuaauaaauuuuaauuaaaauauuuaauaaaguguuaaagacugauacuuuuaauguaaaugucacaaaaauuauaguucucccucugaguacugucucaugugacugucuuuaguugggaaucacaggaggguuuguguacagcacucuacacgugcugaucuuaagggcaccgccaacucacugaacgaucuugggucagcgcucuuacauacuaaugaacagggcucaccaccggcuccacgaucuuucucaggggaauaaagggaacaacuuaaucgugguuacaaagacuuuucccuaucugcaaaaugccuaaaauguagcaaauaaaaauaaaugucucagcuaggcaugguggcccaccccuuggaucccagcacuugggaggcagaggcaggcggaucucugugauuuugaggccagccuggucuucagaguaaguuccgggacagccagggauacauggaaaaucucaucucaaaaaaaaaaaaaaaaaaaaaagaagaaagaaaaaaaaucaaaauaaguaaauaauaauaaaugucacaaaguuuaaaaaaaaaaguucuuucaucccacccgccgcacuguaaaaggaccccaggcuggagggucccacugugacaacauauccuuaucucaguguggucggggaauguucugagaacacagaucucuggcuuuuccuguggccagcucaucacugacuuggaagacacaggggagccugguccuccaccuucuaggcauggcaccuggggugaucacccuucuuugccaucugugcccuggcagagcugacugaaugagaagcaguucagacaaaggcuugggugcggcaagccaugugggcgagguggcaagcgugacuaguacauacucacauguagucccuucuuuccauaggcuaucccucggccauaaauugcacuaaccagaucaggcuccuccuagucagaccaaaacagaaacacgucaaaaacuagaaacaaaacaaaacaagagucaguuucugcuuaaagcuaauuaauacuucaagaggcagcucuguaucuuuacgcuacugugacccuuggugacgcuggagucccagaccugaaaccugucaugaggaaaugugcucaggaagacuuaacugcccugaaggaaagaggggagggaccuagcacugccgagcuaucucacugcacacucggccuccucagccucucugugacuggcacagcagcaaccacaucgcacagaggaccugggagcucagggaucggggaggugggagcgggugaaucugggcugccauggcuuagccugaugaggcagaguccucucagccacagggagggcagcaaugcacuccagaaugugcugaggagucaugggaauaagauaucugacucauaucucuccaauuuuuccacuacuaccugcagucccuccacagaggcccugccgccacgcuagaggugugaucucuccucuggguggguggaaggaauaccagcuuacacugagccucugccucagccaucuccuuucuggaugcuuugcuacaagguccugguucaacuugaagagcugcacagaaccacccugggcugggcucgucacaggggacuacacugcucagccuuugacccgaggccuaugucuacccacacuacuaacaagagcacguccacaccugugcugguaaaugcagacaagugaaggggaagacaccaugcacucaauucuuagagcugcuuacacaggaugaggaccugugguccuggggcggagacagcaagcugccacacuaugcauaaagucacagaaacucaaccccaauaacuguccugcugguuucuccugaggccacuggagacacaacaaagucaggccugugauccgagcaguagggaggacaggcaggagaagagugaguuugaggcuaaccugggcuuuaugguaaggaccuaccccaaaacaauggcaacccaaaagaucugcagagagaggcaacaagaacaggccagacucuggugaacuccuguggcagaaaccugcuugggucccuccuggcuucuuaaccuguugucuguaaucacugugcaccuacaugaagauuguguaucugcuaaggaggaagaaggccaagugacagggucacaggggagugcagguucugaugacaucuuagagcaaucgaugucccuaggaggugacuacaggcacugugugcacaggagaaacugcagaauagcagagacacuugugacagaggugaaagccacacaugaccccauguuccugagagcauguguuccuucugguuauuuaaaacaaacaccuguguagucauccacaaacagaagacacauuguaagcaagacauacuacaggaaaccaagaagagccacgccuuuccugugaauaaugaaccccacgcucaaacaggaaggaagagcgggcgcugcugagggcacacagguguggaagggaacugccguggugcgggaggaggagaaaggccagaggaccaaaaggaaaacugccugcccgugucagcagagauuucaguccagaggugacgugagaacagaacaacagucuggccuggagagggucuggacacugcucaccucggucucacaggagcccugggcuccuugcacuugggcucagauuugguauggcucaaauguaccaaacaaacagcucuucugcaaugaacaguuuacuguaggugaccauaaacggagucagaaacaggcggaaaacaguuauucuauagaugugaccaacuucaccugaugcugaagcuggcucucagcgacacacacacacacacacacacacacacacacaccccacaccauaccacacacacacaaugaccaccaugccuccucuugaagaauccgucuggcucgucuuuaugcuuuguucaccggguuucuaaagcugccccccugucuucuacauucuucucugugcccagaugucugggugucccacucaccugugcugucacccaacccuacaauauuguacuucacacugccaccaggaugcaugagagcccaccacaguauguaacacauguaugcgcaugcagacauacgugugcacaucacauguggggcccagggaagaaucagugggucagacacccgugcugucugcacgugcucggucacugagagcuacagcagcgaggccacgcuguggagccccacagaaacugaggccucucucugaccucauugcucacccugucccuucucccuuccacacuuccacuccaugcucagaaaaccagaacuacuucccagccauuucccagaaacuagucuggccaagagugacacuguaugcucccagucccccguccccaaagaggucuuucaugccaggaccuuuccugacucucuccagaaccucggagugaagcaugguuucucuuccuccacuacagugugcugugugggcagcagccacucugucaacuuggagccuauucuuggugagucagacuucacacuaguggaccaugcauagcugcagcacuccugcuguguguuaggaagagcaagcaaagccaacacggaaggagaaggauucuugccaagggaucacacacauacacaggagcaaagugagugagcagacagaguacaggcagauccccaauggaggagagagcugccuguccagcugaugccaguggaggagguggggggugggaaagggcccagaucagcacccaggcagagggcaggcaggcugagaggcagaacaguagcuuccaugcgugcagggcuuggugguggagguaagaagaauggguaaggaagggaccauauuguuccggggugcaacuggaauuaauagcaaaauuagccagaaaacaaucccaaacgucccuggcaaaggagaauccuugcguguggcuagacagagcacacaggcagagggauccggaccucggcggcagcagagcuggugaugguguggguagggagcggguguguggaguuugaacucgugaacuaacuggaaggguacguggagcugggagacuggaggggguccaugugacaaaggugggguucagaagaaaaauguagauucugaguaaggaagccuuucagauggaagucaggcauggcgaggcacuuggaggugcagggagauggaucagggucaaucuugguuacauuacaaguucaaagacagccuggaauacuugggacccuguugcaaaaugcaaaacuaaccaccuagaaaaggaaauaaguaaagccagaaugauggauucugucuguauccccagcacuauauccccaguggcuucccacuuccccagugggaagcugaggcaggaggauuucuucauggggggggggggaggaaaaaaaaguaaagaaaacaaauaaaagagaaaggggaagaauauggaacagcaaguuuggcaggucugagagcguagugaggaccagcagccaucccuggcacuucccuccccuucagaacaccagacagccugaagucacaggaagaaaacacuuuaaaguguuccuauagugauagugucacauaauuuauauauguuaauuuguaagucuagcacauuuuagcugggcauggugcucuagccugcaauccuggcaccgagguggcugaggcaagaggcuuccauggccaaccuggacuacacagugagaaucggccucaaaaaucaagcaagcaaacagacagagggauggaggggaccuggcuucaguaucccgucauauuuuacacuugaauaucugucacucaggggaaccuagugucuucaaagcaugucuucucacacaugcccagacccuagagcacaucaagucuuacuacaggucagguuuauuuaucaauaaacacugggcauguacaggacagcuugagaaagcucagaguagguuagcgacaucaggcugagcuagcgggaguggagagugggugagaggaaauggggccagcugaggguaaacuaaagcagacagagcccugacuguagaugccucucaggaaaugguuccugggaacuuccagcuaccacggcacaaacacuuuuuagucauaaaauacuuuaaaccuuuaaaaaaaaaaagcugcuuaaaagcuugugaauguuguaguauuuaagugcuaauuaaaauaagaaaaaaaagcaaaggagaaggagaagaaauugaauacaggcacacauucagcccccauucaguccccuucauccccacacucccuggcuuaauuccuucacacuauacccaucccugugagcauccgugcagcacuuagggcuccucugguccacugagccuuuuagaaaauacuuuguagcaacacggaaggacagaugacaauugauacuuuguagcaacacagaaggacagaugauaauuguacuguuggauuuggagucuaguguugcaacuucuaauuuuaaguacagauuuuauuaauucuaaaacuagguauaacuuuauauacucauauuguccaucuuuagcuuuaacuguuaauaagacaaggcuuuauuuauguaauauaguaguaacuuuucuuaaaaacauccaauaauuaaguuaaauuaaaaaaacaaaacaacaacaaaaacacauuaucucuaaaaaugaguugagauuagagcaucaaaguuugaaacuacugagcaaauaugaccagcuuaguccuguuuuucaacaggcucgucagcauuuuaagugagcucagucccugacgucccuuaguuuuugcagcugcagcaucuuggggucuggccaacgcaacagggaacaacugcucagacaaggaaguccacauguuacucucaugcuauagugacagaaggagugacuuucaauuuuacccaugaggggcuagagacccugcccagaguuaagggcucucucugguuguucuuacagaaccuagauuugguucccagcaccucuaugagguggguuacaaccaucuucggcccucuucuggccuccuugggcacuaggcacgcacugcacuugggugcaggcacguacaaggaaguccucacauaaacacauauaaugaaauacucuucuuaaaagcagaggucaaucuuuuuucuaccaggaggcugacuuccagacccgaaacucaccaugaucagaaugcacagagacucggcaugugagagaugcagcguggguuaacugcuuauaaaauguuacagacaccacagggugucuucaccucuguggauggaagguaagaagcaaagcugagcuaaguauucagguccaccacgaucagaucagauccacacagaggucaaaugaccacacaaaacuguccagguaacugcucugcuggcccucccagagccaaagaggcacaggaagugggcaaaggcucggcauucaagaccgccacuguaguacacagccacacauggaagggaugccgguacacugguguucggucagccuagcucaaaguaaagucagcauuucagucuacgguugggguccacauagauuuccagugcuauggacacagagccagaggacugccacaaguucaaggccaguacagguuaccaaguaauacacugacgcaaauggaugaacagauagacaaaucagcaaucugcagugcagacugacauuuacaaagccugcuuacugagacugguuggacaugguggcccacaccuguaaucccaguacccgggaagcugggacaggaucaagagucugaggcuacucaaggccacauaguaagacgucuuucuuuuuuuuuuuuuuuuuccuuuuuugagacaggguuuuucuguguaguccuggcuguccuggaacucacucuguagaccaggcuggccucgaacucagaaauccgccagccucugccucccgagugcugggauuaaaggcaugcgccaccaugcccggcguaagacgucuuaagaaaaacaaaaaagaugaaagaaaagaaaaacaacagguaacuauguucaacuagagucacaagacacaaagaggacacuuuuacuuggcagacaacgggauaaagacacaaacgaggaucaugggaacgccucagguucauacgcuugacgacacagagcagaugaaugugaagacggggcuuuauaaauguggagauuggaguagggugagcccccuuagacuccuguguuugaaugcuuggcccauggggaguggcacuguuagggcuuuguuuggauagguguggccuuguugaaggaagugugucucugugggguggacuuugaggucugaggugcucaagcuaggccuacuguagcagucuccuccugcugccugcagaucaagauguacaacucuuaguuacucuucggcaucaugccugucugcauaccaccaggcuucucaccaugacaauaacggacuaaacuucugaaccaguaagucagucucaaugaaacgcuuuccuuuaugagagccgccuuagucuuggugccucuuuacagcaacagaaaccaugagacaacagccaggcucucuggaagucaaccuucacaccguauagcaucuauuccauacagcacccuuacaauauccaaaccccuguggugacccuugucacuucccauaaguggagucagaugcucugcucugggcuguagugcacaguugucuaacaggucugcuaagaaaagcccaaagcuaugugaggauaacuaccacagcguaauacauccuaaguaaugaguuacuuaggauggucaccagcuuuaaaacaacuacugcacaccugauuccacaggagggcccuaugaguagcaggcagagcuggucagcaccaccauuagcaggaccuuagaaacgcuuagccaguuacaauuuagagagggcaaagagcccaagcagcaacaggaguucuugagaaguucaagguucugaaauucuggauaggaaaagggaucauaagauaaaaaucaguuccacugcacggagaaagcugaccacugcauuugccaauauaaagaaagcaagagcaagcugauuuaaagaauauauacauuugccaauauaaagaaagcaagagcaagcugauuuaaagaauauauacauuugccaauauaaagaaagcaagagcaaacugauuuaaagaauauauacauuugccaauauaaagaaagcaagagcaagcugauuuaaagagcaaauacacuuucaacacucagccugaagagacuggcugaugugaaaacccacccauguaagaaaguucugguuaagugggguuggcagcguacucuacauccgcugcugccuacuuguccagagucacaaugcacggcugacggggcaucagaaggaagagacaagaaacucuuaaacacaagccuaauaugggaaagcuuugacagaaaagaagaccgaaguuuucacuacaucuuuuggguagaugguagcauuuguuauugaaucuuugaguuuucuacuuagaauaacaaccacaugcuaagaagaaaaggacagacuuucgcucuguccccaccuaaaugugcacagagccuguauaaccaaccauaugcuaagaagaaaagugacaaaaagucacaagccuaaccugggcacuuucacucuguccccaccuaaaugugcauagauccuguauuucucacugcauggagaaggcugagagcaugagggggguaggggugggcggguagcagcucucuccugcccuaacucaaaaugcauuauaaaggaacuccugguccucccuuccguacuugagcugacuugcagucuauacuggcugaaccuuaaccuaaugggaacacuguauugcuacuacaguguagcacacuaauagaaacauuguaucacuacaucacugucucauuggcuggcucagacuagugggagggaacguuguaucacuacuccaaugccugacugguuuucucagacuaauagaaacacugugucauuauuucagcgucucacgggcuaaccucagaccuaugcaaacaguguccuugaagagagaaauuccaaagacagaacaccaguguucuacaucucugcagccuggcuaaaacacuaauuugaccacuaacacaaacucuguagcaugugcauuuagaucauaaaacacagacauaaaacauaaucaguaucagauuuaggaauuaaaugacuuuagagugacagaaaugacauuuuuuauuuaauguuucaguacuaucaucaaguacaauaauaauuaaaaagaaaaaaaaugaacuaaaugauuauauaucugcaggcuguugguaccacaaaagacaugauuuuugcucacagaaaugccuuaaguugccagagcggagcagaugccuuuaaucccagcacuacccagucaucguaauugcugauggguuaucauuagauaagaugcuguccugguggccagaguuggggucaaaagugaaccaggccacuaaaaaggaagaagucacaaagaauaggcucaagaaucucucccucaggcuggagauauggcucaggguuaagagcacugacugcucuuccagagguccugaguucaaaucccagcaacaccucaggugucgucuacacaggggcuugugcucacugucaguuuuuuacucuccauuuguauauagaacugcaauuugaaaccuauuuaaacaucuaucuuugcauuucaaauuccacugaaaaacaaagccugugucaccacccccacauagacuuaaggaccugaaaguaaugagcaaaacauaucucaucaauuuucugagaauacagacuuaucaacaucauauagccacaaguuuuguguguguguguuuuuaacacaagcagagcucaaguuucaaaauuaauauuuuaaaauuucauuuccaggucuaggggccuggagagauggcucagcaguuaagagcauuggcugcucuucuagagguccugaguucaauucccagcauccacaugguggcucacaaccaucuaagaagggaucugaugcccuucuggaaugcagguguacauacagauagagcacucauuaaaaaacaaacaaaaccacguaaguaaauaaaaauuuuaaagcacgaaguccuucuguuagagugugagccacuuguuggccucuaagcagcaacgacaucugagugcugagaacucuacgaacuaaauacgagauacagguucuucacaggauguucacuaaacugaaagaggacacagcucuaggggugguugcugugauucacacaggccaggaggcugaagacuggggaagcacaagcagguguggacauggaggccucuaacugcagagugcaggcuuucuccugcagagcacuggucagacccaucaaccucugacaaauuccuacagacagcgcaaggggacaauguugcaagaggucagcacugagcaggacucuuccccagcacacacaggugacuuauacaagauucucugccguccuuucucugugugcacgugugcaggcuguacaucuguaaccagggcuggccuggaacucacaauacuccuaucucagccucccaagugcuggguuuacagggguauaccaccacguagacucuuuucucuuaacuagucuucaacuauagucugccauuaggcagucucacaauucccugcuaaagugagaggcagauccaaaagcaggaaucagguuacccucaaguccugucccagagguuagaauuucacacccuuaguguccaucucccacagagggccugugucucagagaaagucuaugucucauggaggguccaugucccacagaaguuuuguggcagaggaugugaccugcagcuagcuacuucaaccuugcagagaaaggccaccucugcuacaugacggugcagacggugugggcagcgacucaagcagcauucauucccuuuauccccuguggaguggagugaucgauccuucaaggucuggcacuaaggaguaaugggucaaugcucccuucuuccacuccugcagcccuacaccaugcuucacugcagcccugcagacgugugggcucaccuuguaucacagcaagcacucacaaucacauggccaaggagaacauuaccuggagcaucguggaaaagugucuuauggcuucaucguagagaccgcugcccaccaggacauaagcaaucgcugugagacaaacagaaaaauaucggagaaaggaagacaagcaggagggcuguauagucggugagucagcucugccuugucugaggaugcagcucugagaaaggcgugccauuaaagaacuuagaagcaaacacccaagaugacaugggugucccccaccacuccacacacacacacacacacacacacacacacacacacacacacacacacacacaaucugcuuuccagcgcuggcuaagcggccugcagguugcauggagacuagauugccagcacaagggcauaccucauaucucuucucaggcaccggaagagccccagaccuuuaggaauggaaggcucuuauucucugagaggcugcuaggaggaugauccaauuauccccuccacuugcagacaaggagaugaaguacccgugguggcugaagggccacgcuucccagacugccacacaggacacaaggccagcuuucugaaccuaagaugacaaacacugcuugauggcuaaaacaggcucaguucugcccggcuguauggggauggggaccccagaaaccucuucaagcucucuggcucuugcuuaauuagccagugguaaguuuuuucuuaaggaucccucucagauacguuuuuagaauucccgauuuucccauaacuggaacuaucuacuauucaaaaaaaugaguuauaaaacagaacagagggcugagaggcagcucagagguuaagagcacugacuguucuugcguagaacauagauguaggucccagcacccacaugauggcucacagcugucuguaacucuaguuccaggggauccaacacccucuucugaccuccaaggucacguauacagugcacauacauacaugcgggcaaaacacucauucucauaaaagaaauauauauauuauauauucuuuaauucuuuuaaaaauaaaauggaaaaaaguuuauuuauuucagggaaaacuuugguuuggaacauagaucugucugggcccuggcuaccaaaugucccucaaaagagaacaaauuuugccauaccuacccacaacuucaaagaauacuaaucuacaucucacucaaacauaaauaguuagugggguauaaauuuuacucuggaaacccagggauauauauuuaaaaaacaaaacaacaagauaaagcaaaaaaaaaaaaaaacccuggaauagcuacaauuccagcagagaucuccacagacagcaacuugucucugagcacugccucugcccgucacacagaagaaccgacucagcuuagcucagcuuccuggguuguuccuaagcaugcacaaggcaggcucauaccaagguguaugugguuuuuugguuuuguuuuguuuugauuuuuauuuugacugcauguauaucugcagcacacacaaugccucgugcucguggaggccagaagguggugucagauccccuggaacuggaguuacagacagcuauggggugcugggaauagagcagucgguucucugagccaucucagcacagcuugaguaccauuuacuaaauggacauucagcugaaagaagccaaccauuccacaaagaucagccugacugacgccuuaaaggacaguuaguucucaaaguuaccccagugaaaagcacaaggggggggggggcacuuugcaaagguggcaguguuccacagugacaaagcuaaggagaguucucagcacaggaggacugagcuaccauggcgagggaacagacggccacaauaaggacgaaaugauaaucggacgagagaucccuucgggugcuuccggcagccacaugcaggagcuuggguccgccugcucugcauggcccuggcuugcuguggguccacucuucacgugugagcucacugggcaacggggaguaaguaucucaacacacguuagaugcugggaaccccaccugcuuuaaaacaugccaggaguggauagaccaggacgcuccucuguggaccugauuaacgugaugaacgugaugaacgugacgaacaugaccauucccacccacgacgcugcucugggucuccuuccuuucaccuccuuucuguucaugaugacagcgcauggcucuucuagcacagagcagcuggucuuacuagcaucacuuuucauuuccauagaaacgcagggcuagacuaguccuuaccgagcacuguacaaaagucuucucuuccuuccugucugccuuccuuccuuuccucugcaugugccagggccuccugugucccaggcugucuccuauuuagccaaggaugaccacaaacuuuugauccuccucuuuccaccucccaaacgcugggauuauaccacaccuaguuuacaugugcuggggggggggggggcgcgaacccagggccuccuacauauaaggcaagcauuccaccaccugacacacaugcccaggccccacccaaauguuuugucaugauguacaccacacaaaccucaggaaggccugguaagccugaccggcagugcuagucuccaaguucucccuccaccugguuuccuauucuguaucugaucacggcccugggcucuggguuguagggugcucccauggcucugggcagguguuauggggugcucccagacuggauucucaccuaauucuucauuggugcugucauugucgguagcaaaugggaaucucuucugcucugcaauagacuuggccuggcucugaaaacagacagacaucauuagcgucuaacaaacaaggcaagccccgcaagagaagccugugugugacgacgcuggagcuguguuugagcucuauggaagcagaauguaugugccacugucugcugacugagcuucaagaacgugguuugugaaugaauauucaguuagguccccuaucaccagcacgucuguuuccaagagcaucuucucucuucugugggcaucaguccuucuggcuacucuggggccccugaguuugugcaugcucuuuugugcccuugauuauguugagaagaucaguccuucagcauggcuugaacacagaauaccagguaaagcguacaaguauucuagacuccacagcuacaaaaugaacauaaaagaaucuggccaagaaacaaggcaaguuacuaaaguuuccccaguaaugcacacagccauguggugugagguguaagccuggcccuaggcagacauggagaccaugugugacagggcacaaacuacaggacacaggaaguaagcugccucagaagcaaggucuuucuuaaaggcagcaucuuguaauacagugcuugaugacccaaaacucuauggagcccaggcuggccuugaacucaagaggcuggccuuccacccucacgguccaacucucauguguuaucuucagccaccauacagacaguucuaaugaguccucgagauaaaucacauuuuggcauacaaacagcugccaugucucuagaggcucugccagccaacaccaaaugaugauaaggguggcccacagcauuaaaaccaugggggcugacaagauggcuccguggguaaaggugccaacguugacuuccugaguucgagccacagagcacacaagagaaccaauuucccuacguuguccucugacucauacacaugcacccuggcauauguguauauauacaaguaaguaauuaaauaaauguaaaaaauguuauuaaaacaaucaauuccaggcuggaguugccacagacacaauucaaacuccuaggcacauauguaggaaaaucuacaucagaaaggacuaaagauccguuacccagacaaauccagaagaugggaucuagagacagcuccaaauguaagcuugucuuuucuuacagcacagagccugguggaacacauaacuaaguagcugagcgauucccugugaccagugaaccauacugccgaccacggugaacggaccacugugcucaauauggcuucaggaccuucuugucauagaucucagugcucugcuugccucuagagccaagagcaagcuaguguagauccaagcacacacaggacagagggcacugcccucugagguggcaaucccagcauccuggcaauguuucucgguugggcucuuaggcaaaccugggucacagaggaauucgcagugguaaggccacgauggguggggaccuggccagugcucagcgugugcagaguggagggacacauaccaaaaucuuuucaguguugagagagagcagcgagucacagggugcugagccucucaguucgcagucagacucguggaaguucaaaaaugacgacucuguaaagcaaacauucugcgucacucacucaccucagagaauuuaagggccauaagcugaaauccuaagaugcucacagaaccaaaccagagguaaguuaaauuucagaggcuuuuucaacuccagcuggguggugcuugcucuacaggaugcaaguguccugcuaccugucacaaacaacagcagagcuguugacugaagacuagggucgggaggaaagucaugacuauucugaaagaguggacagagcugacagcaucuacaacccagaugccaguggcuguggagcagcugagcuaaacaccucuugguauggcagcaucuaccuuaggcuuagcacauaccugcucacauguacacauacccccacucacauacacacgcaaagccuagccagaucuaacaccacaagccaugcacuaaggguccagaguccaaaauauauaaauaaauggguccugcaacucaaaggggaaaagacugauuacaaaggagcaaagggccuugguggguaacuuccuaaugauauacaaaagcuacugaacacaagaaaaggccaccauuguuauuagaggaacccacaggacggcugugagaaauuggaaacuuuggacauugguggaaggacuguacagugauucagccacugcagaaaauguguuggcaauuccucaggccauacauagaaccaccaauaugacccagcaacuucaucugugaauauaucaugaacugaauaugggaacucaaaugcuguacaugguucacgggggagguauucauaauacccaaaaggcggauaacugcccaaguauucacggcagauaagcugagauagacaugcaugauggauugauuaucccuucacagaaaugaagugcuccaacacacaacauggaaaaggucucaugcgugaggcucagccacagaaucaggaugggaaaggucacagaguacacaacucccagagggccacauggguaacuauggagacagaaggacaaguggcuucuccagggcugagggacugaguagaccagaaaugccccgcaccagugguuuuuaaccuuaggucaaaaccccuuugggggucagauacccuuucauaggggucagaugcccuuucauagggguugccuaagaccaccgggaaacacagaaauuuacacuaugauucguaacaguagcaaaaauuguaguuaugaaguaucaacaagauaauucuaugguugggagucagcacaacauggagaacuguauuauagggucauggcauuaggaagguugaggaccacuggcauaugggguccaucucagagagagacagagauguucgaaggagcugaagaacacggaaaauguacaaccgccaggguuucuccaaaacaguuccuucuguguugugagaaccucaccccagcagcugucuuaaaagugccacggugaugaaagggcgcccgccuugcccuaggaaccaugaggcaaagaacagagugcagggcaguaucuagguccccgagggccacacccagagggacaaaggcaaggauaccaccaaggauagcagcagaccuugaggacacuggaucgcagucugcacuggaucauaacugacagcucguuagggcuaagggcaccugucaccaagcccagugaccugaacucaguccccgaaacccacgugguggagggagaacucauuccugccaagcuagccuuugaccuccauacuugugacacagguacacauguguacgugugcacuagugcaugagugugcacagaguaacagagaaauaaguguaaaaaauacuuuuuaaaggaggcuuggaggccaggccuggggaagccuuuaaucccagcccuuagaagacagaggggggaaccucugugaguuccagacuaagacucagucucaaagagccaaagacaaacagacacagauaaauaagcggcugagugccccaucccccaccacacugccucugcucuaauggcuugaccuugcagauucuaacugcaauaaugcacuucucccaguuuuaaauggccuccgccauggacauggcucacugcggguacggcacacuguggacacugucccaucccugcuucugcacugagauaguauuuuacuaagcugugaucuuacuaagaacaagaaccaacacaggugagggaaaaagacugaauuuaccuuaaacaacuacccgcuugcuggcacagucugcaucuugcucucaagggcacacaccuguuccagugauuugcagauuucaccaaacuccuuucucuaaagccaaauagagguuccuccgcaccucuccuggguaggcucccggcugaacuuacaguguuuucagagaaggaggcucauguuccauugugcuaguccccugacugcuguggaggcaaugcccugcuggcucagagcucgggcaccucagcggcugcugaugcugggcguggccuguggugccuuuacuucugugcccuauucuuuaugauggggagaacgacaaccaagaacagcuaaggacaucucggcuugcagaaaauaaugguucccuggcacguguuaaguguuauuuuaaaaaaacaaaaacaaaacauuuacugcuguguguauguggguuauuuaauauauuauuuuauauauauauauacauauauauauguguguguacauauauauauauauauauauauauguacauauauguacugcugcaaguguaugaacaugccacagugugcaaguggacaucucagaacaacuugugggaacccguucucuucacaugggucccagguuuuuaaugcaggucaucaggcuguggaaacuaccuuuacccacugagccaucucauuggccugggauguauaucgcuuaucugaagggucuggacuagaagucuuuuggauugaggcuuguuuuuuuuuaauuuauuuuaaaagauuuacguguacaaguguuugacuugaguuugcuucugugcaccacuugugugucuagcacccucagaagauugagggcaucuuuacccacuaggccaugacccuggcucaauucuggaauuauuuaucccaacacauuuaacauguuuaaggcucuacgucauuauucagacagagugcaacauucaacuuugauuguacaaaaguuaccaaauggacggagguaccucacugaaaacuaccaugaagacaucaagaacaggacugucaccuagaagcaaacaagucuugucacuucacguaagggcugaaacguggcucucuggguaaaguccuugcacagcaagugaggcgcuccagcgguguggcggcacacacccgugaucucagcauuucaggaagcagagacagaaggaucagaugcugagaggcauagccuggcguguggagagcuagaggcagaaggaucagacgcugagaggcauagccuugccuguggagagcuagagaccagugugggauacacauagccuggcguguggagagcuagagaccagugugggauacacauagccuggcguguggagagcuagagaccagugugggauacacauagccuggcguguggagagcuagaggcagaaggaucagacgcugagaggcauagccuggcuuguggagagcuagagaccaguguggaauacacauagccuggcguguggagagcuagagaccagugugggauacacauagccuggcguguggagagcuagaggcagaaggaucagacgcugagaggcauagccuggcguguggagagcuagagaccagugugggauacacauagccuggcguguggagagcuagaugcagaaggaucagacgcugagaggcauagccuugccuguggagagcuagagaccaguccgggauacacauagccuggcguguggagagcuagagaccaguccgggauacacauagccugacguguggagagcuagagaccaguccgggauacacauagccuggcguguggagagcuagagaccaguccgggauacacauagccuggcguguggagagcuagagaccaguccgggauacacauagccuggcguguggagagcuagagaccagugugggauacacauagccuggcguguggagagcuagagaccagucugggauacacgacagaacaccucaaaaggaaaagaaguucaucgcuccucucacugcagaggaggagaaaccaaaggcguguuggaaguuaccagaaacgcgugugauugauuacuaagauguagcuucagacaucuguaaagaaccaggcggcguucugcuugaaugacacaccauguagguuuguagaaagagcagaaaaccugaauucuuuagucagagcuccucuccagagcuccucugucaguacagccagucuucgcucacugccuugcacaacaucggcaacgugggacuccacccuuccccccccaaacacuccucuagucaggugucccgggucugcucacccuacaccaaacucagcucccuguaagagacucagucaggugauuaaggugcagcacacucauccaugccugguacacacacagcuuuccuguggcuacacaguccaaaccacuaggaucagugacacauuuuaauacacauguaaagucugaaauccuaaguguuauuuaaaaauacaaguuuuggggcugguggcuuagugguuaagagcaccggcugcucuuccagagguccugaguuuaauccccagcgaccacaugguggcucaguacuaucuauaaaagggaaucugauggccucuuuuggcauacagguguacuugcagagcacucguuaaaagaauaaauaaaauuaauuaaaaauaaacaaauaagcaaaacuacuuauuucaaaccugugguagugguuuaguuccagcacucaggaggcagaggcagguggaucucugaguucgaggccagccuggucuacaaagugaguuccaggacagccagggcuacacagagaaacccuguuucgaaaaaccaaaaaccaaaacaaaacaaaacaacaaauauaacuuucaauaaguuuaagauguaggacuuauuauauuaaugcuuacugaaauuaugccgauaugcaaaaaaaaccuacugagacuauagcccaaaaucaaauuaaucccaaaccuggauucuuccgagggaaagcuugcuuagcuuuugacuucaguuuccuccugggaaaaugguaaugaacacuaacuagcucaguguugacaaaaggcacagagcguuucauauuguguaaugggacuggggaagagaauuggggaaagacuccgcucgguauuuccucccacacuuacaaauuaaaaauagggccacaggaauaagaaaaaaaaaacaaauuuuuauuuugaaaauaaguuucucagguuuugaggcacaugccuuuauucucagcacucaagagacugaggcaggaggacugucaccaacucaagggcacccugagcuacauagugaguuccagccuaggccaaaauaaagcaaaagaaagaaacaaacaaagaagagaaacgaaaagaaaaagaaaaagaaaaagaaaaagaaaaagaaaaagaggaaagcaagaacaaauaauauagcagguaguuucuucuccuaaaagaguaggauuauucucucaggucugaagcaggcccagggguuaagacccaaguuugguuccuagcacucacaaucaccuguaacuccagcuucaggugaucagaugcccgcuuuggccucugcgggccucuauggccaccugcacacaccuaccgcccuccacaaagacaaaacuauaaguaaaucauauuuaaaaaaaaacaaaacaaaacaaaaacaaaaacaaaaaaaccuucucaugggaaaauaggaucgaaaacauugcagagacacauagcauccuugcagguuggccagguucacuuuacccgggaccagcagggccagccauugcugacggacaccuccagccugauccacuugcucucacuggaaccauuuucuccuccaccauagggggugcugcagugugagacugagccugagcaaguaagcugcacacugagacccaagcaggcaucuaccccucagcaacuggcaccugagaauaacgcugcagcucuuugccccaagucuagagucuggcuugacgugggcagguaagaaagugaccacgguauuccaaaggugcccucguggugaggucagaccugucugauuugugagaccugagagguucuggauaucuagagcagaccauuguguuggugguaugggggcuguaaauacugaugagaauagccccucggcuaugacacgcuuacuugccuguccugaauuuguccccacagucuaggacaggugccugagguaagcgucacagaguccaacuuccauguaaucguccaggauugggacaaacagaagagaggcauuuccuacuaagagccuuuggugguuaagacaaaaucugucuguaaaguugagcauggaagcucacacuuguaagcccaacuuggaggguuuguagagaaggaucgugguaaaugcaaguucaaggccagccugggcucagagagacccuuucucaaaaacaaaaccucauagucaaguaaacggagucuccuauuuacagacaaguucacagacagguaacccccugcccugaaucaggaggugacauuaacaauggucauucgauucacuaaggaaugcuggccacaucagcugcaacaguguugggaggcaaagccaagacacaaaauaaguccaaaagccauuccaagaagucagauggugcucaaaggaagucagauugcacuaaucuugagacugcaucucagcuaagaaacuagguaguguuuggguaggcauauggugcugaacauuggugggauguuuuaaaaggcauuaucagccagcugcuacuagguauagaagacccagaccuuccccacggcaagucggagggacacccacugaggggaagggagaguggagaggguacugauggguaaaaacgcccacuguacaacucaaaacagaaagagcaugugcauuuugcccagagccugaccaaugaaugagccugagcagcuggaaugcacgcaggaaucaggccugaagcucucucucuaccguuggggguacaucugaggagcacgggucagugcucaugucaccccgcaaauccaaccugcuugcaccucucaagauuggauuccugagguggggaucgggcaaaucaccuaccggagcaagcagaaagaagucugacuuccuggcccgugcacgccagcaggcacccuccaggcagguccuuauccccgccgcccaccugagcccauccccggugcccccacuucccagaugcuuccacgcugggcaggggcggcccagggagagggcggcucggcccacucaccgcacuccggguacugguccgcccagucccccgacugcggacagccgccgcccgccggggccuccugcugcugccggugcugaagcuccugcuucagcaaggacagcggagaguagugcucgguggcccgcgcgcaggccagcgcccccagcagcaggagcagcggccgcaccaccgcagcacccaagcugcccgagcagccgcagccgcagccggcaggugccaucuucccgcacggcgcaggcgcggcccugcucug

SEQ ID NO: 4890 - RNA, 50670 nt, Mus musculus
cagagcagggccgcgccugcgccgugcgggaagauggcaccugccggcugcggcugcggcugcucgggcagcuugggugcugcgguggugcggccgcugcuccugcugcugggggcgcuggccugcgcgcgggccaccgagcacuacucuccgcuguccuugcugaagcaggagcuucagcaccggcagcagcaggaggccccggcgggcggcggcuguccgcagucgggggacugggcggaccaguacccggagugcggugagugggccgagccgcccucucccugggccgccccugcccagcguggaagcaucugggaagugggggcaccggggaugggcucaggugggcggcggggauaaggaccugccuggagggugccugcuggcgugcacgggccaggaagucagacuucuuucugcuugcuccgguaggugauuugcccgauccccaccucaggaauccaaucuugagaggugcaagcagguuggauuugcggggugacaugagcacugacccgugcuccucagauguacccccaacgguagagagagagcuucaggccugauuccugcgugcauuccagcugcucaggcucauucauuggucaggcucugggcaaaaugcacaugcucuuucuguuuugaguuguacagugggcguuuuuacccaucaguacccucuccacucucccuuccccucagugggugucccuccgacuugccguggggaaggucugggucuucuauaccuaguagcagcuggcugauaaugccuuuuaaaacaucccaccaauguucagcaccauaugccuacccaaacacuaccuaguuucuuagcugagaugcagucucaagauuagugcaaucugacuuccuuugagcaccaucugacuucuuggaauggcuuuuggacuuauuuugugucuuggcuuugccucccaacacuguugcagcugauguggccagcauuccuuagugaaucgaaugaccauuguuaaugucaccuccugauucagggcaggggguuaccugucugugaacuugucuguaaauaggagacuccguuuacuugacuaugagguuuuguuuuugagaaagggucucucugagcccaggcuggccuugaacuugcauuuaccacgauccuucucuacaaacccuccaaguugggcuuacaagugugagcuuccaugcucaacuuuacagacagauuuugucuuaaccaccaaaggcucuuaguaggaaaugccucucuucuguuugucccaauccuggacgauuacauggaaguuggacucugugacgcuuaccucaggcaccuguccuagacuguggggacaaauucaggacaggcaaguaagcgugucauagccgaggggcuauucucaucaguauuuacagcccccauaccaccaacacaauggucugcucuagauauccagaaccucucaggucucacaaaucagacaggucugaccucaccacgagggcaccuuuggaauaccguggucacuuucuuaccugcccacgucaagccagacucuagacuuggggcaaagagcugcagcguuauucucaggugccaguugcugagggguagaugccugcuugggucucagugugcagcuuacuugcucaggcucagucucacacugcagcacccccuaugguggaggagaaaaugguuccagugagagcaaguggaucaggcuggagguguccgucagcaauggcuggcccugcuggucccggguaaagugaaccuggccaaccugcaaggaugcuaugugucucugcaauguuuucgauccuauuuucccaugagaagguuuuuuuguuuuuguuuuuguuuuguuuuguuuuuuuuuaaauaugauuuacuuauaguuuugucuuuguggagggcgguaggugugugcagguggccauagaggcccgcagaggccaaagcgggcaucugaucaccugaagcuggaguuacaggugauugugagugcuaggaaccaaacuugggucuuaaccccugggccugcuucagaccugagagaauaauccuacucuuuuaggagaagaaacuaccugcuauauuauuuguucuugcuuuccucuuuuucuuuuucuuuuucuuuuucuuuuucuuuuucuuuucguuucucuucuuuguuuguuucuuucuuuugcuuuauuuuggccuaggcuggaacucacuauguagcucagggugcccuugaguuggugacaguccuccugccucagucucuugagugcugagaauaaaggcaugugccucaaaaccugagaaacuuauuuucaaaauaaaaauuuguuuuuuuuuucuuauuccuguggcccuauuuuuaauuuguaagugugggaggaaauaccgagcggagucuuuccccaauucucuuccccagucccauuacacaauaugaaacgcucugugccuuuugucaacacugagcuaguuaguguucauuaccauuuucccaggaggaaacugaagucaaaagcuaagcaagcuuucccucggaagaauccagguuugggauuaauuugauuuugggcuauagucucaguagguuuuuuuugcauaucggcauaauuucaguaagcauuaauauaauaaguccuacaucuuaaacuuauugaaaguuauauuuguuguuuuguuuuguuuugguuuuugguuuuucgaaacaggguuucucuguguagcccuggcuguccuggaacucacuuuguagaccaggcuggccucgaacucagagauccaccugccucugccuccugagugcuggaacuaaaccacuaccacagguuugaaauaaguaguuuugcuuauuuguuuauuuuuaauuaauuuuauuuauucuuuuaacgagugcucugcaaguacaccuguaugccaaaagaggccaucagauucccuuuuauagauaguacugagccaccauguggucgcuggggauuaaacucaggaccucuggaagagcagccggugcucuuaaccacuaagccaccagccccaaaacuuguauuuuuaaauaacacuuaggauuucagacuuuacauguguauuaaaaugugucacugauccuagugguuuggacuguguagccacaggaaagcuguguguguaccaggcauggaugagugugcugcaccuuaaucaccugacugagucucuuacagggagcugaguuugguguagggugagcagacccgggacaccugacuagaggaguguuuggggggggaaggguggagucccacguugccgauguugugcaaggcagugagcgaagacuggcuguacugacagaggagcucuggagaggagcucugacuaaagaauucagguuuucugcucuuucuacaaaccuacauggugugucauucaagcagaacgccgccugguucuuuacagaugucugaagcuacaucuuaguaaucaaucacacgcguuucugguaacuuccaacacgccuuugguuucuccuccucugcagugagaggagcgaugaacuucuuuuccuuuugagguguucugucguguaucccagacuggucucuagcucuccacacgccaggcuauguguaucccacacuggucucuagcucuccacacgccaggcuauguguaucccggacuggucucuagcucuccacacgccaggcuauguguaucccggacuggucucuagcucuccacacgccaggcuauguguaucccggacuggucucuagcucuccacacgucaggcuauguguaucccggacuggucucuagcucuccacacgccaggcuauguguaucccggacuggucucuagcucuccacaggcaaggcuaugccucucagcgucugauccuucugcaucuagcucuccacacgccaggcuauguguaucccacacuggucucuagcucuccacacgccaggcuaugccucucagcgucugauccuucugccucuagcucuccacacgccaggcuauguguaucccacacuggucucuagcucuccacacgccaggcuauguguauuccacacuggucucuagcucuccacaagccaggcuaugccucucagcgucugauccuucugccucuagcucuccacacgccaggcuauguguaucccacacuggucucuagcucuccacacgccaggcuauguguaucccacacuggucucuagcucuccacacgccaggcuauguguaucccacacuggucucuagcucuccacaggcaaggcuaugccucucagcgucugauccuucugccucuagcucuccacacgccaggcuaugccucucagcaucugauccuucugucucugcuuccugaaaugcugagaucacgggugugugccgccacaccgcuggagcgccucacuugcugugcaaggacuuuacccagagagccacguuucagcccuuacgugaagugacaagacuuguuugcuucuaggugacaguccuguucuugaugucuucaugguaguuuucagugagguaccuccguccauuugguaacuuuuguacaaucaaaguugaauguugcacucugucugaauaaugacguagagccuuaaacauguuaaauguguugggauaaauaauuccagaauugagccagggucauggccuaguggguaaagaugcccucaaucuucugagggugcuagacacacaaguggugcacagaagcaaacucaagucaaacacuuguacacguaaaucuuuuaaaauaaauuaaaaaaaaacaagccucaauccaaaagacuucuaguccagacccuucagauaagcgauauacaucccaggccaaugagauggcucaguggguaaagguaguuuccacagccugaugaccugcauuaaaaaccugggacccaugugaagagaacggguucccacaaguuguucugagauguccacuugcacacuguggcauguucauacacuugcagcaguacauauauguacauauauauauauauauauauauauguacacacacauauauauauguauauauauauauaaaauaauauauuaaauaacccacauacacacagcaguaaauguuuuguuuuuguuuuuuuaaaauaacacuuaacacgugccagggaaccauuauuuucugcaagccgagauguccuuagcuguucuugguugucguucuccccaucauaaagaauagggcacagaaguaaaggcaccacaggccacgcccagcaucagcagccgcugaggugcccgagcucugagccagcagggcauugccuccacagcagucaggggacuagcacaauggaacaugagccuccuucucugaaaacacuguaaguucagccgggagccuacccaggagaggugcggaggaaccucuauuuggcuuuagagaaaggaguuuggugaaaucugcaaaucacuggaacaggugugugcccuugagagcaagaugcagacugugccagcaagcggguaguuguuuaagguaaauucagucuuuuucccucaccuguguugguucuuguucuuaguaagaucacagcuuaguaaaauacuaucucagugcagaagcagggaugggacaguguccacagugugccguacccgcagugagccauguccauggcggaggccauuuaaaacugggagaagugcauuauugcaguuagaaucugcaaggucaagccauuagagcagaggcaguguggugggggauggggcacucagccgcuuauuuaucugugucuguuugucuuuggcucuuugagacugagucuuagucuggaacucacagagguuccccccucugucuucuaagggcugggauuaaaggcuuccccaggccuggccuccaagccuccuuuaaaaaguauuuuuuacacuuauuucucuguuacucugugcacacucaugcacuagugcacacguacacauguguaccugugucacaaguauggaggucaaaggcuagcuuggcaggaaugaguucucccuccaccacguggguuucggggacugaguucaggucacugggcuuggugacaggugcccuuagcccuaacgagcugucaguuaugauccagugcagacugcgauccaguguccucaaggucugcugcuauccuuggugguauccuugccuuugucccucuggguguggcccucggggaccuagauacugcccugcacucuguucuuugccucaugguuccuagggcaaggcgggcgcccuuucaucaccguggcacuuuuaagacagcugcuggggugagguucucacaacacagaaggaacuguuuuggagaaacccuggcgguuguacauuuuccguguucuucagcuccuucgaacaucucugucucucucugagauggaccccauaugccagugguccucaaccuuccuaaugccaugacccuauaauacaguucuccauguugugcugacucccaaccauagaauuaucuuguugauacuucauaacuacaauuuuugcuacuguuacgaaucauaguguaaauuucuguguuucccgguggucuuaggcaaccccuaugaaagggcaucugaccccuaugaaaggguaucugacccccaaagggguuuugaccuaagguuaaaaaccacuggugcggggcauuucuggucuacucagucccucagcccuggagaagccacuuguccuucugucuccauaguuacccauguggcccucugggaguuguguacucugugaccuuucccauccugauucuguggcugagccucacgcaugagaccuuuuccauguuguguguuggagcacuucauuucugugaagggauaaucaauccaucaugcaugucuaucucagcuuaucugccgugaauacuugggcaguuauccgccuuuuggguauuaugaauaccucccccgugaaccauguacagcauuugaguucccauauucaguucaugauauauucacagaugaaguugcugggucauauuggugguucuauguauggccugaggaauugccaacacauuuucugcaguggcugaaucacuguacaguccuuccaccaauguccaaaguuuccaauuucucacagccguccuguggguuccucuaauaacaaugguggccuuuucuuguguucaguagcuuuuguauaucauuaggaaguuacccaccaaggcccuuugcuccuuuguaaucagucuuuuccccuuugaguugcaggacccauuuauuuauauauuuuggacucuggacccuuagugcauggcuugugguguuagaucuggcuaggcuuugcguguguaugugaguggggguauguguacaugugagcagguaugugcuaagccuaagguagaugcugccauaccaagagguguuuagcucagcugcuccacagccacuggcaucuggguuguagaugcugucagcucuguccacucuuucagaauagucaugacuuuccucccgacccuagucuucagucaacagcucugcuguuguuugugacagguagcaggacacuugcauccuguagagcaagcaccacccagcuggaguugaaaaagccucugaaauuuaacuuaccucugguuugguucugugagcaucuuaggauuucagcuuauggcccuuaaauucucugaggugagugagugacgcagaauguuugcuuuacagagucgucauuuuugaacuuccacgagucugacugcgaacugagaggcucagcacccugugacucgcugcucucucucaacacugaaaagauuuugguaugugucccuccacucugcacacgcugagcacuggccagguccccacccaucguggccuuaccacugcgaauuccucugugacccagguuugccuaagagcccaaccgagaaacauugccaggaugcugggauugccaccucagagggcagugcccucuguccugugugugcuuggaucuacacuagcuugcucuuggcucuagaggcaagcagagcacugagaucuaugacaagaagguccugaagccauauugagcacagugguccguucaccguggucggcaguaugguucacuggucacagggaaucgcucagcuacuuaguuauguguuccaccaggcucugugcuguaagaaaagacaagcuuacauuuggagcugucucuagaucccaucuucuggauuugucuggguaacggaucuuuaguccuuucugauguagauuuuccuacauaugugccuaggaguuugaauugugucuguggcaacuccagccuggaauugauuguuuuaauaacauuuuuuacauuuauuuaauuacuuacuuguauauauacacauaugccagggugcauguguaugagucagaggacaacguagggaaauugguucucuugugugcucuguggcucgaacucaggaagucaacguuggcaccuuuacccacggagccaucuugucagcccccaugguuuuaaugcugugggccacccuuaucaucauuugguguuggcuggcagagccucuagagacauggcagcuguuuguaugccaaaaugugauuuaucucgaggacucauuagaacugucuguaugguggcugaagauaacacaugagaguuggaccgugaggguggaaggccagccucuugaguucaaggccagccugggcuccauagaguuuugggucaucaagcacuguauuacaagaugcugccuuuaagaaagaccuugcuucugaggcagcuuacuuccuguguccuguaguuugugcccugucacacauggucuccaugucugccuagggccaggcuuacaccucacaccacauggcugugugcauuacuggggaaacuuuaguaacuugccuuguuucuuggccagauucuuuuauguucauuuuguagcuguggagucuagaauacuuguacgcuuuaccugguauucuguguucaagccaugcugaaggacugaucuucucaacauaaucaagggcacaaaagagcaugcacaaacucaggggccccagaguagccagaaggacugaugcccacagaagagagaagaugcucuuggaaacagacgugcuggugauaggggaccuaacugaauauucauucacaaaccacguucuugaagcucagucagcagacaguggcacauacauucugcuuccauagagcucaaacacagcuccagcgucgucacacacaggcuucucuugcggggcuugccuuguuuguuagacgcuaaugaugucugucuguuuucagagccaggccaagucuauugcagagcagaagagauucccauuugcuaccgacaaugacagcaccaaugaagaauuaggugagaauccagucugggagcaccccauaacaccugcccagagccaugggagcacccuacaacccagagcccagggccgugaucagauacagaauaggaaaccagguggagggagaacuuggagacuagcacugccggucaggcuuaccaggccuuccugagguuugugugguguacaucaugacaaaacauuuggguggggccugggcaugugugucaggugguggaaugcuugccuuauauguaggaggcccuggguucgcgccccccccccccccagcacauguaaacuaggugugguauaaucccagcguuugggagguggaaagaggaggaucaaaaguuuguggucauccuuggcuaaauaggagacagccugggacacaggaggcccuggcacaugcagaggaaaggaaggaaggcagacaggaaggaagagaagacuuuuguacagugcucgguaaggacuagucuagcccugcguuucuauggaaaugaaaagugaugcuaguaagaccagcugcucugugcuagaagagccaugcgcugucaucaugaacagaaaggaggugaaaggaaggagacccagagcagcgucgugggugggaauggucauguucgucacguucaucacguucaucacguuaaucagguccacagaggagcguccuggucuauccacuccuggcauguuuuaaagcaggugggguucccagcaucuaacguguguugagauacuuacuccccguugcccagugagcucacacgugaagaguggacccacagcaagccagggccaugcagagcaggcggacccaagcuccugcauguggcugccggaagcacccgaagggaucucucguccgauuaucauuucguccuuauuguggccgucuguucccucgccaugguagcucaguccuccugugcugagaacucuccuuagcuuugucacuguggaacacugccaccuuugcaaagugccccccccccccuugugcuuuucacugggguaacuuugagaacuaacuguccuuuaaggcgucagucaggcugaucuuuguggaaugguuggcuucuuucagcugaauguccauuuaguaaaugguacucaagcugugcugagauggcucagagaaccgacugcucuauucccagcaccccauagcugucuguaacuccaguuccaggggaucugacaccaccuucuggccuccacgagcacgaggcauugugugugcugcagauauacaugcagucaaaauaaaaaucaaaacaaaacaaaaccaaaaaaccacauacaccuugguaugagccugccuugugcaugcuuaggaacaacccaggaagcugagcuaagcugagucgguucuucugugugacgggcagaggcagugcucagagacaaguugcugucuguggagaucucugcuggaauuguagcuauuccaggguuuuuuuuuuuuuuugcuuuaucuuguuguuuuguuuuuuaaauauauaucccuggguuuccagaguaaaauuuauaccccacuaacuauuuauguuugagugagauguagauuaguauucuuugaaguuguggguagguauggcaaaauuuguucucuuuugagggacauuugguagccagggcccagacagaucuauguuccaaaccaaaguuuucccugaaauaaauaaacuuuuuuccauuuuauuuuuaaaagaauuaaagaauauauaauauauauauuucuuuuaugagaaugaguguuuugcccgcauguauguaugugcacuguauacgugaccuuggaggucagaagaggguguuggauccccuggaacuagaguuacagacagcugugagccaucaugugggugcugggaccuacaucuauguucuacgcaagaacagucagugcucuuaaccucugagcugccucucagcccucuguucuguuuuauaacucauuuuuuugaauaguagauaguuccaguuaugggaaaaucgggaauucuaaaaacguaucugagagggauccuuaagaaaaaacuuaccacuggcuaauuaagcaagagccagagagcuugaagagguuucugggguccccauccccauacagccgggcagaacugagccuguuuuagccaucaagcaguguuugucaucuuagguucagaaagcuggccuuguguccuguguggcagucugggaagcguggcccuucagccaccacggguacuucaucuccuugucugcaaguggaggggauaauuggaucauccuccuagcagccucucagagaauaagagccuuccauuccuaaaggucuggggcucuuccggugccugagaagagauaugagguaugcccuugugcuggcaaucuagucuccaugcaaccugcaggccgcuuagccagcgcuggaaagcagauuguguguguguguguguguguguguguguguguguguguguguguguguguguggaguggugggggacacccaugucaucuuggguguuugcuucuaaguucuuuaauggcacgccuuucucagagcugcauccucagacaaggcagagcugacucaccgacuauacagcccuccugcuugucuuccuuucuccgauauuuuucuguuugucucacagcgauugcuuauguccuggugggcagcggucucuacgaugaagccauaagacacuuuuccacgaugcuccagguaauguucuccuuggccaugugauugugagugcuugcugugauacaaggugagcccacacgucugcagggcugcagugaagcaugguguagggcugcaggaguggaagaagggagcauugacccauuacuccuuagugccagaccuugaaggaucgaucacuccacuccacaggggauaaagggaaugaaugcugcuugagucgcugcccacaccgucugcaccgucauguagcagagguggccuuucucugcaagguugaaguagcuagcugcaggucacauccucugccacaaaacuucugugggacauggacccuccaugagacauagacuuucucugagacacaggcccucugugggagauggacacuaagggugugaaauucuaaccucugggacaggacuugaggguaaccugauuccugcuuuuggaucugccucucacuuuagcagggaauugugagacugccuaauggcagacuauaguugaagacuaguuaagagaaaagagucuacguggugguauaccccuguaaacccagcacuugggaggcugagauaggaguauugugaguuccaggccagcccugguuacagauguacagccugcacacgugcacacagagaaaggacggcagagaaucuuguauaagucaccugugugugcuggggaagaguccugcucagugcugaccucuugcaacauuguccccuugcgcugucuguaggaauuugucagagguugaugggucugaccagugcucugcaggagaaagccugcacucugcaguuagaggccuccauguccacaccugcuugugcuuccccagucuucagccuccuggccugugugaaucacagcaaccaccccuagagcuguguccucuuucaguuuagugaacauccugugaagaaccuguaucucguauuuaguucguagaguucucagcacucagaugucguugcugcuuagaggccaacaaguggcucacacucuaacagaaggacuucgugcuuuaaaauuuuuauuuacuuacgugguuuuguuuguuuuuuaaugagugcucuaucuguauguacaccugcauuccagaagggcaucagaucccuucuuagaugguugugagccaccauguggaugcugggaauugaacucaggaccucuagaagagcagccaaugcucuuaacugcugagccaucucuccaggccccuagaccuggaaaugaaauuuuaaaauauuaauuuugaaacuugagcucugcuuguguuaaaaacacacacacacaaaacuuguggcuauaugauguugauaagucuguauucucagaaaauugaugagauauguuuugcucauuacuuucagguccuuaagucuauguggggguggugacacaggcuuuguuuuucaguggaauuugaaaugcaaagauagauguuuaaauagguuucaaauugcaguucuauauacaaauggagaguaaaaaacugacagugagcacaagccccuguguagacgacaccugagguguugcugggauuugaacucaggaccucuggaagagcagucagugcucuuaacccugagccauaucuccagccugagggagagauucuugagccuauucuuugugacuucuuccuuuuuaguggccugguucacuuuugaccccaacucuggccaccaggacagcaucuuaucuaaugauaacccaucagcaauuacgaugacuggguagugcugggauuaaaggcaucugcuccgcucuggcaacuuaaggcauuucugugagcaaaaaucaugucuuuugugguaccaacagccugcagauauauaaucauuuaguucauuuuuuuucuuuuuaauuauuauuguacuugaugauaguacugaaacauuaaauaaaaaaugucauuucugucacucuaaagucauuuaauuccuaaaucugauacugauuauguuuuaugucuguguuuuaugaucuaaaugcacaugcuacagaguuuguguuaguggucaaauuaguguuuuagccaggcugcagagauguagaacacugguguucugucuuuggaauuucucucuucaaggacacuguuugcauaggucugagguuagcccgugagacgcugaaauaaugacacaguguuucuauuagucugagaaaaccagucaggcauuggaguagugauacaacguucccucccacuagucugagccagccaaugagacagugauguagugauacaauguuucuauuagugugcuacacuguaguagcaauacaguguucccauuagguuaagguucagccaguauagacugcaagucagcucaaguacggaagggaggaccaggaguuccuuuauaaugcauuuugaguuagggcaggagagagcugcuacccgcccaccccuaccccccucaugcucucagccuucuccaugcagugagaaauacaggaucuaugcacauuuagguggggacagagugaaagugcccagguuaggcuugugacuuuuugucacuuuucuucuuagcauaugguugguuauacaggcucugugcacauuuagguggggacagagcgaaagucuguccuuuucuucuuagcaugugguuguuauucuaaguagaaaacucaaagauucaauaacaaaugcuaccaucuacccaaaagauguagugaaaacuucggucuucuuuucugucaaagcuuucccauauuaggcuuguguuuaagaguuucuugucucuuccuucugaugccccgucagccgugcauugugacucuggacaaguaggcagcagcggauguagaguacgcugccaaccccacuuaaccagaacuuucuuacauggguggguuuucacaucagccagucucuucaggcugaguguugaaaguguauuugcucuuuaaaucagcuugcucuugcuuucuuuauauuggcaaauguauauauucuuuaaaucaguuugcucuugcuuucuuuauauuggcaaauguauauauucuuuaaaucagcuugcucuugcuuucuuuauauuggcaaauguauauauucuuuaaaucagcuugcucuugcuuucuuuauauuggcaaaugcaguggucagcuuucuccgugcaguggaacugauuuuuaucuuaugaucccuuuuccuauccagaauuucagaaccuugaacuucucaagaacuccuguugcugcuugggcucuuugcccucucuaaauuguaacuggcuaagcguuucuaagguccugcuaaugguggugcugaccagcucugccugcuacucauagggcccuccuguggaaucaggugugcaguaguuguuuuaaagcuggugaccauccuaaguaacucauuacuuaggauguauuacgcugugguaguuauccucacauagcuuugggcuuuucuuagcagaccuguuagacaacugugcacuacagcccagagcagagcaucugacuccacuuaugggaagugacaagggucaccacagggguuuggauauuguaagggugcuguauggaauagaugcuauacggugugaagguugacuuccagagagccuggcuguugucucaugguuucuguugcuguaaagaggcaccaagacuaaggcggcucucauaaaggaaagcguuucauugagacugacuuacugguucagaaguuuaguccguuauugucauggugagaagccuggugguaugcagacaggcaugaugccgaagaguaacuaagaguuguacaucuugaucugcaggcagcaggaggagacugcuacaguaggccuagcuugagcaccucagaccucaaaguccaccccacagagacacacuuccuucaacaaggccacaccuauccaaacaaagcccuaacagugccacuccccaugggccaagcauucaaacacaggagucuaagggggcucacccuacuccaaucuccacauuuauaaagccccgucuucacauucaucugcucugugucgucaagcguaugaaccugaggcguucccaugauccucguuugugucuuuaucccguugucugccaaguaaaaguguccucuuugugucuugugacucuaguugaacauaguuaccuguuguuuuucuuuucuuucaucuuuuuuguuuuucuuaagacgucuuacgccgggcaugguggcgcaugccuuuaaucccagcacucgggaggcagaggcuggcggauuucugaguucgaggccagccuggucuacagagugaguuccaggacagccaggacuacacagaaaaacccugucucaaaaaaggaaaaaaaaaaaaaaaaagaaagacgucuuacuauguggccuugaguagccucagacucuugauccugucccagcuucccggguacugggauuacaggugugggccaccauguccaaccagucucaguaagcaggcuuuguaaaugucagucugcacugcagauugcugauuugucuaucuguucauccauuugcgucaguguauuacuugguaaccuguacuggccuugaacuuguggcaguccucuggcucuguguccauagcacuggaaaucuauguggaccccaaccguagacugaaaugcugacuuuacuuugagcuaggcugaccgaacaccaguguaccggcaucccuuccauguguggcuguguacuacaguggcggucuugaaugccgagccuuugcccacuuccugugccucuuuggcucugggagggccagcagagcaguuaccuggacaguuuuguguggucauuugaccucuguguggaucugaucugaucgugguggaccugaauacuuagcucagcuuugcuucuuaccuuccauccacagaggugaagacacccuguggugucuguaacauuuuauaagcaguuaacccacgcugcaucucucacaugccgagucucugugcauucugaucauggugaguuucgggucuggaagucagccuccugguagaaaaaagauugaccucugcuuuuaagaagaguauuucauuauauguguuuaugugaggacuuccuuguacgugccugcacccaagugcagugcgugccuagugcccaaggaggccagaagagggccgaagaugguuguaacccaccucauagaggugcugggaaccaaaucuagguucuguaagaacaaccagagagagcccuuaacucugggcagggucucuagccccucauggguaaaauugaaagucacuccuucugucacuauagcaugagaguaacauguggacuuccuugucugagcaguuguucccuguugcguuggccagaccccaagaugcugcagcugcaaaaacuaagggacgucagggacugagcucacuuaaaaugcugacgagccuguugaaaaacaggacuaagcuggucauauuugcucaguaguuucaaacuuugaugcucuaaucucaacucauuuuuagagauaauguguuuuuguuguuguuuuguuuuuuuaauuuaacuuaauuauuggauguuuuuaagaaaaguuacuacuauauuacauaaauaaagccuugucuuauuaacaguuaaagcuaaagauggacaauaugaguauauaaaguuauaccuaguuuuagaauuaauaaaaucuguacuuaaaauuagaaguugcaacacuagacuccaaauccaacaguacaauuaucaucuguccuucuguguugcuacaaaguaucaauugucaucuguccuuccguguugcuacaaaguauuuucuaaaaggcucaguggaccagaggagcccuaagugcugcacggaugcucacagggauggguauagugugaaggaauuaagccagggaguguggggaugaaggggacugaaugggggcugaaugugugccuguauucaauuucuucuccuucuccuuugcuuuuuuuucuuauuuuaauuagcacuuaaauacuacaacauucacaagcuuuuaagcagcuuuuuuuuuuuaaagguuuaaaguauuuuaugacuaaaaaguguuugugccgugguagcuggaaguucccaggaaccauuuccugagaggcaucuacagucagggcucugucugcuuuaguuuacccucagcuggccccauuuccucucacccacucuccacucccgcuagcucagccugaugucgcuaaccuacucugagcuuucucaagcuguccuguacaugcccaguguuuauugauaaauaaaccugaccuguaguaagacuugaugugcucuagggucugggcaugugugagaagacaugcuuugaagacacuagguuccccugagugacagauauucaaguguaaaauaugacgggauacugaagccagguccccuccaucccucugucuguuugcuugcuugauuuuugaggccgauucucacuguguaguccagguuggccauggaagccucuugccucagccaccucggugccaggauugcaggcuagagcaccaugcccagcuaaaaugugcuagacuuacaaauuaacauauauaaauuaugugacacuaucacuauaggaacacuuuaaaguguuuucuuccugugacuucaggcugucugguguucugaaggggagggaagugccagggauggcugcugguccucacuacgcucucagaccugccaaacuugcuguuccauauucuuccccuuucucuuuuauuuguuuucuuuacuuuuuuuuccuccccccccccccaugaagaaauccuccugccucagcuucccacuggggaagugggaagccacuggggauauagugcuggggauacagacagaauccaucauucuggcuuuacuuauuuccuuuucuaggugguuaguuuugcauuuugcaacagggucccaaguauuccaggcugucuuugaacuuguaauguaaccaagauugacccugauccaucucccugcaccuccaagugccucgccaugccugacuuccaucugaaaggcuuccuuacucagaaucuacauuuuucuucugaaccccaccuuugucacauggacccccuccagucucccagcuccacguacccuuccaguuaguucacgaguucaaacuccacacacccgcucccuacccacaccaucaccagcucugcugccgccgagguccggaucccucugccugugugcucugucuagccacacgcaaggauucuccuuugccagggacguuugggauuguuuucuggcuaauuuugcuauuaauuccaguugcaccccggaacaauauggucccuuccuuacccauucuucuuaccuccaccaccaagcccugcacgcauggaagcuacuguucugccucucagccugccugcccucugccugggugcugaucugggcccuuucccaccccccaccuccuccacuggcaucagcuggacaggcagcucucuccuccauuggggaucugccuguacucugucugcucacucacuuugcuccuguguaugugugugaucccuuggcaagaauccuucuccuuccguguuggcuuugcuugcucuuccuaacacacagcaggagugcugcagcuaugcaugguccacuagugugaagucugacucaccaagaauaggcuccaaguugacagaguggcugcugcccacacagcacacuguaguggaggaagagaaaccaugcuucacuccgagguucuggagagagucaggaaagguccuggcaugaaagaccucuuuggggacgggggacugggagcauacagugucacucuuggccagacuaguuucugggaaauggcugggaaguaguucugguuuucugagcauggaguggaaguguggaagggagaagggacagggugagcaaugaggucagagagaggccucaguuucuguggggcuccacagcguggccucgcugcuguagcucucagugaccgagcacgugcagacagcacgggugucugacccacugauucuucccugggccccacaugugaugugcacacguaugucugcaugcgcauacauguguuacauacuguggugggcucucaugcauccugguggcagugugaaguacaauauuguaggguugggugacagcacaggugagugggacacccagacaucugggcacagagaagaauguagaagacaggggggcagcuuuagaaacccggugaacaaagcauaaagacgagccagacggauucuucaagaggaggcaugguggucauugugugugugugguaugguguggggugugugugugugugugugugugugugugugugucgcugagagccagcuucagcaucaggugaaguuggucacaucuauagaauaacuguuuuccgccuguuucugacuccguuuauggucaccuacaguaaacuguucauugcagaagagcuguuuguuugguacauuugagccauaccaaaucugagcccaagugcaaggagcccagggcuccugugagaccgaggugagcaguguccagacccucuccaggccagacuguuguucuguucucacgucaccucuggacugaaaucucugcugacacgggcaggcaguuuuccuuuugguccucuggccuuucuccuccucccgcaccacggcaguucccuuccacaccugugugcccucagcagcgcccgcucuuccuuccuguuugagcgugggguucauuauucacaggaaaggcguggcucuucuugguuuccuguaguaugucuugcuuacaaugugucuucuguuuguggaugacuacacagguguuuguuuuaaauaaccagaaggaacacaugcucucaggaacauggggucauguguggcuuucaccucugucacaagugucucugcuauucugcaguuucuccugugcacacagugccuguagucaccuccuagggacaucgauugcucuaagaugucaucagaaccugcacuccccugugacccugucacuuggccuucuuccuccuuagcagauacacaaucuucauguaggugcacagugauuacagacaacagguuaagaagccaggagggacccaagcagguuucugccacaggaguucaccagagucuggccuguucuuguugccucucucugcagaucuuuuggguugccauuguuuugggguagguccuuaccauaaagcccagguuagccucaaacucacucuucuccugccuguccucccuacugcucggaucacaggccugacuuuguugugucuccaguggccucaggagaaaccagcaggacaguuauugggguugaguuucugugacuuuaugcauaguguggcagcuugcugucuccgccccaggaccacagguccucauccuguguaagcagcucuaagaauugagugcauggugucuuccccuucacuugucugcauuuaccagcacagguguggacgugcucuuguuaguaguguggguagacauaggccucgggucaaaggcugagcaguguaguccccugugacgagcccagcccagggugguucugugcagcucuucaaguugaaccaggaccuuguagcaaagcauccagaaaggagauggcugaggcagaggcucaguguaagcugguauuccuuccacccacccagaggagagaucacaccucuagcguggcggcagggccucuguggagggacugcagguaguaguggaaaaauuggagagauaugagucagauaucuuauucccaugacuccucagcacauucuggagugcauugcugcccucccuguggcugagaggacucugccucaucaggcuaagccauggcagcccagauucacccgcucccaccuccccgaucccugagcucccagguccucugugcgaugugguugcugcugugccagucacagagaggcugaggaggccgagugugcagugagauagcucggcagugcuaggucccuccccucuuuccuucagggcaguuaagucuuccugagcacauuuccucaugacagguuucaggucugggacuccagcgucaccaagggucacaguagcguaaagauacagagcugccucuugaaguauuaauuagcuuuaagcagaaacugacucuuguuuuguuuuguuucuaguuuuugacguguuucuguuuuggucugacuaggaggagccugaucugguuagugcaauuuauggccgagggauagccuauggaaagaagggacuacaugugaguauguacuagucacgcuugccaccucgcccacauggcuugccgcacccaagccuuugucugaacugcuucucauucagucagcucugccagggcacagauggcaaagaagggugaucaccccaggugccaugccuagaagguggaggaccaggcuccccugugucuuccaagucagugaugagcuggccacaggaaaagccagagaucuguguucucagaacauuccccgaccacacugagauaaggauauguugucacagugggacccuccagccugggguccuuuuacagugcggcgggugggaugaaagaacuuuuuuuuuuaaacuuugugacauuuauuauuauuuacuuauuuugauuuuuuuucuuucuucuuuuuuuuuuuuuuuuuuuuuugagaugagauuuuccauguaucccuggcugucccggaacuuacucugaagaccaggcuggccucaaaaucacagagauccgccugccucugccucccaagugcugggauccaaggggugggccaccaugccuagcugagacauuuauuuuuauuugcuacauuuuaggcauuuugcagauagggaaaagucuuuguaaccacgauuaaguuguucccuuuauuccccugagaaagaucguggagccgguggugagcccuguucauuaguauguaagagcgcugacccaagaucguucagugaguuggcggugcccuuaagaucagcacguguagagugcuguacacaaacccuccugugauucccaacuaaagacagucacaugagacaguacucagagggagaacuauaauuuuugugacauuuacauuaaaaguaucagucuuuaacacuuuauuaaauauuuuaauuaaaauuuauuaaaguauaaaaauucugcuaaguugguacuggcuuggagaaaauugauaugacaguuacaaccauacccuucugagacacaggggacccagaugaacucagccuugguaaccaugguauugaggguucaagacuauuucggucauaugucaccucagauaacuggugcuuacuguccccaucugucuaaauuuuguugcucaauauguaacuugucuuuaguggaggcuuaagcaugcauuuuuaagcauaaaaucagccuaugcaugcugaagagaacuuagcuaggccggucaaauaggucccggguuccugguuuuggucaacacuuggcauuuuucugucccucuuugacagaaaacuggugggugccguuucccagguuggcacccacguggugucccccccccccccccagaugaucuagguugaucuagguuacguucagauacuaucugcccucugugagcuggugguaagcguccagguucagcucgccauccuaugggguggggagacuugggugugaccccugagcagaccuggcagccgggcaccggugcagaccccaaguuguguucaucuccaagcagcggcuccucuggugacuauauugccagugucuuagaagaucuugccgcugucugugcagcagagucucauacuaagcuaauaccuuuucaaggacauuaagaacgcugagcuugcuuuguuugaacugagccgaguaauugccuuggaaccugaccguccagagguauuugagcagcgagcugaagugagugugguuuucuuucucucucucuuuuauugaauuagcugaaacuuggaagcugauauuacauuaucaccauuguaacguguaaugcucccuuauacuggacuguguucccgaggcccugcaagcaugguggcgguuaccaggcggccucggagugaguggugcuccugaggcaacgagcgagaauggugcugagugugaaagcguggucccguugucugcuucucccgaggacacucauuaaagagauaccguacaccguuuuacagauauaagcgacacaguuuaaccaaaguggcuaguggguuggagagccagaaaugccuagcucuuggaagcggcgguuccgcuggucuagaagggaggagggagaguaagcaaaggaacagagcaugcucaugugcaguuccugggcagaggacuugccuccguaggcaccuggagccgggagguuugcugcagaucucaagguggagacaggccugggggagugcccguagcaucugccgaguggacaccagaagcugggcgaguaugccaggcccaugggggugaggcuuucggacggcaggagcaggaaaguggcaggacucccuuuguggcuuuaaauccacguucuuacgguacuuguaggcugucgggucacacgugcucgugugguuggucugaaugcagucggcuuuuugauacgggugaccucucccccccaccccccgucucccccaggaaauauaacaaguacaggagcacagugcucggucgccgagacuccgucuagaggucucauccucucguuguagcauuugagaucucggucucuaagaauuuuauguucugccggggacuagguuuuaaucuaaucuuucucagugcuuuaguuccuuuccuguccaucuugggucuuaccauuggacuagauggcuguagcacuguccccacagcaaggggcucuugaaugguggucgggcuggccacugugucucaccagcucuggaugggcuugcugguguuucucucaggacucuggggaugucugaaauuauucugauaaacuaggaacucggcuaagacuugcagguuuuaaauauuugcauaucuaagaaaaagcuaauugcucaucuaaaaugagauuggugauuagaacaguauuuucuauucucuaaaugaugcauagcaauauuuaucacaguuacagcacugcagaagaucgcugugaucuucagcgcuaaauugcagccugccuuugucugccuuagaggugcuuugaagaacgcuuugcucuugcaaauacaaaugcaaauaauacaaaaaaaaaucuguauuuauaaaaguauauuaacccauuacuuuagauauugacaguugugccaagauaugauaguuuuuaccuaggaggucaauaagcagagaugggugguugucauuccaagugguagccccaccccuuccugggaugagaucagggccauguguccaucuccugcuuuggaagcaacugcuaauguuugugcugggcccaccugagucugugcuaggcucuugcagagcagcuggccaguuagugacacagggugcacaugcccuucccuagagcacgcuggacagagacguacuggaaguaugguagcuuggggucaggugcauggacaugggcccacugggguuuucuucucucucggugacuuccuugugggugcugggcucccauugauguuaccgugccgccuggaccacagugacucagugguggcucuagggggcuucucaaacaggcagacaauuucccugagaugcugcugaguguggccaaugagcuuggggcugacaaggcaccugggauccuaggacauauccuucagcucucaccucccacagggacugugacugccagggacgagucugucugucccagcggucgaaugugcaugugccaguguuuuacuuaaaaaguggacguagcacaagcaaaggguucuuauuucaagaaucugguccaccuagggugaagucaguagcgaggcggcugcuugagccacauccccaucuccccuugcgaaacagagauaguggcccuucugagcaucuuaucuaccugugcgugcaugaggccauggcucacagccugcuccagcgagcuuugugaguggggugcagcucgauggagugggaaaguuaaaacucggacaguguagggcugguccuggggacuuuuccugauugcauguuuuggauuucuagauucuguccccucugggacgaauuaacgaagccguaaaugaucucacuaaagcuauucagcuucagcccucggcacggcuguaccgacaccgggggaccuuguacuucauaucugaggugauugcccuguaaagauugguccacaccucacuucucccaucaucucagcagccacuccuugcuagaacgggcucaguucaaugucaguguuacaaggcagcugcaagagcaccgucuuuggcagaaauuaaaugcaacagagaauauuaagugucagucaugguuucacgauugggcugucagcagcaucaauuucuaggcuggcacgaaaaggugacacuuugguuuguaacuugcacuuagaaguacaacuugaauucacccgguucucagucugaaccugucaggccugcagacccuucuuuuuaggugacccuaaucuagcaagagccuguuuuuaugacaguggcuccuagaccauugguguacuuuaacagagcacguauagaccagagccucagcuuaacgcucaguguggcugcacuaccuaccgccuguucauuucagaggugucuaguguggaaaagauggucugguugguccuggaaaggcugagauugaaggccuaacauuaggccucugugaacaccacuuagcgguuagcagggcgagaaguacuaguuuggcuggaccccuucgccguggcacuuccuucaaggccaggaaaggccuaggacccacuguccauccacagcagagaacauuccagauucuaacaaagacaaucuuaucucuccuccuccuuuccauaggacuacgcgacagcccacgaggacuuucagcaguccuuggagcugaacagaaaccagcccacagccaugcuguacaaaggccuaacuuucuuucacagaggacuucugaaggugaagcugcgcugccugcgccugcgcugcugugcccacuucgcuuguggggagggggacuuagaggaauugauccgaugccucucaaaaugaugucacugguuucuuagcacuguguguguguguguguguguguguguguguguguguguguguguugcuucuuccugggcauuccauuccacauccuugugucucuauggggaucccugcugugccacaggcugugccaguagccagggaucacagaguugcuaccuccccugccugagccccggugccaacaaggccacggguacuccuggugcccuaguacaggguaauacaagccacaggauggaagguaggccggccugagaguuaugcauagccaguugcuuguuggagaccacacuauaugauuaaagccauccugggcagagaugguggccuugagcccaguguugaaggcuaacuaauguucacagcccaggauggggagugucuuaagcaagaagaaugagugucuucaccacacagguaguucugccucgcacacuguccuguacacccauguccugucugucugcuagcugcucgucuuugcaucuggccaugugcagcucugaaacacuugggguucauuaccaguuccuuuccuacacagugugagguagugacagcaccugugacagccaccuguguuagccaucacaggccauccagagaagccugaaagagcccgugcccuugcucugagcccuaaccaccugcuagacacauagcugagcucuuuuggcuccuugccuauccauaaaguagacccaaccuucugucucuucccaaagugccccccccccccagagucugguagcuucccaugagaaaaguauuacaauaauuuuaucaggaaaaauuuaaucuaugucuuaugcaugcuuuuuaaggacucgcgucaaagugaaaaccaaaaggcaaagaauuugccaguccuuuauauauucuucacaucaugugcaagcgcccaggaugucugagagaaaggcuuccccgugggcacggggcugccgccaggguccaggacucacacugggcugcgccucccacuuggcagcuguaucuuuccucacagccucuggaagugaaugcacagaggcagccucggggcccauggaaaagaccgucccguccauaguaugagugcuuuucagaggacaccagcaaaugcacuguccgcgagacggagccgggcacagucacggggcaggcuuccgaaacaggcucaaagagugagacuugguuugcuuuauccagaucuccacugcuuuaacugagcauucgaagucccucaguaagugggccuucccaggucacugggucccuccugucaugcugagucaaccaauauacaugggacagugagccaagugacgagagcacuuuguggugguuuuucuguccaagcagaucacaggguugcaccuaaucccucuugucccacccgcauccucgugagguguagaugcagguuaugugaaugaauuaugcgccaaaagagugaccccugguaucugcagacacacagcauuagacucagcagugggcuugaacucacauuauaccgucaaguggaucucuucaggccaaugacagucuagaaauuaauuaaguaggugacucuuuaguuuuacaagaaccuuucauggaaagauauuaaacaucuuauaaccuguuauuuaucuaauuugucaaagaaaggauuugacugcagcuugagccagucuucacuuugaaacucuccugccucagcuuuuucgcaugcugauuucccaugagcgcaccauaccuggccaggcacgucacacaacuguacagugugguggaucgacccuuggcacaugacagcaagaacuuuucauucauuuaguccacgccuuaaguacauuuuaagcucuucaccuugagcuguugggagcagcccagugauggccgcccagugagcggugaggauggugaugguggaguggaagugguggcauugaccaagccaaugguucugaagcauuuacguaccuagagguugccucgcgugagcuagucucuuguucccaauggcuuaaaaucuugauucugcuaugucccucuuuggcagagugagguagagagcugagcagagcuuaggcaggaaccugaaaccaaagacucuuaaaagcugaagagaaucagacucugaagaacuguggcguccacgcaugcuguaaguggagugggcagcagaugccugcugggcaccuccccuggauguccacagacacugcaggcuuaacacgccccagccccccucccugcugccuuccugcccuuccuaccguggccacuacacuugccuuccuaaccugcugccaccagauccugucugccuucagaaaugucucugaaucugacccgucuuucucuccucagggacgcucaccuugaccuuucaucaucucuugcccagaugcccacugacccagccucccugcucagccccccacugcugugcugccauaguuaccacccuuuccccagggcccugggaugccugggcaggaggcaacuagguucuuugucucucuccacucacacccuugugcgcuguucugauuucccagcacuccucugucugaguugugcacaguacagcacugugcugucuccuuacacugcugcucaguccuuagacuagggagcuccccuucuuauucccagagccucucuccuaucucugcuuuagcuuauaacauuuaugcuaauagcccguuaccuaaucagccuccuguucugacuggacugaguguucuuagaggacagagagugauuugcucaccuguacccaccccucaauaccucacacuggcucugguacacaguaggcacucaauguguguuuguugacuugaaguauuauaaaagcucuagaagauucagacuaggccacuugaguaccuacauccgguguuagaagagcccuucagcugcucuuucccaccauugcuucagaggagucugaaaccaaccccucuggccaugccgccccucugucuacauggagccuggaugcagaggcagaagccuugcaagucaucaaauacuuauugagcgccuaccaugugcaaggcaugugguggcaguggcggccauucucucccaccaacaccuaguuggacagaagugguguugucucaagucaggucuuuuucuucaaguugcaguagcugcuuaacaccauuuguccugugcuugggaaagugugauguguuuauacuuuuuauuacaguaacaguaaugccaugcaaaagugcaggugcaguggguccacgugugcaggugcagucagguguaguggguccacaugugcaggugcaguggguccacauguacaggugcagucaggugcaguggguccacgugugcaggugcagucaggugcaguggguccacgugugcaggugcaguaaggugcaguggguccacaugugcaggugcaguggguccacauguacaggugcagucaggugcaguggguccacgugugcaggugcaguggguccacgugugcaggugcagucaggugcaguggguccacaugugcaggugcaguggguccacgugugcaggugcagucagguguaguggguccacaugugcaggugcaguggguccacauguacaggugcagucaggugcaguagguccacgugugcaggugcaguaaggugcaguggguccacaugugcaggugcaguggguccacgugugcaggugcaguggguccacgugugcaggugcaguggguucaugugugcagacgcaguggguucacaugugcaggugcaguggguccaugugugcaggugcagugacuaaccgugaacagagugguacccuccagaggcaccucucacaugaggauuugggugggugcaauguguccuagauuccucucagagcccacagcacagggccucagccacguaucacugcugcaugugcccaccgagcccacugcucuagccucgugugggcuguuugcuugcacuguuagauccaaggaauccccaccaacccagaaaccuuuuuuuuuuuuugcuuuuucuaugugcaguguauaucaaucacucuuguugacucaguuuaagugcagcaggcugucauuuugaauaagcucauagagcuguugaguuuccuugguccauuagacuauuauggauuggagaaaugguguuguuaugaagaugacaucauuagcccuccagguccugcugaaccgucuuacagacauacauuuguuuacuguuagggucagagccuccccacagcucacugccugccuccuucucggucuuaucugagauaauucuugcagagacagguguagcauguguguaacccuguaggaaugcagguggcguuaugugaauggguucauuuucugcauacuuuccauaggaagccaucgaggccuucaaagaagcucugaaacagaaaguugacuuuaucgaugcauauaaaagucugggacaggccuacaggugagugacagugggcugagacaggggagugucucucagaauagauguccacuuuagguuuugaaagcaugugaggaagccccgugucaggaccccuggucugugucgguguacauagcucagacucucagaggguaucagucccuacagauugguguugugccuggcacacagggguguugggugguauuuauuuauccucccgcucuacagaauugucaggaauugucuuaguuaggguuucuauuccugcacaaacaucaugaccaagaagcaaguuggggaggaaaggguuuauucggcuuacacuuccaugcugcuguucaucaccaaagaaagucaggacuggaacucaagcaggucagggagcaggagcugaugcagaagccauugagggauauucuuuacuggcuugccucaccuggcuugcucagccugcucucuuauagaauccaagacuaccagcccagagauggucccacccacaaggggccuuucccccuugaucacuaauugagaaaaugccuuacaguuggaucucauggaggcauuuccucaccugaagcuccuuucucugugaugacuccagcugugucaaguugacacagaacuggccaguacaggaauauauauugagaguagguuggaagcaaccaucuaaagugauuauguagauggaaguaugcauugugucuuuaaucaauuuuucucauuuauaguaaguugguauauggacuguuucuauccugugggaaaagcuuacuauguaaaaaggaaaucgguugcuagcagucauuuccauucuggaagaacuuaaugucugaaguauucucuuuuuuuuccuuuccuucaaaauuucgagcugcaugaugauuuacuagcuguucgcugaggugacuucagagaccgggggauacaguugugauccuauggguuugacacuuucugugaacaugguccacggacuuuucccuagcuugggaagaguguucacccagugccauucucgggguuggcacuuguuaaugaacuaggggaggaguuugaauacacauuuuggaaaucaguagguucauuguuccuagagaaaucgaagcacaugaacuuccuguagugugucagauuacuaaguggugugaggacuguggcugugugugaggugcucagguagccagagacacgcccuccgucacgucucacgagcucccagcacugcucuccggggcuuccauggcugaccggccugcacagggcucaccacgguuguucaauccucagagaacugggcaacuuugacgcagccaccgagagcuuccagaaggcccugcugcucaaccagaaccacgugcagacccugcagcugcggggaaugaugcucuaccaccacggaagccugcaggaggcccugaagaacuucaaggugagccucggcagcaggcagagccaccgcuggauucugcuuguuccucaguucaguggcacuaacuaaccuggaaggggugccucuggguagacggagcagcgguccugacccaugugccgcuaacucugccguuuguccuaaacgacagcgcugccugcaacuggaaccguacaacgaagugugccaguacaugaaggggcugagccauguggccauggggcaguuuuacgaagggauuaaagcacaaaccaaaguuaugcugaaugacccucuuccaggccagaaggccagcccagaguaccugagggucaaguaccuacgagguaagcagacaguggcgggacuguucggcaucugugcucagugcuguggcguccugcugcuccugggaggugguagaguugggggugagcauccugucccuagcgucucuugcugcuggagguuucaggaccaggguccucagugucuuccgagacaggccugauguucuugcuaccuuaccuacggggcugguaaaacucagagaagcuuggccugaguaaaaagcacacuucuaguuggaugugagauucauuguuggaagcaugauuuacacccucucagaucacugaaggacaagaaaggaccuuucauggagguuucauuguuuagaguuagugaccuggcaucucuggccucucguucuguuaugucacauccuccugagucagacccagucugguuagaaaggaagcaauucuugaauuagucacagacuugcuuuuucuccauauacaucuucaagugcacucauaugcguaccuuccaaagcauccucacacaucuuccaauauacacacucagacacacacuucuucauauguacacaugcguaccuuccaaagcauccucacacaucuuccaauauacacacucagacacacacuucuucauauguacacaugcguaccuuccaaagcauccucacacaucuuccaauauacacacucagacacacacuucuucauauguacacauaugcacaccuuccaaagcauccucacacaucuuccaauauacacacucagacacacacuucuucauauguacacauaugcacaccuuccaaagcauccuuacacaucuuccaauauacacacucagacacacacuucuucauauguacacauaugcguaccuuccaaagcauccucacacaucuuccaauauacacacucagacacacacuucuucauauguacacauaugcguaccuuccaaagcauccucacacaucuuccaauauacacacucagacacacacuucuucauauguacacauaugcaugccuuccaaagcauccucacacaucuuccaauaaacacacucagacacacacuucuucauauguacacauguacaccuuccaaagcauccccacacaucuuccaauauacacacucagacacacacuucuucauauguacacaugcacaccuuccaaagcauccucacacaucuuccaauauacacacucagacacacacuucuucauauguacacaugcacaccuuccaaagcauccucacacaucuuccaauauacacacucagacacacacuucuucauauguacacauaugcguaccuuccaaagcauccucacacaucuuccaauauacacacucagacacacacuucuucauauguacacaugcacaccuuaugugugcacacacaucuuccuuuguacacacacauucgucuucauauguacacacaucuuccuauauauacccacaccuuccuaugcacacauacaucuuauguauacauauacacuuuccuauacacacauaacuuccuagguacacacaucuuauauacacaaacucucuuuauauguacacacacaucuuaugcauacacaugcacauguacacacacaucuuccuauacacacaccauauuucccuauacacaugcacacauacagaaacaauuccuauuuacacacacacacaaaccuucauauguacacacauaucuccuaugcauacauaaacauaccucacacauacuguaacauacacacacacacaccuuccuuaacacauaucuuccucccacacacaucuuccuguauacucacauaagcaucuuccuauguauguguacauaucuuccuaugcuugcacgcacacacacacacacacacacacacaugcacaucaguguccacacacacaccucucccagcauacauacacauugucuuagucuuaggguuucuuaggguuucuguugcuguguuaaacaccguggccgaaagcagcuuguugaggaaaggguuuguucugcucaguucgucagcccaguccaucaccgaaggaagucagggcaggagcccggaggcagucauuguagcagaagcuguggagaaggauguucacuagcuugcuccucauggcuuacacagccugcuuucggacacaccucaggaucauuaucccaggaaugguaccacccacaguggguggggcucucccacguccaucauucgucaauacuauauauacuugccuacagacugauaauauugagacauuuucucaguugagauuuccucuuccacgauacauguagguuugugucacacagacaaagaccagccagugcauacauauauuaaccagcauauaaacguguguccuccaguauacgcacacauauauucuccccgcugauuugggaagguguuuguugucugcaugcccacauauuuugccuuuguucucauuagccuuggaaaguauucuaaagcagaaaaaaaugaaguaagucaugcuugcagacuuaaguuaggaacagccacguuaagugggagacgcacacaacaugcaagauggaucagcgaguaaagacacuggccaccaacccuguccagcugagcuccgucccgaggacccauacgguggcaagaaagaacuguguccugcagucuguccucagacuuacacacacacacacacacacacacacacacacacauaugcaguuccccaaauaagaaaaauggagaaaacaucuaaaagaaauguaaaaacaagcagguggauguaacuugguaaaaauauguuguaccuaaucuaauaacaaauuaaaguuuuaauucagcauauaauuacuaggaaacucuuaggguuuuuguuuguuuugucuucuugccuuuuuaaauagcaucgcaucuuguaggcccugcuggccuagcgcuguuucuguggaggauccuccugucucagccuucugagugcugagcuugcaugcgugagccaccauuacuguucugagaaauguuacggcuuaggucuagggagaagcugcucuaccagaggacccgagugugguuccagcaaccacacguggcgaccacugcggccagcuucaggaggagccaacaucucugucuuccaaaggcaccuacacuguuaggcauauauccgcauucagauacacauacacacucacacucguauacaugugcauauauauacacauuuacagauauacacgcucauacauacacacauacacauuuuaaaguagugauuuuuuuuuugcucuaggucuuuaaccccugggguguuuugcaaucacaggacaucucaguuugagugcucaucuuuuauuauccagucuugaucagagcuuggacuucauugacuugauaguuggaaauagacugauaugcacacguuauuccgaacauccugaaguuccuaauaacugagucaaguaucagcagcccagagggccaucuuucagacagcuugucccuuacucuccucuggcucagcagagcuggcacugggaaugacagccugaggggcaaacacgccugucagucaggccguggcgagcuugcacacacguuuucuccgucagagcugacagaucccaggcucggucugaugcuucccuuguguuucaggcucugagacagaaagacaagcucuuuggcuucauucauggaaagguuaacauguaaucagagcggacccaagcuggcuguuguacacuugguucuugucacuagcagguuucuguaguccagaagcugucuuucagaacuccugcaguuagggacagugugguucaaagcguccauguggugacccacucuaguaagggcuucuuuagcagugucuggguuuggcagcuccuuuccugucuacagaguauucucgauaucugcacgcacaccucgauaccccucugacggaauauaacauugacucggaucuaccgggcagcuucaaggaccacugggccaagaaccugccuuuccucauagacggcuaugaagagcagcccggccugcagccucacauuagguaagugcugugccguguggggggcauggccagccacaacccaacuggaggcucauuuugcuuuugcauguguaugggaggauugggccucagugugcauucauuccaaggagacuuaaucucauaaccccacugccccagccuccugagugcuuguauuucuugaucaauaaacaacuucuugcccguguuccuguugcaguuuguaugucaccagcuacuucucguaguucauauggcaccuugacacuuucuugcccgugucacuucugcacacauguugggcaccuuuauacucuaucaguuacgagacauagucaggcacugcacaccgugcgucuggagaaguuuauagaacaaaugcuaaugggggccuuggagcccuacauaugccauguaguggugugcuggcuugcaugugguagcaaacaggccacaugacuugcaaagagugguugcuucuuucaguuguguggugggaugugaagcuggcugugccugguccugugugugucuuaguugagcuccaguggggcgauagugcaggugugccacacaaguccuuaucuuguuccugauauuuccugcagagauguguuacaucagaauuucgagggcuacaagccugaaguccaggagcugaucuguguagcugaccgccugggcucgcugaugcaguaugaaacaccgggguuccugcccaacaagaggauacacagagguauucuggaaacuugaaguggaaucguagcccaggaacagggucucucagccacgucaucuuccucuuagaaauuguuguuuacugcacucagccucccacaggaccagagcacggguguguaggauaguucagugaguucuuccagcucggcucuuaccgaugugcagauauagagcauugcucucaaucccucacugccagucaggccaaggcagcuuuccuucuuacgggggaaggaggggcucgaggcuccgccugcuucgguaggaagccuugcuggguagcaguggcucuccuuaaugugagccgugucaucggaagcucagucucaccagcugcguccuguucuuuauggggucccucaggcuugagaggaaaggugagaauuggccccuuggaaaggguucugacgagcugucugguuguguccucccuuagccaugggccuggcagcacuggaagucaugcaggccguacaucguaccuggaccaacucaaagguucgcaugaauggaaaaacaaggcugcugcaguggagggacauguucgacauugcugugaaguggagaagguaacccgugggcacacagcagugggcaaguucucucagaccaugucucccucggcgagagguuucaaucccucuuugcuuaccaaauuaaacccuacugugggccuggguaccugaggcuuuccacgagaucgcuguccaggccgggugggaaggcuccagcaaagggaagugaguguaacuccgacccucucugaacugagucggguccaggcugggccagcaaaaaguugacaauucagugaggagugcggcagggucucaggagagaagaucucuucccaaguguuacauacagcucuuggaacaaaagacucaaaggaauaguucucgcaugccuuuaauucccugcauggcuuuauauacaguucugggggugauucaggguuugacagcaggcaccucucauuggcuuggacugagaguuuggggggaaccuuauuugcaugugggaaggcuuggugcuauuccuaaguggcugauagcuaugccucuucuguggggguugugggggcgguaacuccaacaggagccaggaucacucccgggucccaggguucaagaucuagccuggacuggaaaccaggcugucugcgcgucaccuguugccgcacacccuauaaguuaagauacugaguuauuucccgcuaaagcuugccauaaaucacuguugccuuuauucuucagaacacacucaacuccugcugcucaggaaauaaaagcgaggguugccagguuucuaagccaccaguuagcccucucuggaaccaccauuacagcuguuuccuugguugacucuaacaucccaccaaguugacaguuuagacgaaccguuacagcucaccagccuuugcuggccucucgccugguguggccacacugugcacugggauggccugugugcucuuuuucacaagucggagccagucgggcuccucccucacuuuuacagagacccaucuuugguuuauccuggaagcuguggguaaggccgcagcacuccucaugagcucugcuccacaggaucgcugauccggaccagccuguccuguggcuggaucagaugccagcuccaagucucagcagaggguucaauaaccacaucaacuuaaucagguaggggccugugugcuuucuuguguuugcguaggaguggagcagugugaggggcccugguggccuuggcggggaacacacccaggguagcugugcacccacaaguaucuuuccugcugguccacuggcacaaagugcuugccgugcaccugcacagguagagcccugcccgcucaaggguggacucucgaaggauggagggugucaguuuucaagaagucgucaaacagcagagaaaucgaucagauggggaauuccguauuugccuagguugcucgugagccugcuguggccaggaccaccagggaggucgcucccugaugggagcuucugucuuauccugagcccugcagucaggcacuggguggaugccugcccuuucauccuuuaugggcuuagcuacccugacaacaggcguaaacacauccugaagagcucacuucagggaugcucgaaguguuugccugccauuuagugaacaugacuuuagaugaauuuggcggaugugguacugagucauaucuaaaauauuucuagcucuaggagccuagaucaagaaacuguugcuccaucuaacaugugacauuuaaauuuagguuuuaguauaaaagucuuuuuuagacuuaaccuuuuuaauuucuagaaauuauguuuauuuucccuuuguuacuggcuccuuucaguuccccauggaaugauuuguggcacuuuuaccuagauuuggucacaugcuguaacugaggccacuguguaccugcuuauguucuugcugaaugguacuugagucacagacccaugucaugacuugauggagugcagagaaguaagggacacccgguguauccaggggccaaaccugaacugucucggacagacagugggccgugcaccaacccacuggugaaucccuccugacuaggaagcugugacgcaucccuuguagcugccagccacugcaucccaggaagucucaggaacugaggcccgagacauagguagaagccagaauggugagccacgccuggguggugagccgaagaacagcaagacagauggacaugacgaaggucgcuguagcaacagaugaaugaacagauuugugagggggcagcagguggggagcaaguguagagaugcagaccccugcaggggguuagaagagagcugcagacacucugaggugcugacagaaaagcaucagaggcauccauuauucugcuucuagcugaggccacaguugucccagucagucuaagaguaguaggagaaaaagcgagaagcuggaaacugaagugcccugucagggagagaaguccuccuugcaucaugaccuugaugugagggagcugucagaagcagggagugguguuuccuaggguagacggacuucgacucagcuguugcuagacgcgaacaccuucaagagaggggaagaagaaaacaaacaaacaaaacaaaaaacggaaugggcaugugaggaguauagugucuccagaggguagagggaaggaggacugcuaaaaggcccgagaggcacccucagacaggcaggcaugcacacagagagccugccguguacagagagcuuggcguguccagagccugguguguccuuacgcaggcacacacaagugccaggcauguccaauacgcaggugcacccagagagccaggcacauucaauaggcaggcgcgcacccagagaaccaggcgcgccacucaugguagucgccaucaggucugaacuccugaagcuaaggauuuuccuuccucuguggccugucaggagcuacgucuuuucuggacacuuucugccaggacagauuccaagagcccaagcuuucugcugagaugggagucgcuacucccacagugacaaagcaagccccucucuuacacuuccccauauuuguccccgcucuuuguuuuuggaacuaacugauguuuacaagccuuuguaaaaugaugguuaauuuuaucgcuuuuaccuuacaggggucaagugaucaauaugagauaucuggaauauuuugagaaaauacuucauuuuauuaaagauagaauucuuguuuaucacggguaagccuccaguucuccucuuugcugugaugcauuggucccauguguuucauguguggucuaucugugagauuugaaaacugaaccacauguaaaugaggaaaauaccuaauaaaaaauauaaaaaaagaaaaaagaaaacugaaccacaggcagaccaaacgaacuagaccggaaguuuaauuaaagccugcuuccgccagaguaauggcuucacaguguuggccuuggcagugcuuucggccaacacucaucacagugacacucccgauugccgacagagcuuccguccaucccgcggggcauugaguuuugagguggagucaccagcugagcaugagaaccguguggcgcccccccagcagggugcuuagauccgagcagcuugagaagugaaaccacacacuugccagugcagaguuggaacaggagaaucaagggucagcuaagacccccgcgccugcgcauuggccugcugcauuuccugauucgccgcgcaugccucugcagccccacaccuguuggcucgcauugacuccugcuguugcccagugugggaugcugucuauccucuccaaagaccucuucaugcucagggccuuugcauuagaugguaugacauuuauacgggacccacacaugggccuccagugcauugcgucagccccaggccaaugcucgcugcuuaggggaugcggagcagguggauaagaagucaguaacaugauuuucucacauguauuauugauuuggguggaugacccugucagugagaugcccugggauauaugggccugcagcauugagcugcuuguccuuaggagcaguuauuuaagacgugaauggaucugcguaucguauucugcauuaaccucccucugcccuucccccucucuucaagagcaaauaauccaaagggcuuauuggaagucagagaagcucuggaaaagguacacaaaguggaagaccuccuuccaauuaugaagguaaguuugcuauuagcaucucagguggggcuggagcagugacuugguacugaagagcccugccuuuaucaucccaaggacccgggcucgauucccaacacucacguggugaccuccuguggugucucaaaacugucuguaaguccagugccagggcaucugacuucugaccucugcaggcaccgggcauguagggugcacagacauacaugcagacaaaacacacauacacuuaaauugaaaauauaucucaggaggaauuguauaaaagaaaaccaaagcacauaugugacuguugcgcugucucagaacuuacaaaguauagcaucugagaccccacauuaacacacuguaagcaguaacccagaucaaguacagcgcuggaaccagacucaaccagaaccgacuuucgagacgcagucaauucaggaaacaaaggacuugaaaauaaauauacucacgcuggaccuguggccacaguccaguacuccccagcggcccaaaagccacgcagcuguaguuagauggauuccuaaaaggagaguuggagaaccccgucucccccagauuccugugggcguuguuuguugucccguaggauaggcguguggaggccagcagcugcagaagaggagguaccugaggcaggggcgggggagcccuuguuguguggccacaucugcaguggaagucugugccguagcagggguugcucagaguuaacugugagcugagacagagcuguggccuugauggugggaaguugcucugagcaccuucaucuccauuugcucccagaggugccucacugggagucacgggaguacccucuccugguaccuaguaggcccgugucugauucccagcacugcagcagcaacagcauaagucgugacguccguuuccaucugaaaugcgcucugagaauggaacugaggugcggcuuugacauagaaagucagaacuaaaggaaagaucacagaaggagacaaaaauacccauaagucuugcaugacacgguaauggcagauuuguuggaagaagacucucagguggcuuuuaacaucacuuguguggugcugaccuucaguaucccggcagcuccuccaugacaggcggcaggacacacugcggacaggagaccggcacugcgcugggucagccucuguggauuucagucacuaaaaucuaguaagacuucaggugggagacgaaaucugcuuacacagaucguggaaaggaaagcagcgugccaaggugcauucacaacaccuagccagaggguggcagcacugcccugcugugucgucuguaggagcuuguccuuuggaugggagcguuuccagcuucagacuggcuucagccggauuauggaugugcauaugggaaacuuguagcuuucuucuuccucugaaaaacauggcgugccacuggagacuuagaaaagcacucaggccccagcagauagaucguuagccaggagcauggaccagagucagaggcccucccucagcccuccacucugccacuuccuggcccagcaguauggccagguuuguuccuuuuccugggacugugcauucauaccuggucuguuuguggcaaggauucagugggcauacgggaaagcaccugcacuuguuuucugagagccagucccugaagaaaggcgcuucucccucaauucagcugaaagcccugguagucaguccugcccagcugcacccugccgugggccuccagccaucgcuccuguggccugcugcaggagaagcccucccgccagagcccagaguccuuugucugucacugccugcccuauuccagcuccauccaucccagccagagucggagggcacuauucuagaauaaaggcagagcaucgcagguuuuaacucagagcuggcaucugaagcuguguuccuaggagacacccuggccggcuuugaggagguccccucacaaccuguggucugcgagguuagagucugugaaccuaaaacacaccuggagaggaaccacugagcaccccucgggccugcggcucuggggagcacuugcagggcacagugcuuuuucagggacacaugcuuuuucagguugcaggagcuggcauugcugcuccuggcuggcaaggcugcugccugcugcgcugggaggagaaccaaccccagagcagcugcugcacugagcuagaucuuggcuguagggcaccugcagcuuucugcuggggccccugcugcucuguagguuugugggaugugaggcacuuagggccuguguugcaucuaaagaaaggagaaguguuguuagccacugccuaccaagagagagcacauggucucucaguuugaaugccucagacaagcccagagcuaagucuaagguucaggacggauuagaaguagacauguccagcccguagcaugugggcgauauguagcucaggggagcugagaaugcagcccaauguguguguggugcugcaugacagaaccauguuacagugugagaacugcagcuaauauggauuuuuauuuucccucgaaagcaguuuaauaccaaaacaaaggacggguucaccgugaacaccaaaguccccagccucaaagaucaagggaaggaauaugacggcuucaccaucaccaucacaggagacaaguauguucgcuccagugugacguggggcugguggcggccaguggagggauguccugaugugagccgugucugggccauguguguacucaguauaugccuggggcagcauccuuccuggcuaagugcacacaacccauuugaauucccacagcaccucugccuggugcucagaggcuccggagagcuuguccaacagcaggaaaacggguccaugcgggcccagggcuaccaugcacgcauugcagauugcugggucucgagaggguggcaaugucuuuguggaaaguuugcacaucugaggcucuggccaucauuacucucaaccgccgccaacugagaagcauuuuacaaucauuucuucuuugauaguuucauucaugucuguagugacuuuuaguccuucuuauccccccaguuauucccacuaaacccuucuucccacaaggcccccacucucucucucucucucucucucucucucucucccccccucucucuguguauguaugugugucuguguguccugcugaauuuaaauaggauagacccacauucaggccacuucucccauaaaacuuucagcuuuucccugcuucuucccuuuauguccccaagccuggucucaccucucccuccagcuaauguucugagaaccaggagguucugcagauagcgucaugauaaguccaugcugugugaguuuauccucacagagccacaguggugcugcgugcaaaaacauaagcacaagacaugguaguagcaguguucaugagccucccacaacuucugcuccugccugggcagaguggcugggaaagugacaacagggcucagagcacuccgagcagccaccauuagcauucgugcgugcgcgcacgugcgcgcgcgcgcgcacacacacacaacacacgcacaccacuucuccaguuucuguuuggauuguuuaaucuaugccauugacagcagugcuuguguuucagggucggcaauauccuauuuucuguggaaacucaaaccacagaagagaggacacagcuguaucacgcugaaauagaugcacuuuauaaagaccugacagcgaagggcaaaguacugacccucucggcagaauucgggguagguuuggcuuuguuuuauuuucuguuccugggguguguguguguguguugcugaggauggaaccugguguguguuugugagugugugugcacauguacaugugugugcgcgcguauguauugcugaggaugggacuaagaacuccagugugcuaggcagaugcuucacugcugagccacaccccaguccugcaauuucuuuggcaaaugccccacccccucaccccccaccuacaguuuccccuguuucacugaggcuguuugucuuaugccugaaaucaauuguaauugucucagccuccuuucuaguacuccuuggagcaaaaacauuuccaggguuuaacaaccacagcaaugggguggcacaguacauauuguuagcucugcggugcgucagugcagguuuguggucagaagagguuuguccaggucggccacugugagcauggucuauaaguucccucauuagaauugcugcuuacuguaaaacugugauugugacuggcaccuugaagggauuuagcgucaccgagggggcaccucuggcuguaucgaugaguguauuucuagaaagguuuaacugaggaagggagacccacccgaaagcgggcagugcccuccauggacugguuguccuggucugaaucagaagugggaaagaaaguuagcuuucuaacuaagcacgccagcccugagagagggcagcuggucaagaucuugugcagcgcgaguuccugacauggggcugaaguucaugaaucucuguccuuucuccuaggaggcugaugcugucugcaacuuaaucuuauccuuaguguauuacuuuuauaauuuaaugccccugucucgaggaucuagguaagugaugucccguccuaugacaguuucagaucgaaacuguugcuauggcuuuuguuugugucacaggcacagccucuaaagcccacuacaaaucacaagaaguucccauuguuucuucuaaaauccacccccugcccccaagucccguuuuugguggguauaguggcaugugccuuuaaugguaacccugaggagacaggcaggugggucucugagauugacgccggccuagucuacacagugaggcccugucucggggaaacaaaaugaaaaauagaaagaucacacccguggccaaccaugaaggggauuuaaggucaggccaagaggagaggcuccgugugcugcucucugaagaaagcagcagggagcaacccggugggaacccgccuucccucagagcgcagaugcuccuguggacccucaaguuccuuaugcucuuuacguaggaaaguagaaauauuuucaaaauaaacacgacaaaguucuucuguuaacuaaacauuuaagguuuuaguccaaagaauuccuauguaagauucuuuuucaugauggacgcccgcagggagguuagcgugauagccauaggccagggcuggcugaagucuguccugucuugacagugucauugcguauucagucauugugggagcgcugauggccaguggcaaagaaguggcugggaagauccccaaagggaagguaugcugggcuggcggaggcacaggcauggcugcaccucgccccgggcuucuggcuguggaccgcaugcgagcuagaccccacaccauuuccuuccuuuuaucacguccugcgccuccucuuuuccaguuagucgacuuugaagccaugacagccccuggcucagaggccuucagcaaaauagcaaaaagcuggaugaacuugaagagguaaccauggccgugguuggagcaggcuugcaggggaaggcacgggcgggguccuagcuccagagacgcccccuccucugagggaugugcucauuucaugagcugcuccgcacucugguuuuaagguggagacauuuuacuacagguaaaaaugagugaugagagagauggagagagagcucagcggauaaagcccaucuggaggacccaaguucagauaccccgagcccaaauaacauucugggugguugugguaggucacaggucagauggaauucagacaagaucccaagaccaagguggccagcucagcuagccuguaucugugaacucugagcucagcaauaaauacaguggagaggagucaagggagagucucaaugucaaccuagggcuaacacauacacacgcacacacucgcacguacacacauacauaaauacgcacacacauacacacgcacacacacaaacacccgccacccacauugucgccuugugccagaauccagcaaggugccuaagagcuguaccuccagaaaugcugggcagugaguacaaacaagcuugagcuagacacugugacuuauuccacaucccuucuugccuacaugacaccagccacugugucaucuagugggccacuugagcuguguuuaaaacugagaaauaugugucugucauccacauugcuuagcuugucccagaguauguuuuugagguuacucauuuacacaugguuuguugauguggccgcaagguggaggguccugcuuccuuuagguaauuucagcaaaucuuuccacaaaccacacagccacauguugcacaguuaugguucauggcaaaccugguaugcaauguuucucaaggaucaugggaauucugagcuaaggauuuaauuuacugcugcagaugggaaacaggcuuagacaaguaacagaaucaggaggggcggggccaggccugagccagcauccucagagucaggcucagcauccucauagucucaggcucagcaugugagguagcuacagcaggauaugagcugugugacauggagcucugugcacaugaaaguauuauuucuuuccccagaguccuggcugcgcuuucaggcagcucaggacaugaggucgcugcuauagaagggucugcugugcccucugccuuuuugguugcaucuacccaggcuauggguccccauaaggcauugcuaauagucacaguuucccuguguuucucuuccaguauuuccccuuccuacaagacccugccaucaguaucagagacguucccgacucugagguccaugaucgaggugcucaacacggauuccaccccacggugucuaaagaaacucuagccagaucagaggauuuauacacaugaagggccaggccucucacuucuuaaguuauuuuuuaagacauggaauuauuauggaauuagguccuuuauuacuuuugauaccaauuuuugauaggaauugaauacuugaaaacauuuucuuuacuuuuucugaaccguaagagaaaucaugaaaacggguuuuuuggggaaaagcuacuugaccaggaagggaaguaugcguauuaguggcagccuguugguucccauguguuaagguauacugcuccuuccuuacagcaaaaaaauguuuacuucagaaaccaaaaauuaauaauuaagaugaagaaagccaacaaccaacagggcuugucuucacugucagagguguggguguuccucagaccuccuuccugugcaccucuguggggugccucgcuacugccaugcccccacaugugggcccuccagccccccuagaacuguggaagggccccagcacccacgguuccauggcuugugacaagaagcacuggccagaugacagacaguauuugccaaucacugaaccauauuuuucuuuucuuuguuggaaaaaauaagccgaggugauuucugaaagucgccauguucaggcacuggauuacguuguguuugugugcgagcuaguuuugcuuucagguguaagagcguuuagaacguuucuuguuuccucagacaggguggaagauggaggaauaagguccauuaaaggcugcaguuucaaaccgugg

SEQ ID NO: 4891 - RNA, 12609 nt, Mus musculus
ccaguccaggcgucuuccgccagcggccggaagcaggagcccuagaguggccauggggaccggcgggcguagggggacgcgguccgggaaaggcacggaaggcgcagcggcgacuucuuccucuugccuguaucguuguaucgagugcaaccgagaggcucaggagcuguaccgggacuacagccacggcgugcucaagauaaccaucugcgugagcgcgccggggggcggggcgcggcuaggaaggcggauccgaacuugcugugguccggggcgaggccugggagcuugagcacgugggggaggagugguccuugugauggugugaaagagaaagcaaggaugugcuugaagacugccuaggccauagauguucuaagacuuguggcacccaggagugguggcgcauuucuaugacuccagcacuccacucgcaugccaggcaggaggagaaucacgaguuggacuccagccucgauugccgcgagagagagagagagagagagagagagagagugugugucucaagcgaauaaacgagugauggagagagaugugauucacuaaggaaauaggaauuguagcaggaagcgugucauucucuuguugauccugaggagauggaagcaguauuugaggucugguacuguagagaguucuuagaagaaaacugugucuuaucgggguacuugucaauuuaauaguaaauaauacaacaauuuaaccgaaauggaaagcauuuaccacggccggggauguugcucgccauguagggcagccuuagauuccggcuccagcaccacgccuguaaucccugcaauugggagauggaggcaggagguccagaacagaaagagagggagggagagaaugaaugucucucuguguguuuccucuuuauacucuuaagugaaggcaggaggaagcaguggagagaguucuggugggaaaggacucacugauucaucagguccacugauggaggaagucagcgugcucccuaugugaggauggauggacacaggguaguagaaggagguucuuuggguagaggucacugccucucauuguaacagucuucagauggcaagauggcaugcugucuuagccuucuaaacugucaggucccugagguuagaggauugugaguggcuccaggugauuagcuucuuggagcccaugaaguucuggggaaggagagcucuuguccugucgcaucuacagcacgaacaucuggcugauaagugauaccgaaggaauaggaggaguuuuguguuuccugaugcuggucuuuccccuccugcuuccaaauuugucugccuccuuguccugacauuugggauacuguccagaagugggauuuagcuagcuuuuaaaagacagagagggacuugccauuuuaacaguuucucuuggcacuaauggugcaucucugggcuugggggaagagauauaaccuccacaucugugcagaaaaaggggaucugggaagagccuccguccugggcucgacaucuaagagugcuugcucuuaacucacagguaauugaaaaaauguuagccucuaugccuccauuuugacagagagauugacuuuuuuuuuuuuuuuuuuaaguuuuucgagauaggguuucucuguguagcccuggcuguccuggaacucacucuguagaccaggcuggccuugaacucagaaauccgccugccucugccucccaagugcugggauuaaaggcgugugccaccacugcccagcuagagauugacauuugagaggguagcacaacuaccaguucacugguaacuggagaggcgugguguuccucacaguggugucuucccggggacaggagucugcuuuguuauguuguacaggguuacaauucuccgaugcacuugacuuuuucuagguuuggugugacuaaaaggugauccuggucugccugugauuucuguuccugucggccuuucaguguucacuuggaauggaagccacucuuuuuuuuuuuuuuccagugaaugguagcauuggugcaacuuugaaacuaauacuguucccauguccauguccacggguugucuaauaaccugugauuugaugugauuuaacccaguucuaauucuuccccucacgguagaggagucugagaggaagucauuuggaagcugagggagucuugauuugggugacguaggcccaggcugcacaacccaagccugugcacacaguguagcagcacgcugcugugucugugguagcagagggagaacauuuuauuccaagcucuugaucucauuggagaaaaggccgggcuuagguugcuaacacugcacccugaucuuugcccuccuggaguucucagaagcuaggacaggaacuuuguugaacacuuaccuccagauccacagccacagucuacaccacagccugucagccgaaguguguuagagagauuaacuuuuaagaaaugguaaaaaugaaauuggaauugaaaguaaugccuuacagggcuggugagauggcucagugguuaagagcgccgacugcucuuccaaaggucccgaguucaaaucuuagcaaccacaugguggcucacaaccaucuguaacgaaaucugaugcccucuucuggaguaucugaggacagcuacaguguacuuacauuaaauaaauaaauaaauaaauaaauaaauaaaagaaaguaaugccuucugaaacacuuuugugccuggggugagucuuuaagucaaguuccugucugaguucugccuugugugauuugaggcagggucuccuuauucaaccccugcuggcucggcaucuuacaugccuaccucugugucuuacaugcugggguuacaguuacguguuacaacaucuggcucucuuuguagguucuugaguauaaauguaaaauauugguauuucuagcuagaagcuuauauuuaguauucaugaaaccacuucuugcaugggugaauguuuuugaucugaggauuuuaaauagcugccuagacaccuuguuguugggaaaguccaaagcaaucuuuaauuuuuaacuccuuugaaauuucagaauguguucauuuguuugcucuaauguuauuuuguauuuuuuccccagaaauccugccagaaaccaguagacaaauacaucgaauacgacccuguuauuaucuugauuaaugccauuuuaugcaaaacucaggccuacaggcauauucuuuucaacacuaaaauaaauguaaguuaugguauuuuaaauguuuaaaacuaugugugaguguguugaaggaggaagguguguucccuguugcaggugcuugugacagcuggagcuagucacaggcagcugugugccuccucucauggguucugggggcacagcuccugucuucuguaaaaagcaauauguccucauaacugccaagccuucuuuccaaccuuggcuuuaaauuuccuuaauguuaccugaugcuuuuacauuuaacagaaauaauaguuucaaacaguuagagaauauauaacaauucugagaacuuuuuuuccucucucaugucugcaaguuuucuagaagaaauggauacaaacguaaaagaaugugcagugcuuaguuucaggguggagucacagagagaagccugcagcauagucuggcugccucuaguggaucaccuuuuuuuuuuuuuuuuuuuuaauauuuuauuuauuuuuagagucugggggucuugucacacuaguugacuuugagcuuggcuuuggcuuguagcugaugguuucucaauucuuuuuuuuuuuuuuuuaagauuuauuuauuuauuuauuuuaugugugugcacuguagcugucuucagacacuccagaagagggcaucagauuuuuguuauggaugguugugagccaccaugugguugcugggauuugaacucaggaucuuuggaagagcaguccgcgcucuuaaccacugagccaucucaccagccccggaucacaucuuaaacuggugacuuugagcagaagaaagcuaaccguagcuagcuagcuagauguguaguggcuuaccucacugcucugaccuacugccugagaagcagcagcuuugguguggcucacaguuugaguccauugcaaugggagagccaugcucaugagagggcgagacugcuuaagggagaagugccaggacuucgcucgcuaacuuuguuucuccuccuuucccaaccagagacccccagcaaaggaacagcacugcccacauccacccuucccuccuaggccaguccuguuugcaaacaccccuaagacaaauguggauguguacguuaucagugcaauagguaguuuuauuauuuuguuuuguuuuguuuuuccaacagcuaguauuuuauucagauaagcagucucauuacaagugguccaaaaacagucaaauaagaacucaaauaaaaucagauguuaaagauugaucuuaagacgccagagccaacgaacagugccauguuggccuaugagcucuccgacaugaaaggacguucacaccucuggccaccaaaccauucagcauagcuucccuaacuaagcuuuuugaagcuaccagcuuuaauacuuugaauuauuuuuccacccugaauagcuauaaggaguugggagaaccagcucaaaauguggccagucaaggauccagguaaauaauggcaucagucaccaguguugaggccuccaucaugucugagauggaaggccugucucuccaaaccacuugggcagaaugucacccuagguguuaauuaauuugacaaucagaauccaacacagaauaggaaacaguuguacccagaucuaggagcaaaccuuaagagaagacugcucuccgcuguuaagagaaugcaggaaaugaguaacaagucagaaagguacuaacauuuaagguuggauuuuucaaauuugcacuuuucauacugaaccuuaaauggcuuaauaguuuggguugaauugacaggugaaugcaagauaucacauguuaaauuugaaacuuggacaagcagugaaauuugucuagcauucagucuguccuaauuacugcaugggauauacuuaaaacaaauuauuuguugugaaucuaaaacucaaaauuuaacuggguauauucuuuuauuugcuuaauuuggccuccuuaauuugucagaacucgacagugcaguggucugccccucaauuaaggccauuuaagugaccagcguguugauuuucaagcuugcuuacauacugaaaauuuccuggguggggugaggaaggccuccccagaucucaguaucucugugagggacauuggagaacaccuaacccuucccagauauuuccagagugcagccagaggaccugugugccugccagcugaggagccucagaacuugagaccgggucaggucgggugggguucacaaacaucccaaacauacauccccacuguugguacugagauagcucaguuugcaggaaaggugguccagauggggaaacugguaaauaagacauuuaagaucuuaagagcuucugauuauuuucacuguuaauuguuuguuuguuuguuuuuucuuucagcccagaggcugcuucuuuuuuuuuaauuccuguucagauuaauaguucauguggugugcuaaaaucuuuagauuagcuagguguggugguacauaccuuuaauuccaacacuuuaagagggaggccaaccuggucuacaaaaugaguuaguucggagacagucaggguuacacagggaaaaccaaaugcacacaaugaaacaguguucugaaacaguucugacuauuuccaccuguauaagucacaugaaugugacugucuggcuguguuuggggggggggggugaaaauauuccugguguggguggauguguguguacacgcuagggucuauucacugcugguugagaacuuguaacuuagaugaagaauguaguuaauaacauuggaaauccacaugggucauucucagcacaaccacugagugucauguggugcacaauuaaaguacuuggaaggcugaggcaggaggccugucuggaguuccagaccagccucguacccuacaccugcuuugcugcgguagguaugccucuuggcaugcccucggcucacggcuucuuuaccugacccagugacacugucuuugacugucagauccaugggaaacucugcauguuuuguuugcuuugugaagcauaccugcggugguggcagcugcaggacucgagccagaguccagcccccgaugacgugauccgguacgccaaggagugggacuucuacaggauguuugugaucgcuucuuucgguaagcagaugcugagcaguccguguuuagcuaaccaucgggucacuguucuaaucaaagcuaagaccuggugagacaacuaguaaugcaggaguaaacaccauaucucagcucagccacuaaccugccgugcgaguuugucugaauggccugauagguuauuucccugccugugaaaugagccaauucgaaccagauuagauuaugugaaagguagguuuauugggaaguugcucuccagugaguucaccggcuccaaaggauugaggccaggggagucaccauggauugggggucugaugguggagggagaggggaagaggaagagagaaagggggcuagggcacagagggaaagagaggagagcaauccaaaugcccagauuacacagggagcuguaaaguucaagguugcggcaggguaugccagguaggaauugagggauugcugggaggagcuggccaggucugccuugauaaguaagauccacaccucagucccuuguccuggguaugagacuuaccaucaccuugcuuugucuuguguaugauagagagguaguaaugguacacuugugggacuaggacacuuuguaaaguacuuacuguccaucaguccucucauugggaauguuaguggucgccugguguucccagugcauugggcugacuguguggugucugacguaagucugcugcuuguggaacugcagagagagacaggcugcuccccagauuuaccugugauuggaagcaccauucauugaaauuacaacccacagcuuucucucuaggguccgaauugcacugaauuaauuuauguggcaacuuuguuucuaauuuccaaccuuuucugcuucagaagcguuugccuuaagccaggcuguggcacacaccugcacucucagcugcucuggaggcugaagcaggauuguuggaauccaacaagcuaugaggccagucuuagcaaagcagugagacuccaccucaaaaacaaauugaaaucagcccuucuguuaauuacacagcacugcuccaggaauucuccuagugggaugccuuccacacuauucuggaucacagccucuuuuguccccuaucugccaccaucccuccccucccuagcaucauccuacuucucagaacuccaaaguauccaugucugacuuaguccuuucuccugaccucugggcccuuugucuaccugcuguuuaccagucccucugcacacagcucccacugcaggcacucagaucaaaggccuggguguccugcuaaagccuucuuggagcccucaguucaguuguucauucacugugcaguggugcugucuuacugagcacuccucaguguucgugggaugggcccuggagaugcaucaaugagaagagcccugauguucucucccucugagccuaggaugcaggggcugugaccuguucacuggagcuuaggacacaucaguccgaaaugcacaggauuuguuaccauauacgucuugcagauacuaauacugagaaaauacuugaggggacuggagaaguagcucaguggucaggaccugaauuugguucccagaacccacaccgcguaucucacggcuaccuguuacuccgccucuagggaucagaugcccuccccuggccuccacagacacuggcucucauauacccacacacagacaggcacagauaacuaaaauuaaaauaaacauuaaaaaaaauacucagcuggcguaagcauuuaaucccagcacuugggaggcagaggcaaguagaucucugaguucgaggccagccuggucuacauagugaguuccaggacagccagggcuauacagagaaacccugucucaaaaaaaaacuuaaaaaacaaacaaacaaacaaaaccccucaagcauaucacugaacccaagagcuaaaacauaguuucaggcuuuaaagcagauuguucucaggaucgguggcucacaucuguaaucucagauaugaucccagaacuuuaagguacaguaaagucagaaauuugagagcaaccugggcauuguagcaaggcaccagcccccaccccugcccaaaaagaaaaaagaaaaaaaaaccucuaaaaccuauugaaaaauauuuuuuaaagccaugccagcgggguuugaccugaagccugugggugugcguguacuugguugugagaaagaaugguauuuuauucaugaguuucuuaggacagcagcugcguucugugcuggagcugggagucuuagguuuccggguuuagacugggugagacgucuguguuucuccuuugcuccauagaacaagcugccuuucuuacuggcauauuugcuuuccuguggguacagcaacccaugacagcaaaaagagcacccgacuuuguucugcugcugaaagcacuguugcuguccagcuacgggaagcuccugcuaaucccggccgucaucugggaacaugacuacacaccucugugucucaggcucauuaaaguguuuguccugaccucaaauuuccaggcagucagaggugagugugugcuuucuuauuugacaugucagccuccagccuugacaugauggccccagggcaucagacuuggugacugugaccccuccacagaccaugcauguugguccugcauaugucaguggcacccuacauacagaacauaguucggccauauggugcugugaguuuucagagcucaugcauccgcagcaucucuccuguaggaggggcagcaccuuuuguugccagugcuuuaugaauggccgugaggaacaagugcuuguccagcguuacaggacuggacaguugucugggcaggagagaacgccgggugccugccucccagaguaaaacagugucugccugccagaugagucuuggguuuucggcacuaugaagcacuaugaaaagcacugcugugagugaagcugcagccuggccuuuuuccuguugggcucuuccugacugugaugcuagucuccuuaagccuucagguuggauggcuggauggugguguuguucugagacagccucccuguauagccaaggcugcccuuaaacucauggcaguccuccugugugaagcuuccaagagcugggguuauaggcaggugccaccacacccaguuuuauuuucucuauuucaugggcuucugccucuuugcuugaaaagagcuugaugcuuugguuaggacaguguagacucuuaagagcaggguggguuuccucugguuaguucucaccaccacgcagcucacaggccugccacgucaugagaguugcugcuuuguuuucuagugacccugaacacaaaccggaggcucucccuguuggucgugcuaaguggcuuacugcuggagagcauuguggucuucuucuuccagaggauggagugggaugugagcagugacugugcgcucuacaagucucaggacuucugaagguacuggaaucgugucauccgcccaucccacauaaggcaccaacaacagacaaggggaugaucccacacaugacuaguuucgugguugggaggacugucauagcauggcaccuuucugggcagcugccccaccaaggaaagucuccucggcaucuguuaacugccuauguauccugggagcgauaggccuugcgaccucuuccccauacugaauguuagcaggccugucuccacacggcuaaucacagcugcugagaguugaggacaguggccucgucauucugggggucaucguuccgggggcauccugucacgcugugugacugggugggcgcuguccgugccucuccccucgcagcccucuccaggaggacggggugcugggcucccuguuucuucacuugccuccauugcugcuccccaccgguccucacugucuaacccucuguggcccuugcuuggcuacaggaucugacuauguccauccauccauggcugcuguuugcucucauucacccuuaccucuugucacucagucucuuccccccagacucccucugcuucucaaccccacagacgcugaaggaagcugcggguggcucugucaggccucuaacaugcuuccugccuuccaccugcugugucuacacaagguucaagauucuugacuaggagcucucugcuggucgugucaucucggcaggacucaguggccucugagaacacuucugucugaggagggugcuucuccucagccacacugccucccugugcccagcgcucagugcuacagcuuccuucuguuuguucuucaucugucauucaugguguuccuuccuucucugcuguguggagcucccuccugugccucccugucuggccuaugggcuccuuccuccaccugaggaagcaggauccuagggugaagaaaugcaggaggacccacagcaggagagggagccauacucaggcucaugucgucuucaguaugucaccuuggguguggagcgcuccacuccucacaugcccugugguguagcccuguuugcugcugugcugugagccagcccagcuuccuuccuccugggccuuuggggguguggcugcuggagcuggccucccuccucaguguacguguauggcuccucauucugggcguuccgucugagcugcugcgucccugacuuccccuuuguggacccccuuuccaugcccuggguccacagugcgaaacuucacagagcugcugcagcucugucaaaauguucccguuggugcuggaauucuagccccacccccuuccuuccuucacgugaaagggugggugggccuguucuucccagaucccucuccuggccagugcugcguccuguccccugccugauacuugguguaugcaagaguauugcccuccguccgauaugcccacacuccagcugcuacugguucccuccuauagaaagcugccacguucacuccugagaaggacaucucuccacacuccacccuggugcuucuacccaguuggcaccucaauagcagcugccuuccaaauuccuaccgcaggccacccaggucuguguucccucuggugcgucuguaugucuggcugucugcuguaauucauaggaaaaucaacucaccagucuucagaacccacuacagagccaguggccuacugugugaucuugugcuuuguucugucuucuuaaaauuacacugaggagagacccugccucccgcuccccuguguccuccguggcucccagccagccuuggaagcagggcuucuguggugaucagaacaggccccacaaaguagucuugcucugcugucuacagcuuuauucuucacucucuggcaggaccagcuaccucaaaagagaaggcacaaaagaacccaaggucucugcuuucugugagugaagccaagacuggggauuucugaacguacccagacaccccagaagaucugaaccaccuauaccaaggcugaacgcucucaggcagcacugugguucccuuauaggaaugauagcucugagcuccauccuuccugcucuuuaguguaauauuuuauuacacugguggcuuuaacccuguauuuugugucuuucugacagaagcacuuugaaguuaucuuucagaauaaaucaagcuuuuuauacauuuccaguucaguaacuaagguugucuuuugaauuaccucagccagaaauagccaagauaaucauuguaguucucucuguaaugguaugauaaagacucuacaacuaggguacuuuauaaaagaaaguguuucguucagcuuaugguuucagaggguuagagcgcuuggcagccuauagagaguucacaucuugauccacaagcaggaggcacagugagcacugggaaccacaggaguguuugaaccucaaagcccaccccagugccacaccucaaggucacuccuuguaauccuucccaaacaguuccaccagcugggaaccagcaguucaaauagaugggccuaauacaugguggcucgcucuuuuuaagcacucugugaguucaaggccagccuagucugcaaagcuaggacagccagggcuacacagagaaacccugucuuguaaaacuuauauacauguauuucuaugggacccacucucauuuaagccaugaaaaucauaaaaucccugaaugccacagccuagagaugaauuauaucccaguugagcugcuagagauggauacagcaguaacaucggccuaaccccugugcccauuuuagauacgguuucacugucucaucca

SEQ ID NO: 4892 - RNA, 2140 nt, Mus musculus
aacagugguuggccccuccagcuaccagugagccgagaggcuuuccccacgcagacccagaggcugguccaugcauccaauaaaagucccuacaguuccuagaauuuuaacuaaaagucucugaacgaucaguaacguuggcaaguccuagugaaaaugcacagugcacaccuguccugucgcuguaauacgguuguuacugccauuucacucugacccuuaguauguuugguuugaauuuguuggcugguuuuguguguguacacguguuugcaguccuggguugagcacaaggacuugaauguaguuuauuaaaacagacauuuggugagauggcucaggggguaaagcccaugacacagagccugaccagccgcauucgcuccucaaggcccacguguuggaaggagagaaccagcuucugcagguuguccccggacacacacgcacacacacacacacaggcaugcacacagaguauuaauugagaacaaggaaaugcacaggcacaccagccaugguagaaagccugccucgugaccacacugauaaacgggcugaagccagguguuguauucccuguaauccuggcacccaggaggugaggcaggaggauggagaguuugaaaucacccuggccauauagaauggccuuuucaaaggagaaaccuucagugcugacagcugacugcccacucguguuuucaaugcccagagagcaugcugcuuuaagugcugcagacagcacgcucccagugagcagggacaggugcucuguguccuaguaucugagcccuuugggccaaacuggggagacaguauagugcgugggagccaagaaggauauuuguauauauuugcaaggucaaauugaucagaaagcuuaacaguaagauugaaaccacaaaauggcuaaugggaguguuuaggaucacacaggagaugugaugagacugaguccuccuccucuuccuccuccucuuccuccuccucuucuuccuccuccuccuccuccuccuccuccuccucugucugaugagcagccccuguguaucugagugccuaguggcaggucucuggagguccauauuucuuuguuaggaaagagacuaguuuaccacccuucagauacacuugcagggaagcgagaccagacguuuguuaaguagagcgcucggaugacuagaaccaggcuucagucugugucucugaaggaagcauugaugaagggaagagaacaucccagggaccccacagugguaacugucugacugcugcacggccacagaccucauuauaaagugagagaucuacuguaaagagaaacccuuccagcuuaaagccaaaauagcccuggcuucugcagcaucaccagagaaggugcgccaaagccagagccucaaguaugacacaggauccccuaccccaugucuuguuggguguggcucuugggaugagcuguccgagaaagcauggaagugccuaauagucugcaccaggggccugcagcuaggaggcuuagaaugugcucaguccugaacagggaaggcagacagagagccuggagguggguuugugugugccccaagcugcgcucccccuggaagugugucccuacacacuguuuuagggacagcugcuguguacacucccuggccuaucacuggccagcaucaccauagucuccaucuaaucaagugucccccuccccuccugugggaaccaccaguggcauuacccaccuagggcgucagugcucacugccaaagggaguagagcucucaccuguggguguagggcaagaagcucuaagcaccucaccacugagccgcauggccagcucugaggccagcagugugggguguacuccauucugaccaaaagguuuccacugccaccugcuuccugcacucugcaggagucacccaguggggacacaauuggcaggaaacagacaggcaccugcuccgcauuggagucaaagucagagcugccuugaguaucuuaaaacaagcaggauuccuuaucuuccccaccgaggcuguuuuccaaagucugguuucauucagucugcccagccuuuguccugacuuaugaacccacccacuuaaaaaaaacaaaaacugcacuaaaaagccau

SEQ ID NO: 4893 - RNA, 5931 nt, Mus musculus
cacggaagucagaggaggguccggcacggaccagacuugacgugugucgccggaccucagcggcugucaggagacaaccggcugccuaaagccguccccagcccgagcccagcguuccuaagccugugcccgcggggcagcgccgagccaccuucgguuaggcguucgaggcuagcccgcgcgcccugacagcagggccgggaggccucgcgagauccgugcgccgcacgagcccgaccggcgucuugggagcggccgaggugggaguagcgggauggacgaggaucugguggucgcguugcggcugcaggaggagugggacgugcagauggcgcggcgcgcggcggcggcgcgggagcccgugucguugguggacgcguccugggagcugguggaccccaccccagaccugcaggcgcucuuccugcaguuuaacgaucgcuucuucuggggucagcuggaggcgguggaggugaaguggagugugcgcaugacccugugagugcguccgcgaacggcucggaacgucgggaagggccaggccgcuaaauugucguugguguccccgccucgcggcgcagggagaggucgccgggaaacgugcccacuccccagucccgggcccaacgucccucagugaugaaccagccggaucccuuaucagaguuugagaaauccuauucgagauaguaaucugccccgcacauacacugucacauagcagcuugagguaaagcaggcuaagacguaguguacuucuaaccucauaccagcccugugacuguuuugggagaagugcccauguaugccugugcggaggggagagggugacagugggugaggguuagcaaguguuaacucucugaagccaagugacccacucaggaaagccauccucccaucagggacguuuucuugugaaacaguucuugcccaagaacuguuagggauuugcugcccacccccacccccuuuuuuguggggagaggggagagggccucacuauguaucuguggcuguccuggaacauacucuguagaccaggcuggccuggaacucggagauccuccugcaucugccuuccacgugcugggauuaaaggccugcaccaccaugccagacuaagguuugcuuuuuguucugucuccucuguauucguugacccuaauccauuguugugacuguuuuccaggugugcugggaucugcaccuaugaagggagaggaggcaugugcuccauccgucucagugagccccuguuaaaacugagaccaagaaaggaccuuguagagguauucuuugcauaagccugauucucaacaaguugauuugcaggauuuauuuauuuauuuauuuauuuuuaagagauggguucuuuguuuguuuguuuguuuguuuuucgagacaggguuucucuguguaguccuggcuguccuggaacucacucuguagacugggcuggccucgaacucagaaauccgccugccucugccucccaagugcugggauuaagggcgugugccaccaccacccggcuagagauggguucuugauagcagcccauacuggcuucaaccacaagauccucuugccucuacccaaggguuuacagcugugcaccaccauuccuggccagguuauuuuguugauuuuaagagacaagagucucuguuccuuagguuggcccuggucuuuaugcuucucuugcuucagcuuccccagugagcugucaugcccauacccagcuauuuuuagagggguugauggugagcugaucucaaacgccugagcuuucugccuccaucuugagauuugccaucacggguacgcaccaggcugucggcucuuucaguguuggcauuuccgguucggcaccuggagucuggauuguagaguuuucacuaucaggauuuuaaaguuuugugugguuggauucacugaccuuuuggguuuggguugguuaaguuaaaugggccuuugugaaaaauguuaauucugugaaggggauuguugacuggguucugcagagcuuggaauauuauauguaaagguuuguacuugggucugcagaaggauaggacugcagguuaagaaagagaauucaugccgggcgugguggcagaaaccuuuaaucccagcacuugggaggcagaggcaggcggauuucugaguucaaggccagccuggucuacagagugaguuccaggauagccagggcuacacagagaaacccugucucaaaagaccaaaaaaaaaaagaaagagaauuccuuuuaucuuuagacaugcccuagaaaauuaauacgcugguuuucuguuucagacucuuuugcaugaaaugauacaugccuacuuauuugucacuaauaaugauaaagaccgggaaggacacggcccagaguucuguaaacauaugcaucgaaucaaccaacugacaggagccaacauaacgguauacugagccacacagguguggggagcaagcaagaucaggguuuuacugucuagcccagucuggccucaaacucacaauucuaacucagcccaaguggugggauuauggguaugugcuaccaaacccaguagccauucaguaaaagugaacuagguagaaacggauauuuuuagccuugagcaaaagcccuaucaucuaggcucuagguggaguggcuaaggagccagcaagccucuuugcuggggcuuccauuaacugcaggucagcaucucaggcauacauuauccuccucugaccuucaggggcagcuccagcucauccuaaauucucccucaucgucccgacagugacaauguuggaggagauaucacagccagggcugaggugugcuguccccuacacuaggggucaugccuauauccagaacugucuguugcuaugcaaugauguaacagcaguuuugagcucuugaccguaaggauguacagugucucagcacccugagcacugacuaaauguuguuaauuauggggauuuucuuuguuuccuugggaaggauuuggcccuuuagcaguuuuuaucauuucuaggaacuuaagcaaauaugugugcuuucuaacauuucccuuuuuacuuaguuuuauuuucuaugugcauugaugcuuugcuugcaugugugucuaugggaguuacagacagcugugagcuguauugugggugcuggcaacugaaccagaguccucuggaagaguagccagagcucuuaaccgaugagccaucucuccagucccauggucuuucucccuguuggcaguuuauuaaggugcugugguaaaccucuucgggucuagcuuuuagugguggugguguucauucucugcaacguuuacuuucauggagguguuuucugguugugaguuuucccccaccaaaaucuuuuacauauauauauauauauauauauauauauauauauauauauauacauauacauauauauacacauacauacauacauacauauacauauauauauacauacauacauacauacauacacacacacauacaugcuucuaucuuuauacaguaggaaguuuuaaauugccugauguuucccauuauagugaacuucugaaaagaaacuaaauauaguagcuguccccaaauggaacuuuuuaggaaugucugagaaauggaauaucucaaaacagaaagacuccuuggguaaaauaccucauuagauucucuaccuuauccugacugcuggcuacuccucugcccaggucuaccacacuuuccaugaugagguggaugaguaucgccggcacugguggcgcugcaauggacccugccagcacagacagcccuacuacggcuaugugaagcgugccaccaacagggcccccucuguucaugacuacuggugggcugaccaccagaaaacuuguggaggcacuuacauaaaaaucaaggagccagagaacuauucgaagaaaggcagagggaagacaaaagcagacaagcagccagcaucggcaguggagaauaaaggugccuaccucuccaucucgucuuuuggggugugagccuggccgugugucugugucagcaaaccugggggaguuacugcaggggcugcucugcuccacugcggacguuuccagcaguaaggagcacauugcauccacaaggugaccguaaccaagugugcucugcuguguggaagggagagaaggugaagacaucuccauuggcuguaucugagggaguguccaaggcaaaugggugucuaagugagguaacagcaccggggugugacaggcuggugaccugcuaagguggcuugggaggaugggaaaggagugcagccuucauuugucccaugucauccuuaggaucugcucccuuccucagaagcuccuggggaggcagcaguuacuugaggugacacuuguccuugcaagguugucaguuggguagggucagccuugggagucaaacccuaguuccuaaugugaaaugcagagaaggcacaggggacuggagaauugguuggugcagaaggacugaaucuguaggaagccaggcguggagcaggcaggcgagaggaaucgguacuuuccugggaacaauccuugcucaguuuuggauucuuuuaucuaugauuucuuccauuccuccuguucuuucaguacagggcucugacuacugaaaguugccuucucuugucaauaggugacuacugcacagaucucaguuagaacagagcaauacuucauuuuugauaaccgccgugcucagugucuggguggcaauguguugaggaagucuugucugucuccuuugcagacaagcugugcagaggggaggcccagcugcucaucccauucaguggaaaaggcuauguucuuggagacgcaagcacuugcccuucagcugggaagcugaacaccucauacaugguuaaugaagccaaaggucucucaagucaagaccauucagugaguggccugaggcucaauuccaaugcugaggugaaaugugaacagaacugucucccaaagaaaccucaucuugucagcccucuucccacugcuagucaccaaaguguccugagcuccuacuuccccagagucucuguugccaaccaaaaggcuuuccgaaaugugaauggauccccaguaaagaacgggaccacuggggauggcaccaagcguccugccucaggaggcucucagaggaaggucccaccuuccagggcaucccugagaaauaccuccaaagucacagcaccagcgucagcaaccgugacaucugcagcugggacauccgcaaccauaucccgagaggagagugggucugaagaccaauuccugaacaagcgacccagguuggaggacaggacugcuuuggauacuaucaaggaacaaacacaaagugguggugaccuucggaguagcucacagcccacagccgccagcgcuccucagagcuugagcagucaacggcggcuggucaacuguccagugugucagggcguggugguggagucacagauuaacgagcacuuggaccgaugccuggaagguaacaaaaccaaccugcgaccucgaagagugugagguggagugggucccacgcugcccguuggcucaugguggugucaccuggcagguggcaggugagagaccuguaucuuacagucugacugacugcgccagcgcuuuauagacacccagugagcaacuguaguuuaagucugcaacuccauagggggggagugugccuguaauaccagaugcucaggaagcugaggcaggagcaucacuccagcccacgacccugaggaauguagggagccucugucucaggagcuuccgugucagugugcuguguccauccacgccuuaccaggacauggcucccuuugucccgugaccgcguauggcuuuauguacuuuugggucguuuug

SEQ ID NO: 4894 - RNA, 40861 nt, Mus musculus
ggagccgcgaggaggaggggagggcggaggaagcggcgcgcccgcccgcuaggcccggcccgccgcgugcgcgcggcccccgcccucuccgcccgcgcgccgggucgccggggccgugguguacgugcagcgcgcgcggagcgaguggcgcccgcaggcccgcgcccugcccgcccgccccgacgcagccggcugggcccgcccgcccagggcgcugugcgccgcgcaggccgcgcucucuccggcgcgaugcggcgcuaggcggccccgggcaaggcaggcgaggccagggcgcgcgcggccucccgcagcgggcggcggccccgggcgggcgccccgacggccccgccgccgccccgcucccggcccgcggcccgcccugccgcggccauggccagugacagcggcgggcccggcgugcugagcgccagcgagcgcgaccggcaguacugcgagcugugcgggaagauggagaaccugcugcgcugcggccgcugccgcagcuccuucuacugcugcaaagagcaccagcgccaggacuggaagaagcacaagcuggugugccagggcggcgaggccccccgcgcgcagcccgcgccggcgcagccccgcgucgcgcccccgcccgguggggcccccggagccgcgcgcgccggcggggcggcccggcgcggggacagcgcggcggccucgcgcguaccgggcccggaggacgcggcgcaggcccggagcggccccggcccagcagagcccggcuccgaggauccuccgcuuagccggucuccgggccccgagcgcgccagccugugcccagcggguggcggccccggggaggcgcugagucccgguggagggcugcggcccaacgggcagaccaagccguugcccgcguugaagcuggcucuggaguacaucgugccgugcaugaacaagcacggcaucugcgugguggacgacuuccugggcagggagaccgggcagcagaucggcgaugaggugcgcgcccugcacgacaccggcaaguucacggacgggcagcuggucagccagaagagugacucuuccaaggacauccggggggaccagaucaccuggaucgagggcaaagagcccggcugcgaaaccaucggccugcucaugagcagcauggacgaccugauccgccacugcagcgggaagcugggcaacuacaggauaaacggccgaacgaaaguaaguggcuggggcucuugcgaccggaggagggucugugaggaccaccccccgcccccgcagacccggggcccggcgcucugucuuagcguggcuccuuuuguccuuguacugucugccacagugcacagugcagagccugccggagcccuggucacucgugggggucguugggguaccagcuacaccgggucugggugaugcaucuuaucuugccugugugccugagcuaguuaaaagccccgcgguuuuuagcgcgcacccggcucugauugagagccagacacuguguuuagcuaggacucugucagcugcccccagaaagguucauuuaaaagccuguggucggaaaacucccuguauucaggaaaagcuuggcggccugcuccccucccccguguagcuuuaucuugcuggcugucccuaccguuuugaaacccacuaccaaaccaggaaagcgguguuuccguucccagggcucauaguaggucgguugcacucggagcacagguuuucucuauucgcuuuguuaaugagacucuccuguugaaaaagggcugcuucuguggcuuccugguuuguuuguuuguuuguuuauuuauuuauuuauuuauuuauuuauuuauuuauuuugaaaacaaaaccaacacggaauuggaggucggagggcuccuuuuaaccuuggguuuggugggauuuucuucuucuuucucuuacuguggcaguuccuuccagucugcugcucccucccuccuguggcagacagugacucucuccacucucuucccagauguaaaucuguucuuuguauucucaccuccccggggcacccugauccacccuccgucuacagucaguccgaguuuuuggggagguuuuaggaaacccggacacacaaguuuguacacacaagcucuucccgguaauuauugguuguguggguuuugaacuacguugacagccguagggcacugucagacugagcauguuuacgaggaaaaaaacaacgaaugcaaugggaagccuaauuuacugcaaacucaguacuggaugggggcaccugucuuaagaucaagugaccuccagaaaaaguugcuuaaaaugaagccucggguggagauguagcacagguggucgugugcuugccuggcauggagagaaacccgaguuuggucgccagcagugugccaggacgccugugaucccguuucucuggagaacuaucaggugggggcuuaaggucacauucugccacaucuccaguugaagggugguuuggucuacaugagguccugucuccaaaaguacaguaaaccugggaaggggauagaagucugacuggaccccaguuugggcuuucuaugcaguuuucauaggcaacagacagcuuggcucugagggcaguguggcucuccuggggaauccguugggaaacagaugcccucuuuccucacagguugagguagcugaaagaacaguccugauuuaaguugcuugccuggaggucuaggggaccagcccagcggcagggaccugcuucgaaucggagcucacacuuucauucauucggggucuguggggacagucuuaaugacuuccuuucacugacccucacaucuuaaaaauuacauuuauuacugagugugugugugugugugugugcgcgcgcgugcgggaguguguccacgcggagguuggaggacagcuuuccagaauugauucuccuguggagugagugugugugugugugugugugugugugugcaugcaugcgugugcgugagugcagacaugcguccacgcggagguuggaggacagcuuuccagaauugauucuccuguggagugagugugugugugugugugugugugcaugcgugugcgugcgugugcgugcaugcgggcaugcguccacgcggagguuggaggacagcuuuccagaauugauucuccuguggagugagugugugugugugugugugugugugcaugcgugugcaugcgugugcgugagugcggacaugcguccacgcggagguuggaggacagcuuuucagaauugauucuccuguggagugaguggguccuggggauagaaccuaagacuuggcacacauaccuuuaccuccugagucaccacaccagccccucguugaacuuuuuaacuaaaaagauuagguaaccauguuugaacauguaaauuuuaauuacuuauuaaaaagaagaaaaagaaauacugcuuuugagcacuaagacaccagucacacacuccuuccaaauacugaggaagcaggcugcuucaggcuucccaguagacuccacacagccaguggcaucgugacagggacuucucugacuuacacuuggggguaaaagucaggauauaagaggccagggcccaccauuuaggcaccugggucagguucaagccagauuugaagccucuguuugccugcauuucuaaggggauuuuuuuuuuuuuuuuuuuuuuugagcccgggucucacuagguagcucuggguguguccuggaacucacuauuuagaccaggcuagccuugaauucauagcccugccucugccucccaagggcuggguuuaaaggcacguggcacuuucuaguuuugauaguuaucucuguugauggugaggggacaugacauuggcgcucugggucuggcucugcaaacguuuuugacgguacaaucuuuacuucacauacucaaaagcagcuguguguuuagucacuaagcugugcuguuuuaagucugucucucuaagggguuccccaaaggaggccauuaugguugguugucuuggggaguguuaucucucguccuugucuuguuagagcuguuuccuaccaguguguauugcucacuucagcuacuggagcgguagccguugucagugccugguucccgccucagaguuagaagagcuugaggggaccaccucucucacucgaaguucuguaagacaccaggaguaccuuuuauuuauuuauuuauuuuaaauugugugcacagguguuuugucugcaugucugucugucugugccccacacauguacaguacccaaugcaggccagacgaggacauggaucccucuggacuggaauuauagauacucgcuagcuguggugguguuggggcugggaauugaaccgagguccucuagaagugcucuuaaccacugagccauugcuucaacccccaaauacggggauuuaagucgggucuuccagccaaguuccgaguuuucugucacaucuucuauguauacaugaggacauggucaucaaguugugagacuucacagguugcccuuccccagugucugccucagacucuggcaacugcuuguccucccucuuaaaaagaggacccccccccccccccaccaagggaaggugaaguaacacgggagaagaccagaaacgugauuguuguggcugcuguacccaccuccacucucuacccucucagggauccucucacccuuuucuugcccuuaagcugcccuuugaccucuuagccuuucucacauccuuccuuccaucugguuggcucacggugacaucaguggcagggagccacagucuucccuuguacagagcaaugucugagcacugucagagggcacaggcucuguagcuggguagagagaagggaugcugagggacggaacccccgggggagcaccgugcuugggcuugucugcugcucgucauuaagauuacugcaacaccagguguguggcgcaccagguguuuaaucccagaggcagagagaggcacagacaucucugugagcucaaggccuugcaaaaaaaacaaaacaaaacaaaacaaaacaaaaaaaggaggcugaggcaggagaauaguguccgaggccagccuggguggcacagagauagauaccuguguccaaaaaaaccccauggcaaaccaguaaagagugaaauugccagaauuacaacauguauaauaauuuuuuuaaaggcucauguuuguauaaaggaaagauauuggggcuauagaugauugggggagcaccuacccgggagcacuuacuucgaagaaagagaaggagagagacagacucuguguguguguguguguguguguguguguguguguguguguguguaauaggaugagggcagcaagcaccuuaugcuacucagaguucucugugcugcgguuaauuaguccgcucuggaaggcuuuuggagcaaggaauaggaugagcacaaucccgcugcuuuguugcggcugccacagagagagguggcaauccucuuagaugacaaagcccuacauggagaggcagaugcaucccuggacugugccacccuuggguucagagaaaagccucuagacccaaagaaaaguaaaucuguuugugggccuggaaagaacagaaccagacagggcuuccuucgcccacaccucugcccuccucucauuccuccgggaauucccaacacugcgaccccuuuaaugcagucccccaugugguggucaucuccaacucauucuguugguacuccauaacuaauuucgcuauuguuaggagucauaauguagauaucggaugugcgacaccccaacgaggucgaaauccacagauggagaaccacugucccagcaccuuggccauagaaauaagagcagcuggccggugcaguaucagauggaagcgugaagucaguuguccggugugcagaaaggcugaaaaguuaggggccagcugaucccugccagcugaauagaagauggucguaaagaaguugagagguuaccguggggauggauaugaugguucacaccuuuaaacccagcauuuaggaggcagcgguggguggaucucugaguuugaagccagccuggucuguauagggaguuccaggccagccaggaccauaaagugagacccugccucacagaaacaccucuagggggacugaggagggaagaugggcguucuaacaggguagugggugugugucucuguuagaucuugguuuugaugugguccugcuucuggggcucuaccacugugguugugucuuuggguuaauggcuuagugucuuugagccucggguugguauucacagcacugucugucugccccuugcgcuugccuuggggagucuguggcuugcaccacaagcagugcacuuugacugccgaacuguuacuaaguauuacuccugccauguuaaaaaaauaauaaucaauuuuaugauucuuuucuuaguuuauuugagagagagucucaauguggagccccagcuggguuggaacuugcuuguagagcaggcuagacucacacuuagagaucuagccacgauccucucuuuaagagaucacuguuuucccugucuguccaccucuugugaguuggaggaaaaaaaaaaggcuuagguggguuuugacccaaccaccacuauccuggcacaugugugugcauacacacacaacacacacaagcaugcauacauaugcuugcacauacaugaacacguauuugagcauguacagguaugcacacacacuuuuaauuuuuuuccucccaaagagaaagugaguucuggagagggcuaaguaagugacuuuuucaaggagggacuuuggagcuguuagugacacagcaguggguguacccccucuucugucugcagugcgcccuuuccuacagaacugacuuggcccaucuuugccguuucuggucauaugugacucuccuugccaaagcuucguccagccaggcugacacuuuagcuugacaauuucccacagugucuguugcuguuggagcugccucaccugaagcagggccuccuggucuugcucuguaaugaaagcugucuucucucccccuuccuccugcaggcauugaauccuuggguuuuuuguuuuuuuuuuuaaagauuuauuuauuauauauguaaguacaguguagcuguuucuagacacucagaagagggcgucagaucucauuacagaugguugugagccaccaugugguugcuggggaauugaacucaggacuucuggaagagcagucggugcucuuaaccacugagccaucucuccagcccuacguccuugguuuugaagcccauacauucugguaucuugggguugauguuaucagcuugguuguuuaauuucucaccauucacucuaacagauucuuagacacuuuucuggugcaggggacugaacuuccuugugaaugcccagagagcucucuuacgcugagaugggguuucacguagcccagaccggccucagacuuguuaagcagccugagcuggccuugaacucccgauccuucuuccuccaccucuggagugcugggauuacaggcauccaccaccaugcuccuagacaguuuucauagcugcuuuguacggcugcuugucccugucgucuuuccugcagggugcccuguuccacacuuggugucaucggcagcugcuugggaugcucuugucauucacuguguuguccuccuguugcccuuggcucugcuuccagccacccagaucuuguugugagguaaacccaccagagaccaccgcacagacacauuaaagccgagaggaaaaucucgagccuuccagcucuuugucuuuccugguucacacacaucaguuagcacgaaguggguggagccacagaagccucuaacauggcggggaccuguugcauucuaaaacaaaaccaucacacaugugucaccagauucucuuccucccgguuuauuucauuucacauucccgagcucaaacuugaugucuuuugggguuauacacagcugagggauguccugggcuagggucuuguugccacaugcugugccugcagaaggaccuacaccugucccccacaucccuucuggcagguucugcuauugccaggcagggaugggguuccuggaugcaaagggggcaagucaaaaagacacagagaagcuucccagggccuaagcaccccgucuuuccaacuaaucuuggggaguauccccuccccugcacccuguuguuguuauaauugguuuaugcuguaucaguuaaugauagcuuacccuuaagugugugcccgugaugaugcuuggucugcaguucaucucagucuuccaugucucuuucuguuuagagagagggccucgagcaguaguagaucuccugccucagccuuuggagugcuggggauuacaggugugcaccacuguuauuguuccuggggguuacaggugugcaccacuguuauuguuccuggggguuacaggugugcaccacuguuauuguuccuggggguuacaggugugcaccacuguuauuguuccuagagauuacaugugugcaccacuguuccuguuccuggggguuacaggagugcaccacuauuucuguuuucucuggucugugcuuggccagggugaccacagguguuagcaaacauagggucugggguuugcuguuuucagacucuuguucugucuuugauugccaggguuuuagacauguucuguauagcaggggaugugucaccuuccugcuaggugcaucaguguaccuguaguagaugugaccaggacaguagagcgcaaguaccuggcuucuuuguauauaccugcagcagccacaacaggauguacagacuccuacaucagucucccacccuagcaacugacucuacagggaugagacacagcccccccccccccauuuuuagaaggcuugacaaacacagcgugguucauuuugaguuccccuguguuagaagaagugagggcuaguagggcaggacaggagucaguggauggaggaacagguuuaaacuggauucugugugugaccuguuucuauaguaucuaucuacauacacuaugaaucugccuuuugugggccccagaugccaggucaaucucuguccucucagcucagcuguuggagggaaagcuccuagcuggguuggacggauugcuguuuugggggcgcucagaagcugaacccugguaguccauaggcuaggaaagcuuaccagagaaacugucauuuuggagaaagcaucgaguuuggggauuucagaagccuccccuccccucugucagugguccgaauaucuccuagaguugugccucacucgagagcaaaaccuccugguccaugaucucagaaacugagguagcagcaugacaguaaacccugcacuuaggggggaggaggcaggaggaucaggaauucaaggcuauccucagccacccagugaguucagcgcuagccugggcuacuucauucccaguucuauuccuguucaaacccagcuucaucucuacccugaaggauuucagagaccucucccuuuccuauagcucuccuuucuagucuuuugucccuuuggaaaagaacauuuuacucccugccacacacuuucuguguggccuccuuugucccuucccucuguggcucccuccacucuugccaccuggaggugguucaguguccugcuguggccuugacagcuccuauccccagugacacaauucucacagugggaagccuugugguccuagcaccuugucuuaucaaaagaguguuccagcugcuuguaacucagacucagugagcguuagaucugagauucuuccuggcccccccccgguugagauuuuuaaucauuuuauaugcagcccgucuuacguacaucuguguuacuguuuuuuugguuuuguuuuguuugacgauuucuuugcuaugcacaaccuaucauaaguguugacccaacacugaagacugcggagacagcacaaugguuaaacugcucagccugcagguaaagggaaccuauguaaccaccauaaagcagguagcuggccugugauuccggccucgggcacugaugagaucaagaaaguaagcuggccagagagaccagaguuucccgugagcucuugguuugauucggagaugccacaaggugggagggcuguggggaagauuccuaacauccaccucagaccuguacacacacgugugccauaugugaugacaaaauacauacgugcacucugccacagauggguacgugaaaaggaaggucauugccaacacucacaaaacuuuacuuaaaagccucgggcacguguguggauuucaagucugagaacuacacaguggggggcauggccucucaucguguuggaaguaaguuuaucuuuuaauguugggcuacgcucaccacuguccuggggcaggugugacugugggccacagauuggacaaguucagaaggauguggucugauuucuuugaauugauuauuggaggcugucuuagucaggguuucuauuccugcacaaaacauccugaccaagaagcaaguuggagaggaaaggauuuauucagcuuacacuuccacauugcuguucaucaucaaaggaagucaggacuggaacucaagcaggucaggaagcaggagcugaugcagaggccauggagggauguugcucacuggcuugcuuccccuggcuugcucagcuugcuuucuuauagaacccaggacuaccagcccagggauggcaccacccacaaaggguugggcccuccccccuugaucacuaauugagaaaaugccuugcagcuggaucucauggaggcauuuccucaagggaggcuccuuucugugugauaacuccagcuugugucaaguugacacacaaaaccagccaguacaggggcugugaaaacugagccuucuccauguuuugguccccagcacaccagugaaucaggucucugaugggccuccauccugauccugcgccagccauugagaccuuccaccuccuuuagugucugggcuaagucuccuucacagaagugugguucccuccaccucaaacgaauucagaucucuacugaucuuucugaaagaaaaacaaacaggaaaaaaaaaacaaaacaaaacaaaacaaccucuaauccagggcuggggcuaugauggcucagugggugagagcgcaaacgugaagagcauccccagcaugcucguuacaaaacuguauggccacacgugcucguaauccugaugcugagacaagacuuacuugggcuugcuggcuggcagccuagcucuugguucacugagagacccccaugucaaggcaguaagguaccagggguauagcagagucucacacaucuuccucuggccuuugcacaugcagauucagucauaugcacacuccagauggacacacacacacacacacuucaaguccacugugguggcacacaccuauaauccuagcaugugggagguggagacaggagggcagggguucaaugucauccucagcugcauagggaguucagggcuagccugggcuauaagagaccucacaagucuauaagcacaaaacaauugugauuacuguguggagcuccgcaagccuuugcuuucuguguuaggcacaugcugcuagcacccagugacuuaaccuucacuguccucuggccuagaugucaccuuccuuuuaccaccugcccaaacuguuaaucucuaggagcccuuuucacccccgagccuguggguguucuuuccaauuguggucaacuccccucucuguguacuauguuguuccugaccccuaauuuuccagauaaaaauagcccaggccagccuggucuuaaacuauuuuuaacuccaaguacugggagaaaggucugcuuugaaggugaaaugaagcucugugccagucccuaugacaggagccaggcaggguucuaauggccugccccuugcagagggguggccugugugcuugccuccucgggccccuauuccccuagugccugagacucugcagggcaugcuuguguccccaaagcucgcagcgcuuaagguaugauguuauguugaaaaugaccucagacauagguuacaaggugaccccccaagagagagguacaccaucagaguuaacuucaacacgugacaucacucugugguguugauauguuuuuaaaacugucacgcccagucgcuaagcaguagggcaagcugaagaguuuauuuaacggggcuggagcauuggguguucugaggaccugcgaucgauucucagcacagcacccaccuugugcagcucacagccaaugcaacuccagcucuggggaaccugaugucccucuggcgaccccguuaaaggguuuuuuaacaaaggacguggccuuaccuaggcaugaccaucucucucagggucagggagccugguuccgagcgcguguucuggauuccaguguuuaccucacuucugaagcagcuggcggggcugcguguggcaggaacccaacugggcauuuacuucauuuugacuuugauaaacuuuuuacccugaaacauuucaccuauuagugcugaggagaugcgguaaaucuccagccccaguuagccuguucaaggaaaaugcaacucaguuauauauuuauaagcuguacuccucuauugggcagauaggccucuacaccacuuucuuccccagcuaugaagucccugccacuugcaguuucuccaggccaugugcuucccuucugucuuccagcuucucucccucuguccuccuccaucuguccucuccuucuuuuccugucucgccugggaaaccugccuccucauuuuugcccagugaucagcuauuugucaucuuuauuagccagucagauaauugagggaaauuccucuacaccuccgugguugaaaggcgauguugccucuugcagaggaccuggguucaguucccaguacccacaagccuauuauuccaguuucagagcaucugacaugcucuucuggccuuaugggucaagguacucacaugguguacauacauuuaugccagcaagacacucacacacaaucacuaaauaaacuauauauauaaaguuccaccuuaauugugcauaauuuugaccuugaaacugcguucauucucugaguacugaguuguugaggcaguuauccacagagcaagucauuucugugguaacaacaguuaccuggacagugucucacugugcagcuuauacuagccuuggacucacgucuuuuugugccuuagucucgaauacuggcauuacaggcaugcgcugccauaauuaccauaaaccugccgggugugguagcgcaugccuuuaauccuagcacuugacagaggcaggcagauuuuugaguuggaggccagccuggucuacagagugaguuccaggacagccaggacuacacagagaaacccugucucgaaaaacgaaaaaaaaaaaaaaauauauauauauauauauguauguauauauauaauuggcauaaaccaucuugaguaaagguguauauagagacugaggguguuuuuguuuguuuguuuuuguuuuuuuaaggauuuauuuauuuauuauauguaaguacacuguagcugucuucagacaccccagaagaucuuguuaccaaugguugugagccaucauguugaugcugggauuugaacucaggaccucuggaagagcagccagugcucuuauccacugagccaucucucgccagccccaaauauguuuuacuuuuggguuugauccuacaagggaugggcaccgcaggacaacucgucugaauuuuuauagauuaaaaagcuuuaguaguuaucacagugugccugagcuaagauacccuuacuaacuaaacaaaacugagacucaugccacucuccucugcuuauguuaaaggaaguuccugugauuguuagcucggaagcaucccuuggaaguuuggguggaaaaggucuuuaaaacguguaggaaccauuuuguucucugggcugguuuccagggacuguguucaguguuacacaguauggaaaguguucaguccugcugaugucucccccacccccccaucauugucggggaaagggaggguaccagccaagaggcccugccgguuccuaagcagcuucagcuaugcauacucguuuuaaagacagugucucccauugggaccugaccuugccaguuggguuagugaggcuggccagugagcccaagaaucuacuguuuucagcgccccccccccaucuuuuuauauggguguuggggauugaacucacaccuccauggcaggugcuuuacuaacuuagcuauuuccugagcccuggagucagaauucuugguuggauuucaguagaacauaaagcuuuauuuuuuuuaaauauauuuuuuuaagauuuauuuauuuauuauauguaaguacacuguagcugucuucagacacaccagaagagggcgucagaucuuguuacgggugguugugagccaccauaugguugcugggauuugaacucaugaccuuuagaagagcagucugugcuuuuacccguugagccaucucaccagcccaaagcuuuauuuuuaacuaagccuaucuguuguugcuugggcaguuggcccauggccugggccugguugaggggaaagcuggucccugguuaagggcauuguauacacacacagccuguuacaguaugggugccaggcaaagaacgcuggaucucggauccccucucuggcccucccccuucacggcuucaagucagguggcaguacauguucuauugguaaugguaaauuuauuaggucuguauucaaaaacugaauaucgcagacauuaauguugaaagcuaaucacuuguacagauaagcugugguguguguguguaugucugugugggggugucagguccugauuggaugcccuaggucuuugauaaacauguaggcuugauuguaauugucagcgaacguauuuuuaaagaauuauuuuuugaauguuuaccugcauguauguauguauguugugcacuguggacaugcuuggugcccuugacgcccagaagaguccuggcagcuugaguuauagacaguugugagcugccauuuagguuuggggacuggaacucagcagguguucuuaaccacugagggaucccagcccuuaagguagguagguagguagguugguugguugguuuauuuauugguuguuguugguuuuguuuguuuguuuguuugagacaggguuucucuguguagcccuggcuguccuggagcucacucuguagaccaggcuggccucaaacucagaaauccgccugccucugccucccaagugcugggauuaaaggcaugcaccaccacgguccagccccuaagguuuauuuuaagguguguagacuccuacucuguuuuuguuccuugcugagaaucaaucccagggucacacccagucugaggaagcuuuggaaacuaaauuauaaaauaauggcugcuacuuugggguagcuuugccaugucccacuccgccccgcccccgugugacuucuuuagccuuagucacaccugccauuggcuuauugucagacuuguagacugacuugauguuaauucauaugguaacuguuuucucucaucaaaaaaaauugcauuuugagaagccuguguuacuuuggacuuuaagacauuucuugugggaccaaguuugguuugauuuucuuuuaguaucuauucuuuauauauauauauauuguauuuauaugaauacacuguaacugucuucagacacaccagaagagggcaucaggucccauuacagauagcugugagcuaccaugugggugcugggaauugaacucaggaccucuggaagagcaguugguguucuuaaccacugagccaucucuccagcccaagaauccauucuuuuaaacuaugcguauguaugugcaaaugaguguuggugcccagggguccaauccccuuggagcuagaguuguaagugguugugaacugccuaacauggaaacuugaguucagguccucuggaagaacaguacucgcccuucacugaugagcucugucucuagccccuaguuggguuugugugugucucuuuguuuguuuguugugcuuuguacaggagauaacaaucgccuggucuugaacuuaaguauauagcugaggcuggccuugaacuuggggugguucuccugcuucauccuucugagugggagccacugugcccacuuggucugcacaguggaaacgacagaccuggaagguguagucuacucugcuuacguauuuuaaaaauagcuuuuguugacaauggguaaagcugugucaucuguuuacaaaacagcucuuuaggccaugugugcauauauauuuauuuguuguagaaauauaugcuauauacacguuugugugugugugugugugugugugacaguuaguauggccuuaguccuuugucuuuggagauaucacuucuuuagaauuuggauauugcacguguguauuucagcuguagaaucuugccugucacagggaaagguugcugcuuugugacuuuguaagguuuacuauuacuauaaauauaccacuaagcuguaaacuguagggaaaaaaagggaacugaaauggccagugggcugauggccaguuguggcaucgggagaccuuaguacucauuguuaggacaaauaaaccucagcuuaucaccuggccuggccugugcucauccugcaguaacagugggacauugaacaccaugucccgagcugugacucaagucucaggaaacacagaggaucaaagucaugcagaguaggaauagaucuuggcaguucuagggacuccuugguaacagugagucaaauaucugcauugaugggacucuguacuggaguucagaaguagauacacacucacaggaucaguugugugugugugugugugugugugugugugugugucuggaugaaagcucaaacaggccucaaacuuaaauguagcccaggaugaccccaaacuuguggcaguccucaguuucagccuccaaagugcugguacaacagaugcgagccaccaugcuugguucaauugauuuuuuuuuuucuauuuaaaaaaacuuuauauguauggguguuuuacugccauguuaugcugggugcccucagaggucaggcugggccauuggguccuccgagggaacuggaguuaguaacaauugugaguuucuguauaggugcuggaaauugaacucagguccucugcaagaacaguaaauaaauguucacugagccaccucuccagcccagauuauucuuuuuuuuuuuaacuaaaaaaacaagaaaccaagacaauucagugcagugcaguuuuuguuaugucuccuucugguggauaauucuagagagccaucuccauggacaccuugacccuguacauaccaguauuagcucagaaugggucccacgccuccagugaaccccagaccuauaacauuuacaagaaaauguaagagcaaaucuuugugaacucuagauaaagguaucuuagaacacacauacacacacaccacagaugaccucuagagaaaaacauugaagaauugggcuuugucaauauuaaaauauuuugcuucccuaaggaugccauuaaggagccaguggcugucgggggcagggggacagccagugggauggcaaagcugguagacacagaccuggucuugcacagaccugguggucaguccuaggauugcacaaggaggcagaacagaagucuccugagagcugucucugacuucacacacaucucauggcaccagggcaccuagaucacucaaguaauagaaauacauauuuuaaaaaauaucccagucugguaagggacagaagagauggccuagugguuaagaacacuuguugcucuugcagaguaccuggguuuuguucccagcacucguaugguggcucacaaccgucugcgacucaguucugggugauccgaugaccucuucugacccccucagcagauguacauacuuacgugcaggcaaagugcucauacacauaaaacaacaggauuaaaaagagaucauuuucugggcgugguggcgcacaccuuugaucccaucacuugggaggcagaggcaggcggauuucugaguucgaggccagccuggucuacagagugaguuccagaacagccagggcuacacagagaaacccugucucgaaaaaaaaaaaaaaaaaacgaggaaaaaaaaagagagagaucauuaagaacacagacaaauuagggcgaaaauaauuacaaaaugugagagacuugcaugugagauuugcauaacauuuuuuuauaaccaagaaguuagauaaauggucuggagagaugguugaguggauaaguggucucccacaggaagcucauucaguuaguuccuggcucccuugucuggugucucaguuaccugcaaguccagcugugugggaucuaaugcccucuucuggccucugugggcaacuucacucacgugcacaaaccacacagacacauuaaaaagacagcaagacaaacaaaccaaagaugucagagaaacaguccaacagaaagauuugaaaagcuguuucacagaaggggauaaacagccguggucgaggguguuaaaagauccucagggggcaggggauguggcuuacucagccuugagcuugcucagcaugaaugaagcugggaguucaaucccuagagccucauaaacaggucuggugucacacaccuguaauccuagaauguuggagcuggaggcaggaggaccgggaauuuggcgccacgugggcuucauaaaguccugucucucaucugacugguuguuagggaagcagaaaccacagcgggaggcuaguacacaugcaugcacgcaggcaggcaccgugcaccaggaugaaggcucgggguaccagggauguggauagagcugaugaccguacagaagguugucacacauguguucauugcuuagaggaaugcaaaaugguaccgccacucuagaaaaacaggcuggcugugucucagagaguuaaauauaaacccaugaugugagccaggaauucgauugcugagcggcugcaaagagaagugagaacuggcccauguggccauggggguuucguucauccuugccuacgacagcauggccguuucauugauccucacccguguggccaugggcgcuuuucauuuaccacagcacaaaauagaaggcagcccaagugucuaccaucugcaaguagauaagcugaggcagggggaugacaucucaguaaaaggacgccuuguccuugauaaagcagcgugguacuccuugugcagcuaagagaggccacacugcuggggccccugcugagaucuggugcugucacgguaguucagcacgugugcauguuugcaugcccaugcacgaggaccucagggcucaaccucaggugucguggucacccuccaucacuuucugagauggagucucccguuggccuggagcucacugguuuugcuggaguagcuagucaguaggcgucagggcuauaccugucuuugccucuuugguguugggauggcgggcugacagccaggcuuucucgugggugcuggggacccaaaaucagaucuggcauuuacccuugugcagcgagcauuuucucccuggcuccuuucugaaaucuuuauuuuuuuuuuuuuauuuuuauuuuuuuuugguuuuucgagacagaguuucucaguguagcccuggcuguccuggaacucacuuuguagaccaggcuggccucgaacucagaaauucaccugccucugccucccgagugcugggacuaaaagcggacgccaccacacccggccugaaaucacuuuuuuagcaaggucccauugaaauguuauuugagccaagacgggcaaauucucaaggaaaaauaucuaucagucacugagggaguucgcucguguggaugugguuguuugaacggaucacucucucagucacaggcugcaucagguagugugggcugcacgggcagaguggugacugucagcucugaggccgugaaaguugagaucccuccagugaguccaaggcugaggcuggcaaggugacucggcagcuaaaccugcuugucccucaagcccgaugaccagaguuguuucauccccgggaccuacauacgacggggagaaaacuaaccccuaaaaguuguucuuucaccuacacacaacuucucucuccucucucucucucucucucucucucucucucucucucucuuucuccuccccccuccauccugccuucucucaguaaauuaaaacaaaaucccuggggauuaucacauacucagcugaaagucuaccaaguucgguuucugccucaggcaugcauccagaaugcuuaguuccucuucugagcaccucuccuaaccaguaaguuuacauagaagaaagacuuuaaucccccaaaccaccgacacuguguucuucaccacacugacccccguuuuaaugcuugggcuuuccccgggguaucugcaguaugaacacugucuaccuguguuuacucuguuccuuacacuuccugaugugcgccuuccuucaggugcuguugggagacagaucugccuuccucuguccagcccuucugccuccucagccccucggccgcucucgucccuggaggaggguccguuggcgcugugccgcagacugaggaacucaggaaccggacgauacgggauuuggugucaggcagcugggauucugaaccuguccugcugcuguacagugccggcgagucuccugccucagugucucauuagugcuuugaugacccccauguuguggucaucgggagaguagaugugcaaagcacaauaccugccuuccccucugccuucucuccuguugguucacaggauucgggaacagccuuggcuuucuguaauugauuguucuuucucuguuaccuuucuucucagcgguuuggaggacacacugguacagugucagccucgcugucuuauauagcauguagugaugugucaagaagguggguggcuggcgagauggcucagugcucaagagcaaugccuacucuuucaaagaacccaggauagagccccagcaaccaccaagguggcucacaaccacuuuaauucuaguuccagggggucuggugcccuccuuuggccuucacagguaccaggacaguauaugacacacagacaggcaugcaggcaaaacacccagacacaugaaauaaacaaaugucuugucaaagaaauaaaaauaaaacagcuaucaaagagccagaagaccugggauuccuuggcgaggacuugggucugagcucuagauagcacccaucugcucucuaaccugggauuugcuccagauccaguuuccagucugggagguuucuuuuauugcaagauuaugaaggugaucagagaugacagggucugagucuugguggcuucugaguaaacugugacacagaugcagucagcucacuaaccaguggugaucauuaacauugacuacuaacuugacuggcucuagagucaccuacgggacaaaccccuggacaugcccaugagggaaugucuaguuuggguuagcugagacaggacaaugaauccugaguguggguagcaccaucccaugcgcugggaccuuggacugagaauauaagugagcugagcgccagcagccaucucccucugcuuccucaccauggacacggugugaccagcugccuugguugggcuccugucaccaugccuucccuguauggcagacucuacauucaggcugcaagccaauaaaccuuuccuuauuuaaguugguuuucuuaggcauuuugucacagcagcaagaaaaguaagauuccgccaaucaaaugagacacuagggccagcaucacacagcaagccagcagcagcaggcaggauuugguuuggaccagugcauaguaucuguucuucccaucuuccacugauauuucuuguccucauuguagugguggguauugaacccaacaccuagcaucaguugccaggugcucuagcaccgaaccucauccccaguccacugcuauuuuguuuucaagacaggguuucucuguguaacccuggcuguccuggaacuuacuccguagaccaggcuggccuugaacucagagauccaccugccucugccucccaagugcugggcuuaaagcaugcgccaccuccacccagcuacuguugguuccuaauuccacuuaucuagucguguccuucuugcuccaccaggacagagccaagcuaccacugaacauagucagugccuugcuggcaucuuagguuuucugucauaggagagccugcugacuguuguguucuguguuguagcucgugguggagagagagacagccucccagucacaguaccucagcccugacucauuugggcucuugucacugauccugcuuccucucugccuucuccaccacaccaagccuccuacagccuucuuuggacauuugcacuuccagcagccucccaggcaugcgugugcucaggcucgggacuccuuuaaccgacucuuucccaaacacugcucccagacaccccagagcucuggcaaacuccuagagcgucuguggguauguuugcauuccaagcagauaccaucauuauguugggcagguggccacgaaccucugggucaugucaugucuuugugaagcuggguuuucagggcucauacagaugcauagcaaguagagcccaacaguccacgugggacaggaauccaggcugccaguguccagucugacgccaagcuuugaagcacccaauaggcauacguuguuaaagcuuaagacucauucagcgcuuaccagggaagaucacugcugccuauuuauuuuggccugaacguuguagguuuuagccaaguaaguuuggggacgguaggauagacuugccuucacagaaaccugccugcggagccuguguagagcugcaaagcuuguggcuggaaggacaguacaagauuuauuuuaaaauagauaaaacgucugucuguuuuacguucaggaaggaagucacugauggagagacaguuacugaaggucacgugaaggaggucauggcuugggcuucgaguagcagggcucugaggagaggcagggugcgaugagacagugcuucucagacagggugagacgaggcccugcuccucagggccgcccgcacaccagcugcagggcuuuauugaaggaaaugcaaaaccacaggccaccgucaacccagacucaggacacacauguuaaacaagggucucuggugaugugcuugcagcuaaaaucucugaagcccugggggaggcacagccuucuguggagagaauaacuucaugccaugugcccucugccgugggcugagacaguggcaggagagagagugauaagaggguugagggaaccauuccgaggaaacaagaggauaagaguggccaagaaggucugcagggucagggucaggcacacugaguuguaaacaugcaugcagucauagauaaccccugcuggugccaagcagccucggggcaguugcugcaaagauagggcuccucugaaagagugugcuugcugggugaggaugaggaaaggccagcuagcauucgucugucauaggugcggagagaaagggaggcacaaggaggugagauacagggaaggggugaggaagggguuccccugaagccaguggaaagaaaggcugcaccuauggguggaagcagaugguuccugguuuacuucugucuuagcuaggguuuuacugcugugaacagacaccaugaccaaggcaacucuuauaaggacaacauuuaauccaggcuggcuuacagguucagagauucagcccauugucaucaaggugggagcacagcagcaucuaggcaggcaugguacaggaggagcugaaaguucuacgucuucaucugaaggcugcuagcagaagacuggcuuccaggcagcuaggaugaggguccgaaagcccacacccacaaugacacaccuacuccaacaaagccacaccuccuaauagugccacucccugggccaagcauauacaaaccaucacacuauacauucggggagaugcauacuuugcuacuagacugcaguaggauauugggauugucagguuucccaggguucuagugucaagggcagaggucuggccccacugcuaguacuuuguacggggagaccuuaggaggaggccugggagauuaggagaugcuggauuugaaguuggaaaauggggugggggauaagggguugguaggagggugggguggagagauggcucagagguuaagaacacugaucgcucuuccaaagguccugaguucaauuccgagcgacuacgugguggcucacaaccaucuguaaugggauccagugcccucuucgguuugucugaagacagcaaucguggauucauaugcauacaauaaauaaauaacucuuugaaguuggaaagcaaucuguugcugugugggguuuugacaccacuggaagugagauuuggcaccuugaaggccgagauugagaauugcucggggaucggcagccgcuccugugcgucgcggucaggcggaggcugagcagcuggugcacauuggcgcacccuccaggcugccucuggggccaugucaagucagguuacagaugaggaaaugccucggcaaaugcccacagucacguagcugcuaauuggcagaaccaggauuaggaacaagagccagguccuuuaagcugagcugcucuguucugagucaccugcuccugggugcugacugagaccagggugugaaggguuguuaaauggaggaggccagagcccagcgcuccggcuuucaaacuggcuucugcaauccugaaggaaauugaccaauaaccuggcuguugucgcuggcagagagcuuugagccucucugguucuguucugugacaucaggguagccucaguggucuuaaagugauacccgggagcuaggagaagagacaaacaugucuguuccaaugaccuuggcagaaacccucgucugaggucagcaagauggcucagcaggugacggugcuugccguguaagcccagugaccuguguucaauccaaacacuccagaguugcccucugaccugcacuggcacacaguggcacacaggaucacacccacacacacauaauaauaaauugaacuuuuaaagggucuauuuagguauguauguuauguguguggcuuuugucugcaugugugcacaccagaaggcggcauuggaucccauggguugcagucgguugugagccaccaucaggugcugggaaucuggaagagcagccggugcucuaacugcugagcaucucuccagccccaacaaguugagguucuaagaguuaaaaucucagggugcgccccagccucuuacagucuucagcucugagcuccucuuagcccagugguucuauaauucugcuacugucaugagucguaaugcagauaucuguguauucugauggucuuaggcaaccccuuucaaaggguugguugacccccaaaggggucaugacccagauugaggaccacuugauuagccucuagcaaaucugagcaucgaauuuuacccaaauggagcucugaggacgagggucaggaaucccccagucucugacacagcucaugacaguggguaggugcugggcaguccaccggcuguuuagagguggcaggacccugcagggacugagggaugguggcagugagacccacacugaagagucacaggcagaugcugguggggagagggucuuguuaguuuguucacaguugcccuguaaaugugugugcuauuggcuccaagcauagugcaaagugggacugaaguuugccccggccuggccagcuucuagcuguacccucucuacugccaugaccuuggguggcacuggucuaucacagugcaggaagccugaggggugacagcaugggagauaaggauagcucaguguucucccuuuacauuuuuuucuguuugcuuuauauacaugaauauuacuuugcuuuguuuguuuguuugguugguugguugguuacugagacaaggucucucuguguacccaucuguucuggaacucuuuguugagcagaccggccuugaccucacagagcucugccugccucugccucugcccgccaggcgcugagauuucaggugugugcugccaugccuggcugaauguuuugccuguuuguacccguggaagccaaaggaggggcaucagauccccuaggacugcaguuauaaauggcuaugagccacguggcugcuggcaauagaacccgaguucucuggaaaugcggccagugggcucaaccacugacacugagccaucuugccggccgggugguucucagccuguuuguugugacuccuuugggagucccccauucagauauccugcacaucagauauuuacguuaugauucauaacagcagaaaaauuacaguuguaaaauagcaaugaaauaguuuuaugguugggggaggggcaccacaaaugaggaacugaauuaaaggguugcggcauuaggaaggcugagagccacuguuccaacccaucucccuaauauaucuuaacccaaaaauuugaagguagcuuauauaacauuuuuggguuuugagacaagguuucacucuguaucccaggcugaccuggaacuuacuguuguagcccaggcugcucucggacuccagagugcuguauuuagaggcauguuaaaccaccauacccagcuuuuaaaauguuucugcuuuaugcuuuaacccuauaaacagccuuuagcuuuauagauggccaugcaagucuuuauuucugacagucuuugggucuguggaauucuaguuggauuguuucauuuucaguuuaucucuagggacugugaaaugucucugauuuuguuugacuucugugauaauaguugcaaaaccauacccaguauuuacauaauaccuuugaaggaggaaauaaaaagcccaguccuauuucgggcauuuucuuaucaggacgagcuucucugaggcuguccuguuaggauugaguaaucucaaaaggaagagauaacacucaggcuaugcucagcugggccacagcagggcgaucgcugccaggcuggccgggcaggugauccaggcccccuccacauggggcagacauugggcacggugcccuccuccuccuccuccugcauggcagcggugcccagcugggggcagccaucuucugccucucauuugagaaauaaacguuuauauuaugcuaggcgugugcuuagccucagaguugccugaacaggaaggcacacagacccaggucagguuggcucaccaucuggccaggugucugggcuguguguccucaggucggcuugcuguucuggccaugccuccacagaacaggcucuuauccagucacugugaggaucgggugggccugggccuggcaagaccucucagagguuauaaugacgaugaaugccuaccuggcucccaugcccgcuccccuccgggcaggucagugaagaaagagcccaggauggagaccgacuccucagaggcccugcagcuguuaggugcagcugcugucccuguggucuuugcaccaggcacagugacuagcacuucucacgggcugguuugcucgagugccuagcaggcaguuugcuguuguuguuuguacaggggaacaaguaaucgguccagaaugaccugaccagugaggaauggugcagacauuacucaggugcaggcuguggcagacccucuguuccuaauugucuuuccuuucacacucccuuccuggaaagcacacacgcuuuaaauaauuguacacagccagccgugguccuguggucuguccgaccuggucucggggccagagaacacagcuaugaacugucuucgcggcccuucccugauauucugugcuguguccuucucugcuuuaaaaacucuuaacauuucuuuuaauuuuuauuuuauguguauaaauguuuugccuaaguauauguuccaugcacugcaugugugcaguguccaaggagaccagaagagcgcguuagguccccuggauuuaaagauggcugugagcugccagguggguagagagaauugaacccagguccucugcaauagccacaagugcucuuuaagauuuauuuacuuauuuuauacgagugcacugucgcuguccucagacacaccagaagaaggcaucggaucccaguacagaugguugugagccaccaugugguugcugggauuugaacucaggaccucuggaagagcagucagugcucuucaccgcugagccaccuaucucuuggcccugugugaggcugauggccagccagaggccuaagucuuguugccuacgucuugcuugcuagguuucauuuuuguuguuggaaggguggagcuggggauguuguaguuggagcgcuugucaaggauucagggaucucugaguucaagccccagcaucacaugaaacccuggugaugcaugcuuacaaccucagcaauggggagaugcgggcgcggggagcaggcauccgagcuacguuuggcuaaccagugacuuugagacaagucugggguaccuaagacccugucucaaaagcaaagaaaacucaaagagguggcuacucuuccagacugucugcuccccuuuuacagcuggcuuugaaaaugagagccaaucccucuaggagcucugggauuaaugaagaauucugugaagguuuuuuguuuugguuugguuugguuuuuuuaauucguuuauuauauguaaguacacugugcugucuucagacacaccagaacagggcaucagauuccauuacgaaugguugugagccgagccaccaugugguugcagggauuugaacuuaggaccuucagaagagcagucagugcucuuaaccacugagccaucucuccagcccaugcugugaaggucucauguaaugauagcugcaaacuuguaucuugagaaauccugauuguuaucuguuaccuuugguugguuuugaguuuuuugguuugguuugguuugguuugguuugguuugguuugguuugguuuaguuguuguuguuugaugcagguuuucucaguguagcccuggcuguccuggaauucacacuguagaccaggcuggccuugaaaucagauccaucugccucugccuccagagugcugggauuaaaggcauuuuugcuuuguuuuguuguuuguuuuugccauuuaaaaagcagacucuaagccagauguggugacguguacaugugagccuagaacucggaagauugagacggggaucgguaggaaaguuaggucggggaguuccuucacugcugugacuuauugaaggaaacagaagcuggggcaugcucaguuccuccaggccgacagguccugggugugggcucuguaaagaaggaagccgggauuuaauuugugcagauuguauuucacugucuaguagccacacgagugagugguuuuucagguucucuagaucauguaguugguucuuccucuguuauuaauuuguuuacagcuuaguuauuagucauucuuguccuuacagccuuggcccccaauucuuauaccccaucggucacucuggugagccugggcugaugggauauccagaugugaugggauauccagaugugaugcuguauagcggcggcaucgcagcucugcccgaagacacgacacacccugcuguuggucaggcgaccaggguggaggagcuauuggucuuaagggucuuugggcuauggagauuaaaccugggcuaacagaaacgcaugacccccaaaccacagauggcuccgaagaaagaggaugagggccccagagcauugcuuuggauguagugagaaugaggggucaagagacuuggaaggcugcuggcugcuggcggugcacugagucaccagcgaggugaggccuuaggaaacuacuuaauccucccugcagucgagggcugugugcagccacuugcagcauguucucgaacauucuuacagauacccaugaguuagugccaaauggaaccacagcacacugggugaaacgagucugcagaccuagcuaguaugugcuuccgucugugcauguaugugugugcauggucgguaccuagaaccccagcacucgggugggucccacacagaaggcucuucacugugacgacauccugggcuaacauagggagacuuucauaaagagcaaaagaaguucgcucacaagcaagccagcacagcuacagguuuggcugugaggaccagaugggggugugcuugaccugagugaaggccgcagccucucgugagugcaucugccgcaugcuggagacaggcgcuuggacaggaugaacugucagccgccaaccuuuuccucucauuuauagugggaauaauuucauagccugucagcaucacacaaucuguuuccaaguaauuuacucccgaaauaagggguuaggggugggcaaagaugaguuacucaguucagcuucacguggaagcuguccagggccugaagugaauacaccaugggcuccugcgacagccggccggccucuucuuuccuuuuagucccugggugagaggagacagcuucaugguguuucucucgugagaaggucuucuaucuuguguauuugcaucgcuugccuccucugggguuuuccuccuggagagcggggacauccagcauugcugucugcagcguuaggucagggacaggacacugacgggaccacggggcacucacacugucacucuuccggcuuuuugauugacagguuuguuuaggacucaguguagcuuuccauaguuguagcuguggccugcugccuguccuagagcuggcacaggcaaggugguugagguggcaggccaacugccgccuguuaucucagggacuagaaagcuaauuagcguaauuaaauggacuucauugaauugaaacuuucuuuaaagcugucccauccaacucuguccccuguguggucuauccuccccucuuugauccuuuaccgggcuucuugagaaagcagaguugggucucccugccugggcuccugucacuccaaucucucuuagagacugcauuggcccuucagugcuguacuccagccuugcuucggggaccagauucuccgugucucugaggacacuagccuuucuggccuugguuuccuugacagguggaggaagaugagagagagcuaaggcccugcaccugguguguuggaugcacuugccuacagugcacuuggcagguggcgaugucaagucucugcaguccuugucgugcagggauggaucucauugaguucgugagugugcccgcuugccggguccugucacuuccggcccucauuucuguucuguuugaggcggugccucucucucuccccaggccggccuguaauuaucugacccuccugccucugucuccugagugcuggaauuucagauguguaccacaccccuggcuuuccuugacguucagaauagcauccacaguccuguguuucuugauucucgcccugguuuuuugggcuccucuuguucugccacagugucccagccuuccguucuccuguguggugcacccacuuuacuuuuuguuuugcuuuucgagacaggauuugucuguagaccaagcuggccuugaacucagagaucacccaucugcuccagugcugggauuaaaggcgugcgccaccuccuccuggcucggcuuuaccuuuugaaaugagaucacaccaggagacaguucagacuuuagguuauuccuaacccacucugauucagauucucaguuaaccccagguggcagcaggaucuugcaguugaguugguauccagugacagucaccaugagcgcuguguugucugugucuuuagcagcuggugacagaccccuuugcugagcagucuggauacccccccuccccccgcuguuuugucaucucuaaacacuaacaguaaaacaaagguuugugaaguccauccuaagucaggaagaauggagauguaacaugcacggucgggucgucccaccugugauggggagcaggagggcagggcaucuagggaggugugguguugguguuuaaggauucaggcuuaacaugucucccagucucuaagagaugacugacugacugaauagccagugacugcauucuaagauuagccuuuguuacauaccuaaaucucauaguagaagucuugaaaacacuagguaaccaaccauuccuagagagucaucccaaugcccucucccuuaccaguggauaagaauuccccaccccaccccaccucugcccagaucugagccaccaugacucugaugggaagacaguggcugauacaugucacaguggcacugcagcucacagacccgcucacuacacuccuucucaggacuuuuucaccuuugacauggcugcuugccuuuuuucugacuggugugaauuuuggggaaaaaaaaaagacacccaagucacacuuuaaagucacacauuuguucccuugaaggguugacaaaagaagaaugcagauaccaaggaggaagaagcuagcacuugucacauggcuaagucccaucauagaggacuugaugucuacugguagcuuccuucgaucccuccacgugagcacagcaguggugugcgcugaagccugacagcacaguuuuccuccccacugcagggcuucuggcauuaguugaccacacacagauacccagagcucuacucagcgccucugugggugcagucccuugguauaccgugcugacuagucugagcugagccuugauaagccgaguagagcacguguuccuuuucagagggcuuauucuccauccagucugaguuucuuuccuucacugacaugacaugggaggggauuuguaguuggccguucagaguggggcagcaccagguaguucauuccccagguuuugguuccaaggccagcucagaagacaacuccgccaagcaggucagaagccugccuucuuaguuugcagugugcaacagucaggacagugaagccuagaaacucuccuaacuucuguuacuuaaagcaugggcuaauggcuugggacaacucgggcucuccacuauugggaccccugaccuuccauguuggcucauuccauugcugcaaagcuuccacugagcuagguucucccgaccugggguugcucacugaccuacgccguguuuuuuauaauggcuuagaaugguuuuaccucuccuuaccacagaauggaucuuacaacagucacucuuggguaugaaucagaguuccccgugcucacucauggacuguuaucuuguuuuucaggccaugguugcuuguuacccaggcaacggaacaggcuauguccgucacguugauaacccaaauggagauggaagaugcgugacauguauauauuaucuaaauaaagacugggacgccaagguaugcaacucaauucagcagagauguuuuuuuucgacgaugugguuuuuuucccucauggauaucuguagaccucucucgagucugcuucagucuggacacucagaguggacuuuugugauaugauaccuauaaugcugugcuugaaaacaagcacuaauacgaacacauagcagcaugccuugugcaguacgcaccuauggguggugcuguggugucagugggcccaguggaacacaccaggaaucccggugccugggagguggaggcagaagauucagaaguucaaggccgcccaguucagggaagguuuccagcucgaguugagugucaaccagccagcucuccuugagcagcggggugaggagaaggaggauguguuugucaucccaaucugucucuaagaguuugcaaggugccuugggauucaguaaccuacaaaagcaaagaagcaggccauauuccuacuggcugacauuagucuacugucuaacgaguucuaggucaggcaacgcacucaacugcccuucaacuuugaguccacccgcucaggagcagcaguguguugggcuugcuggugcauaccuaugaucucagcauuugggaggcucagagguuaacguuggucauccuuggcuacaugaggaauccaaggccagccuugguuauuugagaccuuguuucaaagugacuaaauaucucuagauuggugauuuuggucuagugcuuuuccucauagucggaaacacaagggccagaucuauaugcaugucccccacuccucauuuagggucccugugauauucaguggacuccguguacugccugugauguguauccaguccccgcagagagcggagguugagguacacgggugggaugaauggaguugagcucacaucagcuacgauuagaauuuagacccaggcuacacagggauagcugaguacagaauggguuaggaugggagaugacucagcaggcuaggguaacugccaccaagccugaggaucuaaguucaaucccugggacuuaccaacucccaaacguuguccccccccuccuccccagcuuccuuauguaaugaguguagauuaaaaaaacagagaccgccagcucaccugcuugcuaagcaucuguugaaaguuuaaagcaccgugguuguuuuccugauaguacauuacuagguaagcuacugggcaaauguggcuucaugccuuccuuagcaugacuagaaauacucacugguuuucaaaccuuacaaauaggguuggaaauugugcauauuugucuauggcaagggcuuacaacaaaaaggcauuuucccaugcaucugucugcccuauccguggagucucggcucaccgucacaccuugcuaguuacaacauaacuguaucuacaaauaguccuguuaaucauuuugaguccuuuaacucugccugcugccuguuuaaccuggugccauucuugguggcgcauacugacauacucugcucuuuucccagguaaguggagguauucuucgaauuuuuccagaaggcaaagcccaguuugcugacauugaacccaaauuugauagacugcuguuuuucuggucugaccggcguaacccucaugaaguacagccagcauacgccacaagguaguguuccacucacgggaacuugguugacagugugacagggcagggagaguucgaagggugacccugaaguuucuguggagcagccgccugcuguccaggcccucuuucggcguuaggaccuucuugagugaucaugaguaucugaacaugcuccugggaaugucagucugcaauaagccauccuuugccugagaugaccuccccaacucugcuacucccaaccccaccccaccccuauccccaacaugguugcaccuguuaucacugcccacuccaggauucuguggguguuuucagagcgcucuuagaaaacuaguaaagggggcuggagagauggcucagagguuaagagcacugacugcucuuccagaggucccgaguucaauucccagcaaccacauggugguucacaaccaucuguagugaggucuggugcccucuucuggcuugcaagcauaaauggaggcagaacacuguauauauaauaaauaaauaaaucuuaaaaagaaaagggcaguuuuucagaaguaauucagagagcagaagugaggagagaaggaauugucagacggggugguggccauauguguguggugcaugcugggaagacagaccagaaucacucuccacaucuguggccauguguggugugugcccgacaucgcagcgccagaacuguugcaaguuuaucgccagcccaggcuacauauuaaacuccaggcuaugugauagcagcacaaagcaaucggucuguuuuuuucuucaugucucuuucauuggacuuuaagguuuagauucuaaacugacuauguuaauccauacacucucuugagggugguggugguuucccauguggcaucaguuaaugagaagauucagaagacccugaaagcacagugugaagcgcaggcuugcagggagugugccugcuuuuaucagggaaaguggcaggaaagguucccccaccccccucuggcuuagaagcagccaacugcuggugagauggacccuccccaguguugggguacaguggccaagguugguggccauggaugagguccuggagccugcauggcaucuguccucuuccugcuucugacccgugcggcuuucaucacugaaucacaguggguggcagcugccugguggagccuggagucauagggacccugacaggaaaccugggaaccaggcacggcacaugcagugaggccagaggugcagucaggagaggggccaccgggccagauuccaggugggugagagaggaggcugucgagucuggggcugugaggaaggcagcuuggggaaguagcagagucugcucgugaggacucagggcucagggaaacgcuuaucagauaucagacuucggaucggcaguugacagacagccugggacgugggcaagagcuguucagaacuagcuguauagccguguucccugaaaaagaccaugguaggaaugggagcagcccgggcagagcgagucagcugcuggcuaguguuaggacacaagcacuguggugccugccgccggcucugcucuguauuugagucuucaagcaaggugcugugauuguguagccaauuacucgggcuguugcuuuucccaugaacuuuggccuggauccucagauucugucugaccuaaugauggcucucuccugagggaccaguggccugaggcauaugcucacaaacacagcgucuguuccuuugcgccacuguuuacaagugcuggcugccacaugcuguuagcucuggagucagacacagugagacacacuucuguugugccaugaagucaccugcuuuuagcucugaacagaccugucacaccacauuuauuuguguucaguuagaugagggcuuuuggggaaggaacccuagaagucuaugaguguugcauaacuuccucagagacgcagucaaagaugguggacugcuggacuauguuccuuugucccaaucacugucccuccuggguacuugcccuuccucuaucugucccugaccaugcaggcuggguggacauggagagaggcuaugagccucccuuggcugcuguagcucaucugcgggauggacaggacccgcuugccaguuaacaccucugucuuagaggcugcuucacgcauuacaauugucaggaacacuuucuucccagggaccauucugauccugucuuaaauuuccuucuagguacgcaauaacuguuugguauuuugaugcagaugagcgagcgagagcuaaaguaaaauaucuaacagguaaacgcagcugggcguggcuggcaaggucggggaugguaucuuccaaaagccacaguacaguccaggaauguuucugccagauuccugaagucccuauuuuaaacaggauuucucuaguuggccuucauucugacuuguugaaauuguccagugcuuaccgguuugaugcaugucugaguuagauagcucaaacacaggcagagcuuuucugcgaugccacccugagccugaagcuccuuggugcucuucagguucccugguccccuccccuugucuuucagauagacggauaucucuuccuuucacaacauucacucuaaagaauguguggcgggcuggagagauggcuccguuguuaagagcauugacugcucuucgagagguccugcguucaauucccaccaacucuaugguagcucaccgccaucuguaaugggauguggugccuucuucugucaugcaggcauucaugcaaauugagcacucauauucauaaauaaauuuuaaaaucuuaaaaaagagagagagagagagaauguguggccauaaggaaagucuguacagaaggggcagaccagcuccgcagacaggugugcggauucccaggugccagcucuguguguaggccauggacgugugcaccuguguguccugggaccugaagcauacccaguagucccaggacccacucaguggguucuaaggagcuggacucagagcugugccuuauguacuuucacuggcucaguacuuuucaguacucggguggcuuuaaauuaaagaugucacuguuucugacgaggugucugugcuugucacagaggcaacgggaacagccacuaggguagaccgaugagaagagccgcuggagaagugagguguuuccggcgccaucacgggcucucuggugcuuuaugauuggcugcagucucagagccuguugcuucaugagugaaugccucuuuuucuugcaggugagaaaggugugaggguugaacucaagcccaauucagucagcaaagacgucuaguggggccuuggguccggcaguacccacgucaccuacagccucucaguugccuucuguggacucguggacaggauggacagagagacaccugccugguauuucagcugggagccaggcgacuucgccgggugucauccaacagagggcuccaucugcugggacuguacuguggggucagcuccagaucugugacugcucuuggcugcugacccaagaggagacgcugucggaggagaguagcuuuuccaucuggacacgaaacaagggcccuuuguaggaauuucuucagucuucuauuuugccagaccugucaccuaacugaguucauuucaucucuuuuuuauaucaaguuuugaauucggggaauuuuuguauuagguacaauuuaucaaaacugaauuaagaaaaaaaaauuuacaguauuauucucaaaauaacaucaaucuauuuuuguaaaccucuucaugcuauuaaauuuugcccucaaggccuccugcgaugauuguugccagugagugacgacguguugcuucugccugaacguaaaggacgggcgggcgcugugucccagcccgagugcacgagguuuuucuuggcccgucucucagugauuccaaccuguaaaggucacugcucucgcgcuucgaccgaccuaacaguagaugguugccacuggcacucaacuaacucaacauaguuacaagaggaaacaagccacaggagaggguuugucucuucaguuaauuuuuuuaaagcgaagugacgggcacuaaaugaacucggggcucucccucagcuucggguuccugagacaaagggcuuucuucugcggcaggucuagccugccuacagccgugucccacugccgcagguuuccuuguggcuucuccguaguuuugacugugcuuccagacccuuccaggucagggcuguguucuuguggcagggcaccugguggacccaggcacgugaaugugguaugugguuguagccucaaucguggccaucggcuccuuggacagccacgagccauuuucauacccaauaaugaaagcugugugcuagcuuagaaaucaaaggggguguaaaagcacacauucuuuguuuuauggguuuuucucuuuuuagaggacagagggacaaccacacgaggcugccagacuccugucaccucuacaguccccuuagaaagccagaguuugcacagauuguggguauaacuccuguccccuuagguguucuaucuccgaccuugaucuuugccaaaauguguguaugcagaacuauuucuguguauuuuccuugacacccgucuuagcaccuguguaguuuguauccgguuagaaaccuuuucuauggaaagcucaguaauucuuauuaagagauugcuauuguucauguaaaacaugaaaacaaccaaguagagccguguguggaugagggcccacucagcacugugcuugcuugaggggcucucggcaggaagucuccuucugacccauauccgcugaccacaccucuccagcaagugccucugccgcuggccagcucaagguuugcccaccuggccccgaagcaccguguuucggaguugggaggaacuguuuggcauuguuggcagaaggugugauugccuggagcagcagccuuuuaaauucuggagacccuguaguccuuuguaucucagaccuuuacugauguaccaggucccagauucuguggcaggggaugggguggggugugcuugccagacgaaauuuaaauuaucuaucuuuugggaagugugugcuuuccuggaggucacugugaaaacaaacaaacaaaucaggaccguuaaccccuuaaugcccacuuaaacucaauuucauguuaggacucuuguuuaaaaccauuuguggccuguauguguucauccugguuagagagaaagcuuuaugacgcuguuucuguucaacacauuaaccagcuguggaacagcccuuuuugcacgacaggcagggcacuucaggauucgcagagagacucgugugguuuggaagugguauuuccuaugaaagccucucacguugcuuguaaagcuaaucuaauuaaaaagauguauaaauguucuugaaaaaaaucaua

SEQ ID NO: 4895 - RNA, 838 nt, Mus musculus
gcucccagaccgcagcgcagaaaguuuugcuuuucacuuggaggaaaccaaggaggggaagugugauggggcaguguggccagggaccgaaagacugggcgcuucccagacccugggaguaaaaggcgggguggucaagagagggacuucuuccuaccaagucgcggugaagccgaaggaaagugacagaugacaggucggggggggugggagcagcuguuaaaaaugacuugagaaucgaaucucuggcagcacggggcuggccaggagcacggcacaagccuuggcuugugccaagcuccuggcagcuggcucaccucccccaucccuucccuuuggcugcuucagcaaagcaccugcuacaggacaguggguacaggaagugccagucagggguuaggcccgucauaaccucgccucuggaccccgaggcaaaaauaaaccuacaaaacugaacugcauggagucagccggagaccugacuguggguggagcauggggcagugggaagaagccugggagagugcgugcuggaagggaggagccuguggcccuagaaaaaagaccaggugcuggaaaggugggccagagcaguugccucuuaccaggaaccuucggguaagcacgggcggaugcggcugaaguugauaaagacaugagcagagucaggauuuagugcaguggguaggguaacaggguugaaaaaggcacuguguugguauccuaguuugcuuuaccugucagugugacauagccuaggguccugugagcagagagcuuuaguccaugauuaccuagaucagauuggcccguaucgcgucuguaagaaaggucugga

SEQ ID NO: 4896 - RNA, 151803 nt, Mus musculus
cggugccggggcgggcggcggcggcgggagccggcugcagacggagccgggcggccgaggacgcagcgcggcgccuggcgacagcucgagccgcgggcgcaacggccgcgcggggagcgcgcccauggguagcgcgggacggcggcgggcggcgaggcccuggcuucugcgcgccggcccuggcgggguccagaggaccgcggcuccgaggugcgugccggggggugcggggugcagggcgcagggaccggaccugcccggcugcgcgcaacuugcgggccgcucccccgggacucccgcuccuuuguacgcgcgggcucgcgucuccgcgggugaggaccgcggucgggaagcgaccggcagcgccggcacauucauuugagccuggucgcagaaucccgagaaucaauuucggcucgucucccggagagcgaaagccgaggacaacuuggcgucaccccuuggggagacguuugucgucauuaaccaucuucggcuacauuaauucaguccgggccaacgucagcacgggcgaacggacagcaagugcguccucacgaauuggggcugggcgauaccugauuuuggucaaaacaggucuuaggcgcuucggguucugcuuggaguugccucggucugcgcaaggauggcuuugagaaagaaggccaaacagcgagggggaaaggcagaaugcagaacaccccaaaacccaagucauccgcagaaaacggggcgucuugguuauucucauugguuuuccccaguaacuucaaaauagucccagaaauguuccuuuugucugcgguuucacuucuaaacuuuaacacuagauggcuuucuuaugacaggcauuuuaguccgcugcccgcuugaguuuccugcgucugcagucuaggcugggauuuauuuauuuauuuaacgucuuacaaauuggaaugaaaggaagaaacuaucccaaacugcugcuuuauuugaaacauaguacuccccuguaaggcuuaaacugguuauuauauuucuuuuuucaaauauggaaagugggcuuugaucucuagcgaccagaggugacuacgaaugagcgagcugcuuguuacugggcucugcaucgcggaggucuugaugucuuuggagaauguggaguucuuggguggguuuggugauaagagcugcauagauuucgacaugcuguuuauggcuagcuggagcgguuuccggaacaggcagcaaugggaucuauugcaggggguggagggugguugggaggggggaagaauagucuaucuucaguuuugggcgcgugugaggcuguucaugccuaaggguugaccggcagcauuugaggaagaucuguagcugagugcgucugccugagucauacugaggguugugucacggaccucugcguuuccuucuccccuggugagaucuggcuugucucuucccagcacggcuuuuuaaugacuaguacagucuagucauuaaacuagugccucuaguuaaccgaucaguggccacagcagauucuuacauucuggguuaaguacuuuuuuuuuucagggggucggauuugggaauuaaaccuauaggcuuggguaugauagacaagcacccuaccacaaagcuacauucccagccucauuuauuguuauuucaaaacagugagccauuuacuauuauuuugaaagaggcucacuaagcugccuaggcugaccucacgcuauagcucaaacagacuuugaacuugugguccccugccucaugauuggcuuggaugacaggugugcucugcuccaccccaauucauuuuccuuacuuuuguucuacaaguaaaacaucacagguagcccaagucuugcccuggugguaggcaggcuuauuagcugaagaaauugaaauuuggcuuuauaguuauuucuugugguuuggcuggcuuaaauuauaacguuaaauuuguauguucuaaauuaaaguguauucauaaauagcuaaaggggggggaccccaacuggguaaaugucuggggaacauagcaaacaggaagggcuucccucaguacccacgugcuaccuauagauggggugaggugaacuugcauaagaagcccuguagacauuuccuccggaggauggagagagcacaacacagcauccaguuaggagguggagguggagcuucugccugggagugcggcugagaauugcacugucuggcuuaaguguauaguuuuuagagcaugauuuuguuauuguaaaauauuaggcucucgccaagagcguuugcuuuagcgcuguaacuucuagcuucguuagugggaucaucaucuuggucaaagcuauggaguauacauuuggaaggugcaaccccucuccccguaugauaaugcaugggcucuuugauaccugagcuuagucacuuuuccagaguuuggggaauccucuucaccugagauaaaagggacaguugguuggauacacuugaagaucuauuucugaaacagguguuaguacaaaucauuauuaucugguaauugaagcuggcuugacaaggccgugcacaggccucccaacugugcuucuguuuacauggaccugcuucucacccuuggcuccaccaguacuuguuaaccccagcuuuagagaaccuuggcuugucuuuaaacuucugaccucaauguggagguaguuuuagauaugugucuuuacaaagacaccgugaguccuaagagaacauggacugaccauacuuguuuacuuaaguaaaauaugaagucaagccuuguagacuacaaaaacccgaggucuagauucucuuccugaaccuacacaagugcuucuuuuucgggugagaagaagggguaggaaccucaaggggcagucucuagucccaggugaguuuggauaaaguauaaaccuuuuggcuccaaaaauauugguuucugucucucugucacugucucugucacucucuucauuucauuuuuuauuauuuagagugaguguguguguccgucuguguguguggcaugguguguguguaggucagagggcaacguguagaagucgauucuccucucaucacaugcgcuuuugggucugaacucaggguuggcagcaagugccuuuaccuacugagccaucuugccagcccccuuuguuucuuuauuguuuaaaaaugcauguauuagagcaauaaaaaugucuguuuggccagaaugguuuauauuucccaugauuacgaguucugcuggauuccguguauuguaaguuuguguacagugaaccuccguauauggauuuacaguugcuagguuuaccuuugaagucaguggcucaggaaucgcuuuucgcugccaauugcauucagcuaugacccuuuuuaaggagcgguaaccaugcaaguggaauucaaaugucucccaacuucaaggguaaauugguuugauggucucugacccugaguucagagugacaauaguggcgagugcucugcagcucagaucugaugcuuuucuccugcgagagccacuguaguagugcaggcugcuucugagaccuguuuccuaugcuguguuguguggagacugaguaguggacagugcgacaggcugugagcugagugugauugucauggagcaucucugugccagaaaggauguaagugaagcagaaaugccuucaugcguaccacuguuuccauccaucuauaaaacuuagaaaacagaaccaagccacauguggugguguacucugaugaucccagcacugggagcagaggcaggaagaccaggaguucaaagccauccucagcuacauaaugaguucugcaacagccuggccuacaugggacccugucucacaaaaucaacacaaaagcagauuuuaaggagguuagguuuauaugcauuuggcauugcuacccuaaccauauuacuuaaauaugcguaaguauauuaaugaaaccaacucuagccaucacuauuaucagugcuuuuaaucaagauaacauaaaaccguauaugguagcccuugugaucucagcacuaaagagguugaggcaggaggauugcugggaguuugagggcagucuggccuacagaguuggggcuccaucucaaaacaacgaaagagaagaagaaaguaacaggagaaaagauguguauugggcuugguccccacauggggugugugugugugugugugugugugugaauguguguguguguguaggcaugugugugugcaugugaguaugugugagaauaugugcaugugauuguguaucugagugugcgugugagagugagagaacauuuaguaaagugaccucacaucucaucugacacccccccuccccacacaccuuucccuuguuucauagugaggcugucacugggcaaaggguuuagagagcacagccugcuuuccccaggguucuccacugcuuagcuccuaccgugugguuucugacugcacugagaaccgaaccuguggccuuagcacagccaggcaaggugacugagcuacguucccaauaggcccuagacagcuuccaaaggggauuuuccuguagucacucagcagggccugugggaguggggauuuaauaccacuuuuugaugguuucagcccucaaaagauuuuaaucuuuguuugcagugcuugaggcuugaacucugguuucauacaugcuggugugguguucucucagugagucgggugccugcucugcuuuuucuuuucagacuaaguugcccaggcuaaccuuaaacuccgucacuauccuaggcuagucuugaacuaucucgggaucuuuuggccucagcuuucugaguagcugggaagacagagcugcgccaccaggccugacauuaggaaguuucuauagaauauauagaauauagacuauauagacuauagaacacagccuaugcuaccuugucauuguaacuuuacuguuucaggacaaauucucuagagcagugguucuccucaaccuucccugccacccuucaauacagguccucauguugugauaauccccaacuguaaaauuauguuuguugcuacuucauaacuguaauucugcuacuguuaugaaucgcaaaugucugauaugugacuccaaaggggucacgaccccauagguugaucuagagagccauucaccucugcauccaaguugucaaaguggggcccagugagcagggugucuauggcuggcccugcugcugucuuggugagcgucccugaguccaggacuguucugugauagucaccuugcugcucuguuuccuuguuacuaguuccuuuguuuuggaauuugguucuguugacaacucagcccuuccucucaggacuguugccccgggcugggguggguaaugacacuggccaccgagucugacuccugaguuugaacccuggacccaugugguggaaggaaagagccgacuccugaaagucauucucuguccuucacacaugggacauguaugugcgccuccccuccucuaaauaaacgugaaggaaagaaugugccgccuguaccuuagcugacccuuuauaccgcuuccuguaccccuggugggauugaucaauugccuaggcacccagugggucaucuuuagccauaggggcucccuuuugggggcuccaaggaaucauguucuuauagccaagcacuaggacaugugaagugcuugguuuuaguaacuggcugagucucuuuccccuucucacaggcuauuaugaaagauggcaccuaacuugcuuuacgaguucugcugacugagauuuucuaagucagaagugagucuguguuuuacugugucccucguuagaccugcuuuguauguaguuagugauuaggaaauauaugcuuaaugacugacuggcucuuauacauuaggggacccuguggcuuucuaaagacccaacagaaaggacauggaaaaggggauagagcuagaccgcugcuccugcccuaagauuugcaucaucuuaugucccuugcaguuaggggaagagccggugcuucccugguggugucccuuuuaguggauggacagucagauacacugauuguugcuguaaugaaagcagcuugagaaagggagggcuuauuuggguucauagugagcaugguggaaaggcagaucagaaguguguggccacuggucauauucuaucuagucagaaaaagagauaaugcuggucuucagacuacuuucuucuuuuuaagcagcguggaaaccccagccgugugauaguacugcucacauuuagggugagugugaagacccacuucaguuaacaccaaauuagaacacagagguuugucucuugggugauaagauucuagcucucagugaggacauuacagcucgcaucucuuccuuguguacuacuaucccucagcuguaggagcgucuggaacucugucugcggguuucccacuugguguaugugcccuuccucugaggaauguccccuuuuauuuguggugaagucagaaguccaaaguaggaaaauuaguuagcuucccaucacuaaggcugucaugggagggaaggcguggccuagcagcucaccucaggacaggcaggaagaguggaggggcccgauguggagcagacucuucccauuucccucauauuucauccuggccuguuccgugggaugcugccagccacacucauggcaggucuucccuacccagcaaaugcccuggaauugaccucccagacacacccagacgaggcccuugccaguuaggugagguggacacuguguguucaguuacaccuuuucuguugggugcuuuggagccaggcucuccuugggccagccuggauuucacccucgagccucagugcugggaucacagagaugugccagcaccgcagccacaccuacacugaagaccagagcaaagagccgguguuugaaguuguggcuguggaacaugggcauggcgcccuuaugcacgugggcucuugggcguguaaaacauuaugcaaacccagaguccuguugugcauguucccgcagacuuccaggaggugcggagugucuggugccgugugaccagcacagcucugcuucucugugcucuggggcguguuuuaaauuugauucccguggaaccaugggauucaugugguucuggaauagcucugggcuguuuccucuuuguauugaacugucuaauaagggauuuuuaggaauuacaguuuuggucauucauccaguaaaaugcuacuguuucaaguguuuaaugccuuaauccagugaacaauggcuguuuuguagaagggucuucaggcucuuuccacuguaaagucaacucucugaaugccuguauauauucauacgcauacaagaauacuugugucugaauauauacaugugucuguauguauacauaugugcugcugggcaucgugggucuugccuuuaaccccagcaccaagaggggcagaagcugguggguuucugugaguucaaggccagucuagucuacaugacacauuucaagccagccagggcuacacaguaagacccugccucaaaaaucaaaauaaaauauaugcauacuuauguaccguagaucuguuuaugcucuuuaucaugccaagaucuccugaccaucaucaaauaugagcaaaaguaugaguuuuaagaaagauguuuuuaaaguguuagaaguagaaguguuuucucuuacaccccacucucuaugggcuguguguuuauccauugcaucugugugcaucuguugucuuuccugguggccuuucuccuggucccuggaacuacuugcgaugccuugguugggcgcggggauggaggugcuucugguuuagcuuggcugcagagaaagcuucacaccauuacaccgccuacugcacagagugcggagugauaagacacgucaccugucugugcagacaugcgucagaagcaugugaagagugcagccucacaguggggcauucuguaugacaggaugguggcacacacugucccuagcucaucgaggaggccccguguuucccuguauggcucuagugugaaguguccccacaggcucauguuugaauacuugguccccagaugcuuugagaaccuuuaggaaauggggccugacuggaaaguggguuccugggaccuggcuuuauggcugauaaccaugguaauaaccgcucgaauccacagugccacacucagaacgcgccccagagcacagagaaggcagagcugugcgaaccacucgggcaccaggcacuccacaccucucagaagucuguggagacccacacagcagaucacugggugugcacaauguuuugcaugcccaacuguccuuguuucccacaggaacaguuucaguuuggccauuaguaccagccugagcuccuguuuccugagccauggagaugcgagcaagccacugcugcgcguccauauccucauuccgugggagccagaguaagcccauccuccccuaagcugcuucuuccuggcguuuggucacaaggacaaguucagcaaguagccuggcagcgcuuaggcuacaggaggccuggaguauagaaagauggcuuccagcuaccuaccgugcucccacucuguccuccucagcaggguacagcuccggcuugcaccucuccugaugucacuuuuuugcacuugccucugugucuccucccuagagcaucuuuauccugugggcggggaccucccugcuguguuccccgggcuuccgaaguuugugccacaagagugguuccugaccauugugguuaaaugauuguaguuguggguuuggacaugaaggagcucucugugccuugacuuuuuuuuuugaaguaaguuauggauuccauugugacucauucuaaguggccuuccuacuuccuccugcaucuuucccagggucacaggaaguggcugccacugagcuauguaggugcagcugugggaggcaggaguuccugcagagggguuagcagggcucugcaggaucuggggagacugcugauacugugcccaaaguacugagguuuggcaaggcggcacacuugccaccuccuaugagcuggugggcugucuuuuccuuucccagugucaguuuggucccccaggguggcccuaguccuguuggaggcugaggggaaggcuaaguucucuuggaagccuuggcuugggcuacuugauacggcuuacuggagggacaugaauucugaguuucuagcacucuguugcccuugccuguucaacccuuaagauuccuucuagaaauggggauguuugagaauuuggucugcagauuauaggccgugcucccuugcuuauguguuuuucauugaugacuagcaaaguccguuggaauauuauuaauuauaccuacaguuuuugcuuuuauuugagauaaggucucauauagaccaggcuggucuugaacucaaucucccgaauguugggguuacagacaugcucugcuagaccagguuuaugcagugcuggggguggaacucggggccuccugcacgugaggcaggcacugccccccugagcuauauccccagccugugacaagcagcugcgcuuagagccuaccaggagucucucgucaucauaaccaucaucauccauaaccgcagcagagucguggcuccucuuuuguguggaaucugagagccaugguccucucuccacacuaugagcagagccacagcaaauaaguaguaggggcauccaauuggcuaccagguuuuauuuagagccauucuaaggccuucucugugaaucacaggucugauuucuauuuugaaaguuccgauggguaggaaugaaagagacugcugugcuugccguguaaagagaaugaagagcuggaugagaaucaaggccgguuucagacagcugugugcaagcuuuccugcuauucuuccuugcuccugucucacgggggagcaccugugcaugccugugugugcacaggccuguggaggccagaggacagccuuccacaagcaacacucaccuugggcuuuuugggacaggaucucuccuugguuugggacuugauucagcuaggccgucgccccguccccaacucugggaccacgagcacauaccacugaggaaagcuuacuguauguguguugaggugacaggcuccaucucaggccucaugcuuacacgguaagcuucuuaucaacugagcugugucuucaacuccuacauaggaauuucaugaggccagugagauuuguuugcuguuaaagacacagugguuuaaugagaagugugcucuuccuggaucuugugcguuuuuuaauguuucaaaccugggucucuuggguccagcuguggugcucugucguguacugaacacuguaacugccuuaagucaaggcagcuuucaguacgucauggcaagagagauaaauugaagagaaggaagaaagaagguggggggguaaagaaaggugaggguauggggagugguggaggcagcuagcuuacugagaguggggugccaaggcugaggguggagcugcguuucucagucaggggugcugggugcccuguaauagcagcccagccugggaguugcugguccuucagaggccauuucuucagcucugaaaaucucugccaagauuaaaagaacuguaagaggggaacggucuuguuucucauuucuccuuugcuacauuugcauaaucuuuguugaagccagcugaaugugaagcccuaaauaaauuccaggcauuuaaauauuuaaaaggauucagccacagcucucuacucacccgaagaauaaauguguucaacaaagaaaauaacacccucgcagaugcagcccggauagacuguguccaccuugucacugaauuagaaaacguuaacagcgaagcuugcauuugacgggcucugaaacuggccgugugccaaaauauuguuucccugcuagagaaagcgguggguguguuucaugcuggcagcuggccagccaggggcucugacgcaaucacucgguccccauaacugcuuugcaacuaauuuuagggcaguuaaauccgggugaugucugguggcugccgugcgucugguucaguggcgcuuucuaaauccauccuuuuagcuuggcaccacagcuucugguucucucuagaauaagccuggggcagaggggauguugagucagugagggaacacugaggcuggcagguggggagaggcugggcucaggccuuaccuugugcugcgucauggaggcaaagcucgggccaccgugugugugugugugugugugugugugugugugugugugugugagacaggcugaggaggggguggggcacaccgaggcuccaccuuccugcagcagcccucaggccaguuuuccuugcagucucuggucucugccagcuucacggugcuaaaaacugaauccaaccauccuuucugggaaauguaaaguuagaaaaaaagauaacuaaaaaagucauaaaggagccgcagcuauuuggagugucuuacagaggagaaccagagcuucguucugugugugggugcgcauguguguugaccuuugggccagucaaggacaccgccagugucuuuccacauuauuuucagcuaugcuggcuggccagagggacucagggguccuugugacuccauucuccagggcugaaaucacaaacaugugccaccuugcccagcuuuuuauguggguucuagagaucagacucagguccucaugucugccaguaggcacuuuucccagugagccauccccccccacaacucucacagacaguuuuaauaaugacuagggguuacaggcuacaggucugcuugauagagccauugauggauugcugaguuggcagggaaccuccagaguuccagaccuccaagggcagacagaguccuuuaccgcagcuccggcagagucgguucguacaguuuuagaccuuacagaaacccuugggcucuuucucagcgggauuucccuaucuggcuguuucagauuagagcuuccugcacugagggugcuuagagagcaaugggagccugagccugagcugagcuuuggaaaaugguugggauuuggagccuuuccaaguauggcacucauuuagauaggccuugaacucaugacagccuuccugguucagccccaugagcgcuaggcuuacaagugugcaccaccaugccagcgcuggcucuguuuuaaacuguauuucaacauaagcuguaaguacggaauccuugcuuuucaugacugagcacuuccuguuaccugaggugaaauuucuagaaugaaaugcagacagcuuaaguguguuguucauccugugaguuugggcaugcguguaaucuguuguaaccuaugcuucagucagggugugaaguguacugacuccccagaacgccucuccugucccuuccugggcaacuugccccacccccaccccaguuucuaguuuucuacugugaaguguugcauguucuugaggagauauaaauagcaacucaguuacaagggucacacucucagcucuguguggaaauauuacuauauuaacuuuagaucugccuuuaaguagaucacacacuuccuuugcucuccccaugggcucagggaucauuuucaguggccugcgauuucgggagcagcuuucucucucucaccugaucucuuugucguuuguacuccaauucccugccaagcagugacuuccugccuuguccaggcauccauccaccugccugguuuuuaccacugugcacucuugagacucaggugagucuggccucuguguccuggcaucugcacagggcuggcaggggcuccuggcacuggcucaacugcuuugccucugaagaugggucaguagagcucagcuguucagcugugugugcuauuuggaaaacuugaggcagaagaagacauggguguguccuugugaagcggaggacucauuuuuaguucaaacacaacaguugcuccaacucccugaauucaguuugaugaugucaucuguggaggacacgaaccaccuaaaccgggaagaccagauuucagaucugcugugcugaggugauacuggcgaaugcaggaaaaucucggaggaauuacaaguaacuuucagaccuaagagcugcgccuuugccacgccuuaguugccgaagccugggaugccccggccucuacagcugugagcaguucuagcuucuacucaauguuugcaguuccugguggcuucacguguuuguuuucagugugugacucuugcacggggacagguuggcucugguggguacucucccuggucaagaagacccacucgaguauagugcugacauccaagaagccuuccuuuguacugcacagccugaggucugugcgaugcuacucugaaccuaggcuccucccauguccuuccuccuucauaaggcuucauccccaucucaccaagugacccgugguccccacucaggcuugcugagaagaaaggaccgucugugagguggguggcuaagggucccucucacuuugcccgcauucuucugaugaccuuaccugaucccgggaagcugggaauuguuguuacugccaucccuggcuuauguuaguucuguggaggugacuccagacuucaugacuccuugucugagauugaugcucaugaauaaggcuucccugaaaccugccuccauagcaggugacuccugagacaucauguguuguugggaaagugaaccagugcaguugaugauccugggcccugguucauccucuacuuuuauccuacacuguaagggguguguguguguguguguguguguguguguguguguccauggcugugguguccacggcuuucucaccagagccucaguuucuguaccugugaacagggggcaguuguucaccauguuccugggaggagucugucagacacccaggagcaugcuuugcgauuuccgugggcuccucuggaccaggcucaggucugcaggcucagcccuuggugguagaaggcagcuugguguugcuguugggauucuuucaucgugggaagaguagacuuucuaacuaugcuuccuggucagucuuaaagucuuugcuauugaaggcaucacugcccugugcugcagaccgcaguugguuccauguggaggagggggaguaaaacucaguauggauaugagugagggcagacucuuggaacugcaccuaaugaugcuucuggggacauggcucagagaguguaaggaaagaccuggcuucccauuuacaauccagagaaggugaagggguggcuauuccaggacaggcguaacagugacugcuuucucaggggcucuggggugugcguacauucagaaauguuccaugggcauuucggcucugucccaccagcaggagaggacuucaggggcccgcuggcugcuagcaccuuacagugcccuuuccaggugucagcucaggcucguaguaguggccacuguggagcuuguggggccgucugugguugcccgagggcugggucaguguccaggggcugguaaugguguggucagcuuuccugggccugccuuaguucuccuguguguucuaaggacgugcagagccauccaugaaggcaauagacguucuuuucuuuuaaauuugagguagucucguguaucgagugagcucagcauacacucaucuccagcuucuaaucuuccugcuccugucuccugggugcuaggauuccauucccagucugcuuuuccacaucugguuucaugcagugcuggggaucaaacccagggccucacaauauucccugcaaacacucuaccaacugagcuacaucuucagucugacaguagcccuacugugcuguguguuaagacuauccagcugugggcgaccguuggccuuuucucugaagauagaaacauuuauguucuugaaugaaucuugguggcuuguuagcugauuagaaaggggcgggacccugguugaaaugacauuugagaacuuuucauagacuggaaggcaucccagccuuuuggucggccagggugaguuuauccccuucccccuuuuugagaugagccuugacuggcagggauuuacugugcugaccacacuugucucuacuagaggccuccgcagggcggggcagggggugggaucauggagugcuacacccaggccaagcucauccucugcccuucccccgcugcugucuguucagguguggcagcuauugugcugaguuugccccuuucucuaggaguugaguugugaggaccugggacccuccccaagaucagagcauagcugcucagguguagacugagcagagagccuccuugagcccuccaucugacucggggcaguggcuguggcuaaggagcugcaggaccuguacuauguuccugcugccguaguuugggacguauguguccauguauguaguucauacccuuguauuuguguguuccugugugcagaggacagaugccagucuuggcaguggcucuuaagguauugcccaccacucuugagacaugaucucugacugucauauuggggcuuguauuggagcccugaucaucuacacuggcuggccagugaguccagagaucugccugucugcuucccuagcucuuaagauauaagcaccgacuaccaugcugggcuuuauaugguggggucuagguuucaugguaggauuugaacucagguccuugugagguaagcuauuacuuugccaucugagccuuuuuccugguccaguuuguagcgaacaaaagaacagccuaaugguggacauggaaccugaggacacugucguugucuuaaguaaaauauacaccuguaugaaagcaggaaaacugaccugggagcucugggagucugauuaaacccaaaggccguguuuuaacuguccauggguggacaggcaugcacacugaccaguguccuugucacuugcccuucauuagcuggacucccuuccacucgugcuguuaggggagcaucagcagagccccggggacaaugaggugguguggcuuguuggccaccgguauggcugaccaugaguucucaguucuugucuucauggaggauuggggaggugccagagaaauugcaggucuuggcaacccuggagaagugguuuuuacauaguacccucccacuaaguguucuuucuguuauuguuggacucagaagaaaggccuacugggccacacccugaaucuggggagagucccgaaguucuggguucagauacuucccugccugaggcucaggagcaggcugugucuaguggauauagaaugguccugggaccuggaggcuugggcccucucaauuggggugaauuaauuuggcagaguaaaaacauuuuggcaguuugucuuuuuuguucucaaauagcaauuuauuuugagacagggucucucauauagcucagacugaccucagauucaagcuguugauaaaagcggauaaccuugggcuccugauucucugccucuaucucccaagugcuggugugugccaucucacucagugcauaccaugaggaucucucacugcccuucgagugaguagagaauugucccgugcccccaggaugcagcucaggccccugucagcaugagcuccuccugagcgccucuggaaaugccaggcagggcugcugcccacaggcauauucccuccacucuguggccugcccugggcucuggugagauggacuuacagacaggacacagaggugcaugggaugcuccaagggcuguacgaagcugccccagguugucagaauggcuggugucucggugaaaugcgugugcccuuucccacuucguguuugaagccaggaaggauccaggaaucagacaaaugcuucucuguuuaucaguuacagugaauuucugugguacaacucagggagaggaguuucccuccuccauccuccauccucacaucacccagucuuugaucccuuguuagccucuaagagcccagggcuggcccuacaccugccagggguuccugugucuuccuccagcaucacacaggauagcucugcacaggacagcuuuguacccucacucccggcaaaggguugauguacucuguuuucuuccagccccucacaggccagugcuucugagaacagaauaaauauugcucauuaaaaacacacagacaggcagugguggcacacgccuuuaaucccggcacuugggaggcagaagcaagccgauuucugaguucgaggccagccuggucuacagagugaguuccaggacagcccgggcuauacagagaaacccuguuucgaaaaacuaaaaccaaaaaaccccaaaacaaaacaacaacaacaaaaaaacccccaccaacacacagacagggcuggugcgguggcucagcagauaaaagcacuugcugcuugcugcacagccuggugaccugagugaccccaagaacucauguaacagugggaggaagaaccaacuccacaaaguuguccucugaccuuuccgcaugugccauggugcacaccacaugggauuaaucguaaguuaagaccccacagaguugcugccuuuaacagaugccauuuacauuucuggaaccacaguagccccaagcaaacaaugcugacagcuuaaggcgggaugaguccuguaacucuccuuaguggcuguaaccauucaaaugagucugaagacccacccacccccagugaaaugcaguuacacauuccaaaaagcaccaaguagcuauguaaagauugugccgggauaagcuugcuugcuucuugcuuggugauuaauugggguuggauugggguuggauuuguauaucauuggcaggagauguguccaucuacauaguucuuacauauguagaaugcuuaauacuucucaaagacucuguccuaaaggcacguugauaaaaauggaagagggguugguuaauugguguuuuuugacaccggguccuguuguguagaccaggcuagccuugaauuuaugauccuccugccucugcccuuacggcuaguauuccaguccagcacuguuggacuggaucagaaaggagguuuugaggcaacuucagaaaguucagugaagucauuucaaacuucugcucucagaguaaaacauaggauauuggauucucuuuacuccuucuuggggguaagauuuguccugugagcaccaugcuuccagauuguucauguuuuugcauucaguugccaacuauaaagaucucagucaucugucuuuauaaucuuagucagcuaguugcaauuccaguucugcaagaggaagacaggucuuuggugguuuaaggggaaugaucaucccaaauugcuucucagaggagcaguguaaaauguagagcaguaauggggaagaggugacucccuuugaagaguggguguggguugggguuagauaccaccgugacuuuaggaaggcugguuucuccuguguagcugguggauugcgggccucucagaagcuuuauuugggggcuguggauuuagaauggaaccucgggguccaccugcccagacgagccugugcugauuggcugugcgcuuuugcuacggugaugauuauuccccuguagcagaacaugugggaaugaagcccuuuaugacugcgagucaccugcucaggucacugugcuguauaauaaguagcuuuugaagaaguccgucaugauggggaaagccuguacugagagggcauguugaggagagcguguauauucaugguuccagggcaucccuuuguguuuauucuguuauuuuggaguccuuacuguguuugcauguggucuguccccuguaucauuucccucugggacuuauaucccugcugagaagcugaggcaaccuuuuucuguauauuccaagcuagugguggguacaagggcggggugcagcugcacuuagaaacgccuuugcuaaaagacugggcuccucccuuggacgugggucacugacggcugaaagucuggccucucagccaccugguuacacauaagccuguugaucauuuaaggagcaucugccuaaacccagggggccugacuuaccccuuccaagucugggacacaaacagcuuguuucauugugcagcuuuuacagcuuccuacuccagaccauggguaccagagagucucaaguuacuguccaaacuucagucaccauggauucugggaacagugaagucucagacaaauagccccaauguagagacuagggcuuuauuucacccugaucucccaccaagauggaccaucucuugggggaacugagagauauuucucuaucaguauugcgauaggaccaagcagaccacaccaaggcugcuuauguguccacucagacuggugaggugcuuagugguuaaagacaguaccaagcuuagugacccaaguucagucccuggaauccaccugguagacgaagagaacugacugccaacauuuguucucugaccuccacaggccaucuguagcacaugugcaccccuucaccacauaaauaaaugcaaaauuaauacacuucucacaguggcccaguucuuccucuuuuaaaccuucagcugaagucagugcccagaggugggcugagauccucguccucgccuuccuaccuuguuggagagggagggcucaguggcuaagagcacaugcugcuacccagguauacuggcacacauccucagccccaggacuuagcagguagcagauaugugugaguucuaggccagccucauuuacagugaaaaguccaagguagccaagguuacauagagagaccaugacucuagaagaagaagggggagaggguguggggaggaagaagaaagagagagagaguaggaaaggaauggaaaggaaaggaaagaaagaaagaaaaaagagagaaagggaagagaaaagaaaaaagcacuugcuaagugaucuugcagaggacugaaguuugguuuucagcacucaaguuggguggcucgcaaccagcauagcuguagguccaggggaucucauggccucugaggacagcuguaggcaugugcacauaccucuccacagauguacauacacauacacacauguuuauaugcacauuucucagcacagauacacauacaguuauguaauuuuaaauaaucuuucucacuguuaugcuucaauuuaguuuuugggcaaguggcuggacuuaauuuguugggaagccucagauuuggggugcuggccuaggacucaggaccagcuaaccccuguguaugcugaagaccuugacauaggcaguccugcuccauccuggggggaagccuggggaagaacgcaggagggacuguacccaccccuccaggcuccgcagcgucuagggugagcuuccugagcacugagccaaguggaagaagcucaguaauugugugggaguuugcccccauuaaacagccacagcuggcuucuguauaaaaguacugaauaaagaucgauugugaggugaagaguguuggcagugggacaauaaauuaugauacuccacacuaucaagucauuuaugucaauuuaauaccuugcuauuuaauggugugggagaacguucacagaauguuaaugcuaagcagcauguauggucucagugucccaggaaaaugagauaugcacauauuguuagcacaagacuauauuaaacuacauuaaacauuuacuguggauguuaguugcagacauggguauuuuuuuuucuuuugcuuucuagauuuuuuugaguggaauguacuaauuuuguaagagauaaaacaugcuauuaauauauuagagugagcgaguuaacguguguccauuaaaaaugaucagucguuuuaguauuuuggauucguuuucuuucccuauauaaucuuccuucuuauuuuuucuucuuuugaguguauuuagagaguuuuaaagacaccuuuaaaacuucaaugucuaauaaaugcuuucugucccuacagaaaacccuggugacccgagggucucaguguaaucuccuaucuggagguccuguccagggcuguucucuuguuuguuagauuuaggcacugggguuuuuaaccuuccaaguguuuucucuccuuuaagcuuccuacuucagaauuccauauguggauauuuauguauuauauauaacauaauauauauauauauaugcuuaguuuagaagcaccacaguuaauucuggcuguuuaauuuuuuucacuguuaguaaggagccaccugcuggcuuuuaugugccuccuguagguguccuuccugagauucgaucuccaggacaccagggugaagggccacaucuucuuucccaaguuguuacaaagcauagauuuuugguacuuagugaaaacagccuugcagccuucucuuaucucugagaacacagaugucuugacucagaaaauuccgagggucuuuuuagcuguauaauugccagcccuuugauaccuugcucuuugacauuuacauuaaaaauaaaaauuagcuaauuuguaaguuauaaggucuuaaaaaauaguucauuccucucucaugccugugaaugcuuccauuaaaacucugaaauggcuuauuaaauuaaaugcagugucaaaggcuaauugucucucugugaauuagccuacgugcuguaggagggccugguuuaaacauuaccuuugaguucugaaguccauuuuucaaaucuauccauucagaguguuuggacuugagacaucuguagauugugaagccccuucugugucauaagggaagccacugcacuuguggaggcuccaaauuggucaaggugcagaggguaaccgacagagcccucggucccuaaacagggugucauggaccauucuccacauuuucccugagguucaagagacacagagaggggcuggaaaggaguucuguggcaggcaggacguggucugugguggccaugcauugagagcucacuguugcugcugcacaggaauggccuucauuccccaugccugggggaggaguuuaugggccucugaccucccuaggccaaaaaacaaaagccacagaaaugggaggggacuguggagacaauggcuucagcaggaaagagggaaugaggggcaaaaaugcccaaauucagauuauauacaagugugacguuaggucauuaagaguacaugggaugccggugacacacucaguguucuacaccaacuuccuggugucccgagugugaaacaugagugugucuuuggaguggcagagcccagccuggcaucaucuccagucagcagguggcagccaucccugacuaaggaaacagacagggaguguccaggcaguuuguagccaugccauaucaguggagaaccagaaaugcuguuuucugugcucuuguucuaacuuagaaacaguaucucacaagucacuguaaccucaguaggaugaguggagugugaggccugaagucacugucccaccauggucaggaugcuguggugaucccguagggugagucugagcagcagacucccagguuuccauucagguggagauggcaugccugagggaagcucuugagcuucuagugacagagugugcuuagucccagcacaggcuguugggcacucguaaguaagucuucugggcaugaaugaucuuccacgugugcuggaaagcacggcuguucaggcuggcugcugugcagagaaugcaggagcuggguggucgggggcgggggaguggggucagggacaggggcauucaggacaaccaggaaggagagccaagcgagggcuuuaaagucagaauauccauguugggcucaaggcgaaggucugugugauuggugauagugaacauuaggacacaggcuuggagaaacuucccugacccuugcugggaaugacccuguuguuuggcuaccucagaagccccccccccccccuuucagcucugggauacagggucuguggaagggcgcugguuccccuggcugcuggauggaaccguuugaagagcaccauucccuaacccuaacuauagccauaagucuugacccugaugcuaaccauaacccuugaccuuaaccccuagcgcuaauccuaaccauaacccuuggcccuaaccacaacuauaacccuaaacccaaccauacucauaaccuuaauccuauaaccauaaccugaccuuaauccuaacccuagcccugaccuuaaacccuaagccuaauccugacccuaacuccuaacuguaaucuuaaccacaagccuaaccauaacuccuuacccugacaccaaccacaauccuaacgcuaaccccuaacccuaauccuaaucguaaccuuuuccacacuccuugccaugacccuaacccuggcuccaaccugaccccuaaaccagaagugcccugugcucgcaguguccuuuauuaaggguuagggucccuccugcugcaguccucuggcagucacacauaccugcugggucugcugggucugcccauggugcucuugaauugaauuccuuugaauugucaccauaguguucuagacuggccagcagacaggaagguguugaagaggccacuuucagccaacgugaugauguuggucaguacaaacugcacuuaaaaaugcagacgcugccccuuuugcugcccgcagucacacgcucaguggucacgcgcagcugguugcuaccacaucagacagcacgauggggcacuuucaugacugcacaagacucucuuguuugauaguugcuguccauuagucucccagccuugggccucuggacagaguccauccuuuauuccuccuggggaacacauccagggaugacccucccgugcucguacacuccucacagggccagaggucugcagcaccccugccugccucucuggcugaggucuccucagacgcaccugugcuugcuuacccugguuagugacagacacauccuuacugccuucagagcucccuuccucagcuggccucccuuccucauuggcuuccucggaaucucuaaacguuucugagcccacucccucagaaacaauugucauaaacuucaaguacuccacauauuuuugaagugacaucuaacacuuucaucacacauuuaaauagugguucaugggacauaggaaaagaccaaagccaagaugggaguagugugagcacugaugcaggugggauuguccuucacagugucauuugggagaacugccugauuaugaagugaaugccaugaagcugucaccaaagccacaucugaucuggugugaaacuuuuugguauuggggaaaauuccagguguauugaaaagcucuucaucguucauugguggaugugcaugccuuuaguccccacacaugggaggcagaggcagaugaaucucugaguucaaagccacccuggucuacagagugaguuccaugagugcuagggucacacagagaaacccugucuccaaaacaaaacaaaacaaaacaagagcagcagcaaagagaaggacuucaucuuuggcucuuugccacugacccccuuggagcauuuaacccaggccacauuugccagguauacaucugcccccuacagcaauggugccugugggcuucaggccggguugauuauuaaaggcuuguaguggucaagguucugaagggucuuuauguaaaguccuggaaguguguagccaugcugcagugcauugugggagauuuugaugggaaggaaaggaugcccaccuguuccucagaagucucgcauggaagugagggucuagaugcucgucaauuccacacacaaugagugucagggaccuuggguccuugugucuucagguugguggcucaguggggagaacaguuaguucuaaggcagguuucucuguccuccuucucccucggaggugucagggccacgcuguagaugucugcucucuaacuuaggauauuaucucucaugaaauuaugcaaauacguagucauagacaagaaauacaaaugucaguuucugacagcuguuucagucggucaccccaguaucauagguccugaaucccagagcacuggaagcucccucuucuaucgcucugugugugugugugugugugugugugugugacugugcgugugagacugugcacguaugugcagggguggaggugggggguaggguggugauuuugccuucaggagauccuccuaccugaaacaagccaagugaauguuuuuagaguguuagucucugagcuuaccaucuccaacccucccacccugcgccugugcugugauugcuuuggggucacccccuguuccauaugucauccauaaacucacuagcgccccaggguggaccuugguguacuuguacuuugauugacacuggaguccuauaaagaggguguggguguggacgcacgccuuuaaucccagcacucgggaggcagaggcaggcggauuucugaguucgaggccagccuggucuacaaagugaguuccaggacagccagggcuauacagagaaaccgugccuugaaaaaacaauaaauaaauaaauaaauaaauaaauaaauaaaauuuaaaaaaaauuaggcuugguacaggacgugguaaugcacaccuuuaauccucuaacuugagagguggaagcauguguaucugaauuugaggcuagccuggucugcauagaacauugcagcugaccagggcuacauuuugagauccugucucaaaacagaaccccacaaaaccaggcauauuacuuuccuacucucuuagggaagguaacuauaaaaguugauccuauaauuguuuucaaauucugcuuaauauagcacaagaaugcaaagagacgacuguugcugauuaccuuacgguaacuguccgugcuguccaugugacuguguuacuucuccuucccagggcacagguuugugcccagcgucuggagagcucugcauaugugcgagcagacccagcaguuuuuuguuuuucugcucacugagguacugcccugcaguuuagcaucugauaagucugaagcgggcuccaggggaaggguuucuuaucuagcauaggaagauaagugcuuggcugguggcucguugaauguucuugggcaugcaccuuugcagaacagggcaggauugcccagcagugggccuccagcuugugaugucuggcagaaauccugguaguggaagacccaggcccugcugcuggcagaacuguauuuggcacagcucuggccagugcuguggggagacaggguacaaggauggucuccagguucuggggaacucugcccugugugcagaaccaaccaggcagcuuccccugaugagcacauggaguuguacgccacaggcuguggguuuccucagauacuugggacgguauacagaacauagugcaacuuccccagaugcuaaaaauguuccgcucgcaguucuuacagguggggcuugucagcaccgugcagccucgggucuccugccuggguggugagccugauagggcauagggaugcagguaagggaggugcagggcauaggggugcagguacgggaggugcuaguggaucaugcuccgugguugguccgacugagcccauaacagcacaggcucggagacagggugggagugggggugcagcuacagaaucugcugugagacuguagccauucuaguggaacagucagcuugcuaacaaguugucagcuguaaugugugacaccgcuccucucccccccccccagccacugcuguuaauuuacacaguguauaaucugagucugaaacccccuucugcugcaccccagggcuuaaagcacauuccuaauguccuguuucugagcagaaucaauuuuuuuuuuuuuuuuguuaagggaagaaaugugaucagagcugguggauuuugggucaucaaggaaauugcacaauaaagcaaguacagaguuaaauuuaaacagacaggcuucgcuuuauggcguuggaaggucuuuucuuggggguggcuagucucuagccagacaguagccugguucuguagacggucuuaggagugcucaggauaauucuaggucagacagacuugcaguggaguuguccuguggccugggccagcucugccugguuuacuugucccuucacagguuaaacuccuagcuccccgagaugaugguuuuaggagguggcuccuuagacaaagguggggcaugaggggugaguccugggcaugggauuaguaaccuaugaaggagaucucuucuaccucaggccuuggaaacagcauguaucuuucaugacccagaaaguggguacccccacccucugccucuggcuuuguccuuagacuuccagccuccagcacgggcuaucucaugcuacuguuacagcaacugggcugucucauguuguuguuacagcaacuggacuagacugagauuucauaucacacuuauguguuuauuaugcagcacgcaugccuuaaaggacuccaggggucuccaagauggcugcaagcugugcuuuaaaggagugccacacacagcgacagugugagccaucuguuguggacacccuguggucaagguuucauggagggcacagagguugcccaugcuuucagaggucaaggcauaguguuagcuagcauucugugugacuuuguucaaggcuccauuuucccuguacaguccacacuagccucuccugcuggaccaugcaaagcaguguccagcuugccaugacuuccacaucgucuugucaccucuucaggcugaaaucaguucucucuugucaucaccaagacugguggccccugacccaugccccucugcuacuucucccuuacuucucgccuuccugcccccagguugcuucuccuguggccucuauccugguacuugcccuuccuaccccauuucuacuuggccaucucugauuuccugugaggguucuggauauggccguccuguacccucagccuugcaugcucuugucacaccucuucucuguuugcacccaucggaucagccaugcuggcuagagcucugcuugccagcucaguugcuggucagcacacugugggaaugaaugaguggccauucuagaagcaguucaguaaccagcuuucccaugagcagaauuugguguaagcuuagguauaccaguuguguguguguguguacugcugucaccuuuaacuuuaguugccuuccuaggcuuaauauuuauuaggucaccacacaaagcuguuggguuuaggguacuugguaagguuagucucuuucccugaccuaacucugauaggaacuuuagauagagauugguuggcagagccaugcuccuugucucucauuggcuuuugacugaggaagcuggagccccaccuccccccuugguucugaugacagccucaggaugaggcccuacacccaguagucucggccuagagcuggguaggacguggugagucuggcggucuucuaacuacacaagagagugaagaaccugggcauggagccucucaaaggugggagacacuucuugcuaauagcagcugcuugcuugaaaucucuucuucccuagaaagccucucaguggguaaugaacagccgcugcuucaacacagggcaagcucugagaagcacugcaaguuuguugaacucacccugcccuuccacugaagaauguugauguuuuuaggauacauuguugacaugauuugguugucuugugacuucuccugcggagauaaaaagagaugccuaucuaucccagauagacccaacugaccaaagaaaagauuuuacccaaguucaccuuagggaauccuuuagccacuucuggcagccucacccuagcaggucccaccccaguugauuguucgccucugguuugguggagauuagaaucucaggaagggaacggccagauaaggucuugugaucccaccagccuuccacaccauucccugggggauguuaacaagcugggucucuugcagcugggucuccacagcuuugcugcuccaagguggccaugguggucauguugcucagucaagguggccaugucuggcccagcggcaguguuucaggagacaugguggcucugccugugcaacccuauuuucuguaguguuccagagucguaugaaugaaugaaugaacgaacgaacguaguccuugcauguaacacaggcugacuccugguuucagucaggguccuuccugguguuaccugggucugugcugccgauuucauucaggguccuucccuaggugugacugggccugucccacaaugucugagcucauccuuggagccaucucagcugacgaauccucuuacacagaggugugugugugugugugugugugugugugugugugugugugugaagauccuguuuauggaaaggaaggauucgagggugaggucagagcacacaggauuucaggguccacacucccccgccuccucacccaccacugccucacucaggucuugcuuggccugggcuguccuggcuuuauacucuguccucuguguccagcuauccccucauucaaagucuauggccgaccagccuucuagaaggaacucucagggugcccuggugacuggaggaacugaggaagcagccagggaggugacaagaaucccacucuugguucccaagaguggaacccaggagagcgucggccauggggcaggcauggggcgggggggggggggggcggggggugucauagcuuugugauuuguuuuauuucgucaacacuugucuuauggugguuuuggauauucuugcuuuggagaaggagucucacuguagcuguagcuggccaggaacuucaggugacccuccuaccucugcuuccugaguccuggagcauuggcagaggcagcucugcgggacuccacccguccuaaucuguucccagggagugcugacacuucucuuuugagacuuugaggaacaaaguucaacuucaggugugugugaaacccuaucuugcucuaaggguggggguggggugggaagggacgccauucaccucacagauugauugcagguauucccuaguuggagggauucccugccagaaguuagugcugacgcucaggcucaggcaggcugugagcagaggggcccugcccuggcaggcugccucuggaggaauggagugagcaggguuugaggaaggugacagcugaagggagucaggagcugccuggcagcagagaacacuggggcauggaggggcgacggcuucugcccuccaccugcccuugcucuuucugaagggagaccgagaggccacucccuuagcuucaucuccagacuuaggcagggcacgcagcaugguuguucucuuucacagcuuaaucuccagccacuaugucagagugaggugucuuuggcccaacucucugugcuggacgccagcuaagguaggguuaaguguccgugcgggaagguguagucccugagagacuggacaccgggccuuguaugcugucuacccagaagaguccaccaugcacagugugaggggcccuggggaacugggagugaguggaaccugggaaguggugugccuaccacaggcucaucugagugagcccuuuguaacuucuggaauagggcauuugagagguugcacugccauuugccuuuugggaacuguguccccacagucauccugccaccugugagguguaccacaggugcugcgacaugccaggacuccugucugggguuugcucccuguguccugcucugccccuccgucacugccuguaauacucgcacucucuguacggucccuguguagucgucucagggacuaggaguuuaaaacgguuccaugauguuagauuauuucaggagagguucucacgagcuccaagauggcugguguuaaauuuaggcaucuugggcuauucagggcugggaaagcuuugguggaaagaugagugcugggauuuuucucuaaagccucaaaccagagcagugugagacaggcagggugaaggccacaucaagccuggcucuggcccgugccguccaaggccguucuccagcuucuucccacgauucccucuaccaaguuagcuccucucaucagaugguguccccacucagccccucuugcggccuuaccuucucuccaugucacccccuuuccuucuuauucuggucugaggcucagccccuaugcugucagcuauguggcaucugucagagucaccuacacgaguccauuuuaguuggcagaaggcaaggaugaggucauaggaagguuagggggaggggagcuagugugccuggccagggucagauggauucauuuucucugccaguuaaagaauuaaaaggcaggagggaccugaaacccaacagggagccgcagagucucaagcgcugcaaacagucaccagugaaagauuuaugggggaaggaaacacagcgaacacacagagaagacccucugcaaagcagaggcuggcacucagaaaccacaccaaaucgaaccaccaccaccacacccccacugccgcugcugccaccaccagcaccagcaccaccagcaccaccacuaccaacagcagcaccagcagcagcaccaccaccaacagcagcaccagcaccaccagcaccaccagcagcaccaccacuaccaacagcagcaccagcaccaccagcagcagcaccaccagcaccaccagcagcagcaccaccagcaccaccagcagcagcaccaccagcaccaccagcagcagcaccaccaacagcagcaccagcaccaccagcaccagcaccaccagcagcagcaccaccaacagcagcaccaccaccaccagcaccaccagcagcaccaccaccaccagcaccaccagcagcaccaccaccagcaccagcaccaccagcugcagcaccaccagcugcagcaccaccaccagcagcaccaccaccagcaccagcaccaccagcaccagcaccaccaacagcagcaccaccaccaccagcugcagcaccaccaccaccaccagcaccagcaccaccagcaccagcaccaccagcaccagcaccaccagcaccaccaccagcagcaccaccaccagcugcagcaccaccaacagcagcaccaccaccaccagcugcagcaccaccagcugcagcagcagcaaacaacgucaagucucuucuugggggcucaaaggcuugaggaugaaacucgguguuuugguuuuuuuuguuuuuuaauuuuccuccuaacucaggguuggucaguuuaggggaagcuaggaugaccgacuaugccagaacuguguggcaaguccuggguaagcccugaacuagcugagcccauccaucggcagggggucagaugcugagagacaaaagucuacaaggccuagaagguggcaagagggugaggaagaagcuggccaccuugcagauuuaccaccuuauugccucgccauggcccaucucucuccaguuugugucucacugccugccacacagguugauggagguccuggguccugaaugccuggguuggggaguuguuggcauagcuuuguguugaggagguggcccaggaccugagugucaugcuugcugucugugcaugugugcacggggcaggugcugcagaccccacgcccacucuguagacccagcccuggcucguccaugggacaucugcaccuguccugugcacugccgagauuuuugccucuuggauuuugacaacuuguuaggcaguucuugccacucugcugacuuuggagaugccuagcaacguuuuacaguuuggacagguucuaaucacuuuaacgaaaccauaauaaaucauuuuaugacgagaacccuggggacaggaacucuaagcuggguuuuggguuucucacgcaguggagcuucccuuuuuaauaaaaagcaguccuagaugcagucaacaggagcugccuagggucaguccugccucccagccccccuggagcagggcugcuguggcuggaguucagaagcauaaccuguaugagcugccugacuauuccccagccucugucccaggccagggacucagcaaugugggacccaaggccucaguuuacauuaugaagacagcucagaggcaaaggacugcuggagagaauagagcccuggcuuucuuacugcugcuuuggugcagugugcgcgugccaccaugguucugaacagaugaguugaauaaggcagacugcugcucacuuccugagcacagccaauccaggcagcgaucugcaguuaccugggccugugcagugggccaacacgguuaacacagagguucccaaacuuagaagcuaaaucccaaggaaccagauuuccuuauucccacuggcccugacuaauuuguuuccauuuucuccuuauacuccagaaacaaacaugauuaaaaacuccccuucccuccccuccccucccucccccuuccuuccauucucuucccuucccgauaaaacugaaucuugaaauacuagugcauaguuuuauuuuauauuaguugaucuuuuuaguuuucuaaaguucucuaaggaaaguuuggaaugguucuggauugccuuuauaaaaacauuaucuuuuguuuauucuuuagcaguaucaugcauguaaacaaugugccuugaucgaucaccuuuauccucaguucccccuccacuccucaggcacucccaacaugucacuccccccuccccuucauguucuuuaaauguuuuaagucauuaauuuaagauauauuuuauuucuagucauauguuuguguccaugugugagugugaacacgugaguggacagaucugcagaggccagaggaaagaucccugacccuccuggagcugugcuuacagaugcuugugagcugcccagggguggaugcugggaaccauugaucuucugcgagagcaauacauauuauaaaccgcuggggcauauccaccugugcucccccguaccauuuaaaaauaaccuucugagcuuaauaaguuuaauuagugcuugcugggauguugacugaugcuuuugacugggccuugcacaggugacacagcugcaguccgucuguacucgcagucacacuccugguccagaagauaguauaucauagacuccuccgguccucugguucuuagaucuguuucuacuccugucucccaugguguuccugguccuuggguaggaugaauguugagauaaauauccuauuuagggcucacucaguaggcguuauucucagcacuuuggccaguuaugacccauggcauuaagugaucucugccuauugcagagagagacuucucuggucaagguuaauggaagacuaauccauggguauaaacauaaguguuucaaaggcagucugaugaucugucuuaugccaaguugacuauaacagguuccccucuagggcccaugaccuccugagccaugcuuuugaccagguuugcaguauaaggcaugaguucucuccuguggggcaggccucaaauccaguccaaaagcaguugguuauccccaggaccuuugugucacugucauaacaaugggcacaucuugcauggcagguauuagcauuauaguaguaugguagaaugcaggguccagugcugaguaagaucagauauauuuucucccccaguggccugggcagcauuuuccaguacugugaaagcuagcauguaguaggaagaaauuuucagaucaguuuuagcuugaguuuucuauauccugcgaccaaaguaaguugucucuuuagcacuaggucuuauugucuaguucuagugggugaccaagaacaacagcaguggcauguauuguuuugggaaccuuugguaccuccacaaccaaugacuuacauagcgguauccuauguccagaacuggaauuuucaucugauaaucgagucuucuacaggaaaucuucuagaagacuuccuacuuaacuuugugauaaucagcuuucucucuguguguguguguguguguguguguguguguguguacacgcacgcacgcacgcacgugcacacucuguguucauggaugguguuugugugggagucuccauggaggccagaggucagucuuaacugucgucuauggcuuuuuggcuuuuagcucugccuuuugagauaagaucucuaguuugucugguguuugcuugcucugucagcuagacggguuggccaaggaccccaaccccagccuggggucacgggcacaugccaccacacuugggugcuaagaauccaaacuuaaguccucaaggcuguucaguauucaccuuacucacagagcuaucucccugucccaacguuuuauacacacacacacacacacacacacacacacacaagagaguuuuucuuauccucuggugucugaaguccgggaaucugucgaaugccuaaggaaucaccuuuuguuuuauuuuuacauacgaaccaaaacuauuuccauuugaagccaguagacucauguauaauaaaauacuuuuuuguguguguuucuuguuguuguuuuugaagagguaaauguuuuagaugauguaagucuucuccccaaauaagaaccuuugagaagccagcagcagguggcccugcuccacuacaccaguuuagaaauguucaccucuggagacauggcugccacucacugcuccaggagagagugcagaacaaacgugucuuggcugcucauuccucagugacuucugucugccuggcuucccguuuuuaauucuggcaguaagcgucugcgaaugucugcuaaauauuccucccccuaccagacagccuccagucaggcugugugcgugugugagaaccgauaauuuucccucccuccuccucccuggugguuugcucccaguagccaguuuaugggaauagucuuucagcagugauggagggagaggacacaggacucagucccaggcgcagagucuaugggaguggccuuccaugacagguggccuuagaggccaagagucuugccauuucaacuguguugcauuucuucgugagugucugaacauauuuuaggaaauuaaaagugagaaugggaaaggguuaggaagacagguuagucugcaaaugcuugcuguggaaguaugaggccugacugaccccaggacccagauaaaaaaagccacaguccugggaagcagagacaggcagaguccuuagccuaacccugaacuccagguccguugauagacugucucagaaagcaaggucaauggggaacaacacccuauggugaucccuggucuucauaugaguguguacaugcacacacacacacacacacacacacacacuugggacaugaaaaguguacuuguucuacuugguucucacagagaagagagagagagagagagagagagagagagagagagagagcacuaagagaaagcccucgcuguugguagcuagccagagaaagggcuuacaagacaaaaguacuguagaagcaacgcggguucccaccagacacggguuagaguccaagcacagcucugcccguggauggcacguggacccaaccaacugcauccuaggcugcagaggcaguucccuggggauuccaaagccuaucaggcagauggggucagagcuggcacagcucacauccgcugugcaguuacaacagccuugggcugccuggucagugcaacucccacggggguggcuccaucucugaccugcucuaguggaaaacuuuacuaccaccauugggcaccucugcucugcagugcaaauagcuggauaauuuucugguuuagucugggaaacgggagcguccaaaauacuugagcuccaggcaggcagcugcuaacuuuucauuaccacaucuucccauucagaugccccugguuacccauccuuuagaccagcaucugaaggcagggcccacagaaggcaggggccucugcaguucacccucuguugucuguaguccaggaccaagagcaccacucccaccccacauacacugaguuacugggcuuuuuuucucugcuagaccuccagaggggccgagguucauugccuuuucuauguuguacauugcauggagacagccuggaagccuggccuguuugccugcaugcgcaccugguagaucucgguugccccuggcuacugaccuggugcaugugcaccacacuggacaucgugucucucucugguguucaggaaguacagggucucauuccagcuuucuuguggagcagccaggccuagggaggagcggcuguuggugaguagcugcuucuacaggcuggccucuggcugugcacagcuccugacuacagcuucuggcugugcacagcuccuggccaagcucagcuucuggaggagaugcuggcguuugauucacguggcugucgaguccacugucuuuucugugugcucccucccccuuccagaagagcgucugagcacaggcuugcucuccuccucugucagccuugcuguugccuuguucucagugaacuaaguuucuuucuccuuuaguuguauugagcuuugguaacuuguuuacugucucaaacucaggcugugugcaaauauaaauuuccccuugauguaucuugcugucaguuguugaagcuuaguucuugugggcauuccugagacaggccgcagaagcaggcagugguaaaacccuggagugaggguagacuuggcagagggauucauuacuauucuuguugcugugguuguggacagaagcaacuuaauggaggaaggacuuuugcuuccacacuggaaagaucuggucugucacgggggcaaggcaugcagcaagagcaccuagcugcuugcuuucaucucaguggaccaggaaguaaagaccagacaggaagaggguugggcuauaaaccucaaggcuagaaaccugcuuccuccuaugaagccccaccuccuaaagguuccuaaccucccaaaacaaagccaucagcuggaggccugauguuccugagccuguggggggcauuucacaguaaagccacaucaggagaugggguggccugucacauuguguguccuggggucucaguucccuggugaggcauagggugggagagugggaaguacuggguguguggaucacacacauacccccauggacucaggagacccuguggaggaagccuuugccggagacaugcugcaucucuguguguggcaucccugucaccccauaagucucgcaucaggaagcaccguuggccgagcagucaguacuucaggaaguaaauccgccuuuccuuuggaggugauagugagaaauuguuucuuuuucucaugcguguaccucacgcaucucacuuuuaugaaccagacacagucacucagcaucccucccuuggacgcagaaaaaccucauuucuccugggauucguguaguaaaguuguuggcaggauugagcaaauuucucccuggaaaacauccaagccugggaccaaguaggaaacaagucugugcccacucaagugucuggugacaacugaacuguuugcaaguuaugcagaagauguuuuuuagaacuugucucauccucaggguuucaauuauuuugaucccuccucccucccccgacuccagaaaggagacugaggagaaaaucccugcgaagcuaagcccgagugacucccgcuaugguaauuaauuggcaggaaaaucaauaauugagugagaagucucucagucaguggugacagagacggugcagugagaugcuagugaacuugggagacagcaccaggggcagggagcuaauuggaugaauuuacauacugcaugccucuguagugccugggcugcuagucagucggagacucagagacccaaauguucaaaccucuuaagcguuugacccugaaagaagccucagugaauagguaucugacuuggugaauuaaaaugggaccaccuuugcauugucugucagacaauucgaaaauguuagcucacuuccuuucuucacagagcaaauucuuucccauucaucgccccuguguguuuccucaagggagcugcugccuuaaugauguuugaggauacugacucugggccaguuuaauuguagguucuuguuguuuguagguuuuuuccauccuuacaaaucauugaggaccucagagauguuuguuuuguuuaugugagaucugucaguagucaucauauuggaaauaauaaacaaguucacacacgaggagaggcugcgacucacucagcacucaucccaucaaaagcucugcagagcccaggcaaggcaccgugagaugucagguaccagccaagggcggggccgauggugucaccugucugaaggccuguguucuguguaagaagcagggcaguucuguuuuccuuuaaaacaggcgcuucauuccuucucuuuaagcccucucugagcggccucuuuggguaagugcuccacaguuuacucucauguggcagguguguccugggacaaaguagcucucugauuccuaggucugucccuaggugugaucccucgagggauagaccacaggugcuguggagcucaagggucaagacuuuauaggaccacuuauuuuuacuugucccugaacaauauugaaggagauagucuaaucaauuuguagauaguguaaguuuuuuaaauauuuaaaauuuugagauuauaauauaucauuacuccuuuucuucccuccaaacccuccugugcuucacccccucuggcuugcuuucaaauucauggucucauauucucucucucucucucucucucucucucucuuguguguguguguucuuaaauauagaauggugcuugcucagucuguacaguguuguguguauguauucucagagcuggccguuugguguuggagaaccacucacccugcuuaugugcuccuggcuagggaagacugucucucccacuguuagcuuccuuaguugccugcaguucuuugucuagggugagaccucuugagcuuucccuuguccacauuagcaugucuauugaugccuuccuuguucaggucuguuuccacugacauguugguggguaguuucugacauuucuaggaaacaccaugucacagccaacucuccauuccucuggcauuuagaauugcucucuccccucuucugcagugaucucugagucuuaaacuuaggaguucuguucuagauguuaaauguuauuuuauguguauaaguguuugucugcauuuguauauguguauauucacauaugugcagugccuguggaagccaaaagagcaucagauccucuggaacuagaguuacagauauuuugagcuuuccauguaaaugcuaggaaccaaaccuauuuuucuaucuagagacagucuuguuauguggcccagauggugaccgaggaguuuguccuguuaugucaugugacuuugcccugugcgcagaggcuugucuacugcugacacagugagaagguccugucuuggaauuagugugaaaaucguuagauuugcauauccauuaggagcccgagacagagcccggcauggucuauagcacgugguuugggggcugcuaccuaagaugcagagcagcuagagagccugacucaguuggcaaaaucuacuggagacacuugaggacuugaauuggagcucuagcuggggcaguggugccuguaaucccagcacccuagaagcacagggcagaaggucucugaggcugcugacugcgcgcgcgcacagcugacugugcacacacacacacacacacacacacacacacacacacacacacgcauacuagccugcacacacauacaaaagcacauaggaggugugguaagugaaaagaucaagauuugauuaugugucaguugaauauuauagaaauagacuagaacucuggugucccuuugugggcgagaguccucauuauagacauuuagucaccucgcaaccauacggagcggugggaccugccaggguggcuacugagcagaugcuuucuuuuggggacugagugaucuccauggcugggugacagcacggaggcccuccccagacauggucacuugauccuggacuuugcagaugcagaggcauguaaacuuaaugacauggucuguggccuuuuguuauagcagcaggagcgugugaacugcuaaggcauggcacugacucccgcagcccugugcucuggacagcgacuaagugcccagcacaugauccacugaauagcuuugauagucugaacaauuugaaggacuuagauccagauagagaguguaaaaacaacaacaacaaaaaauguguuagugcauaaaccugaguccaggguagacucuguuaugcaguaaagcaucagugcugugagcugugccugcccagccccccaccuuccugacucucuuucacucuguacccaguucuacuuguccauggccccucaaccuccaggcagcuguguggugcucuccugaaguacuaggcacaguuagaaaaacugaccauaggauucugacuggacugcaggaagcauaagggacuuccuguuggugccagcugagcucacucucaguuccgcaguguuucugcccugugacaugcucuguggguguccgaauugugugcacagagcagggaacuccacuugugugaggcuuugccuagaaggauuucuuaguaagaguuuccccgguucuccugccuuugacagaaucuauccuggugauagcaguguucaauuuacucuuuugugggucaaagccaucaccuugugcuuugguuugugccugucuggaagucuuugggauagcauguucccugugaguugacauuuugcccugcugcauucuccucuaaguguugcugaauuugugugacugcaagaagggucucuuccaguagcuuggagcuggagaagccaugcagccuggugugaggguccugcugcucccacaggagucugugcagucuguagguguggagaacugggaccuagugaugucauacugucuuccuaauggugucccaaggucccagguuccuagugagaggacaugagggugacugugguuggagguagauuccccuggcugcacauucuacacagcauucuggcagcagcagcucuagacacagugagccucacuugcuuuuccuauggaaucuuccugggcuggcuccugaauccacaucgagccauccuuaacuuuugguguuggccucauguuuugaaauauucccacucgguuguccuaccugguuggcugaguauaguuauuauuuuugcaguuagaggcaccaccuuuuccagucuuucucaucacacaguuuccuaauucaagcugugagagauuuaauucaguucuguaggcguuuauaggguguuugcaagucgguagccgcauuauuacaaaccugccuccuuguuuuccguguugccuggagcccuuugauuagcaugcuccccaccagugcgcugagccugcuccucccccucucccuugguggguuguuaaggcugagagccuccucgggagaugaguggcccaggcucacucuuccucucuacucaacucucuacuguugcagugcugcaguuugcuguuuggugggcgcucagagcuuugccaggccuuucuggagugggaagucaggaguggaagagaacauaggauccagagggggaaauggcucuucgccguuaccuuuaccagagcaauagaauacacucaccuguccgucacagagaaauaggcauuaaauucugauauuucuggacgcagugagcuaccaaaugguguaaaagcugauucucuugcauuccaucgccagagcuuucuuggaacuuuucucucacguaauugguugcagacgcugggaauguaugugaugaccuacacccuaggugugcacaggguuaaaaugugagcaguuugaacuuaggaacccugcucugugaggaaguacucaguauuccucagccaaaaucuuccccuccccccaggaaaagacaacuacauaauuucaaauggauacauucacugauucucuucaagaguggcuuagcccgugggggacacagccacacgaguuuauuuucuuuuuuuguaccuuucuuuuguugauggagcucauggggagcucauggauucucauuuguguuuagagggaaugguaagcagauguguaucaagacguccauguggcugugagcucugccccacugaguguauagacacaggggcagcagaauuggggaaaagaucagccucagcggugcgccuguuaaagacacccacaggcaauuguuuaaguuggucuuuucuuaguuuguuaugguugcucuuaaucugcauccuugaaauagaaaauacacuuggauuucacgagucugauucauucuccuugauuuaaugagcaccacugaagguucacacucugggcacccgggcugaacacguucaagacauuguucaguuggagcucaaaucagccgcugcacacagcacagcacagcacggcucccacugugcugugugguccagaguuggaucagagcucagcucuuuagauaaugaauauaaaugauaucuucucguuucuaauguuuagcuugucuauaagcaggugcuggugcaaacuagcagaugauuguggaagccuaggucagcugugcgugucagguccagggccuuugcuguucccggguagguaugucuguguggugugccuuaccucuugacacagagcauccugugagugagccuacaucccaugguucuccagguuccuacuccacccugugcccaagccacugucugggcaugagaaccagaguggcaggauugguagcuggcuggacagaggguuagaaggcuguuugccuuuuguguucauuacaggaagagcuuuuuagcauuagugcaucgggaauguauuuaacauuaguguagcaggaauguauuuaacauuaguguagcaggaauguauuuaacauuaguguagcaggaauguauugguucugaaguuuuccuuauucauuuuguguaugguaaaugcugaaagaggcagagaauuuccuauuccacauaugccugugauaauaauuuacugcuaauuaccaaaaagaguuaauaucauaaaguuggggacaggauaaaagaccauggcagcagacagugguuuugagucuaagaaacuugccugcuuuuguuaauucacuuuacaacuauuuuuugauuccugccaauuacaccucaggcuacuaccuauuuaaaaacucacaguugaguggcacgggcguuaaaggaagucauguaagaaacugaaaaugucagagcagaaaguacagcauccuuggagagcagaggggaagaaggcauuaggaagcucuuuaacuguauucugggacaugccagagaaguggagagugaaggucuuuaaagccauggaggaugcuacacagaccugagagggcccugugagggaagguauaggcccgagagacugcuuuauauggccaaguacugaaaggcugagagaaugcccugggagaugaagugcugucagacuaagagaguucucuguaaggugaagguccgaggguguccucugaggugauuuggagcucagagugcucugugagguaagaugcuuuauguuuuagccuugagugguaauccuggucccagguguguccuuauuagcucugcucugagacgagaggggcaggucugacugaguuuacuaggugcauaguaaagucaguguacauguaacugguaguuuccuaacagucuuuaggugaaggaaugggggccucucugguaucuccugcccuacaaagccuuuccuuuucucugugucuucuuccaagucaaguaugacuuccuccucuccaaugaggaggaacucaccagaaaucucuucuggugccaucugaggacacugggauucauucugugggaagccuggccaggcguuagagagugauucuggugccaagaguuucauccugguguagacaacauguaaggcugcguguuggugcuagauuugcuacauaaauauuuguuggauauuaaauagcuucaaagggucucuguguccaguuucucuuccuuuccugaguaacuugaaaggaagcagaguagucaucuuaaaccacccagauuucagugccauugauguugggaauuccacaagaucgugauaugccucagugcagugugugugugugugugugugugugucugucugucugucugucugucugucuguacuagccugggugaguugaguggucagcaugcuaaacacauacuaucgucaggaacguuagugcccaaagcacauuuccaggaagacugaugccaucugacguacuaaaguccccugguucccacuguccuuagugcaugcgaucuacaccgagugcugacugggcaagcugggcuaagucuguguugguguccagugcugauuguucacgucaucaucguaucucagaguggugaagggaauguggaggccauccuagcuguacaggauucugaggggagagaugugacucuuuugcugauugcuagagcuucuaaggucugcgcagaaaugaacagggcgugcuugacuuagacugaccucaguauauugacaaggaacuuugguuuuauuuguuuucauuuuguguguauguacaugucuauguucuuaacaugcagauguauggaagcauaggucagccuuuggugucuuuucuuaaguuccguucauuucauuuuaugaaacaaggucucccacuagccugggguccaacaauccagcugggcugucuggauagugugccccagugaccguaccugucucuuugucucuaaaucccagcacuguguuuguaggagcacaccaucaugcuugacuuuucuuccugaguucuggggaucgaacucaggaccucaagcuuacauggcaagcacucuacacagccccaagaauuuuacuguuaaagaaaaaaaccaaaccaaaccaaaccaaaccauagccuugcuuagaugcuggauuucccugcauaccagcagguugucuucucaccguuggcgggagagcuacaaggaauaacuguguguuggugcuggcugcacuuccucagaaccgcacuuccucaggaagccugcggguaggaacaagguguggggaggggcaugucugcauggcuuguuucugugcagagcaucuugugagguguccccagcacagaccuaggaaugcggaucuuccugucccuucccuugcauuccaguacauaacaguugcuggggaagacccaguuuuaggugcuccccucccccacuucccagcccagacagagcccuuaccucauuaagccaccugugaaggaggaaguguggccaggcuccagaguccucauugaugcuacucagagaaucuguggcuuccuuuccuggccauaaacaaaagcagcugaaagaaugggcuuugcuucucaugggaugcuugcuaugucaggggaaggaaaggcgcuuucucauaauguucaucuuguaggggccucaccauaaaauacagacaguaacccagaagugccgugugaagcugacuauuagcagcagacuuuucgaguuuguguuggggucucauaauacaugcacacgaggacacaugaggacagaacccuccuuacaggaaaauuggaauauugaucucugaaaacagcgaugcuucagaaaugccucucucuuaaggucuggaaggucauacuguguucgcaagagauacuuguuauucgcagugcagucaugucucccgcauaggucucccuggugacggcuccauguguccucuugcacagccucaguggcagagaacaucacaacgcagugugcucuuguccuacuacaauggcuagaagcuaggggcugccugugggaacugguggcugugauagguggacagacaggccagggaacacuuggauaggaaaucuuucacaaauauucugguguugggggucauuauauuguaacauaagccguuaggcauuaucaaguaaauucauauauuuauguagccguucugucugucugucugucugugguuuuccauaagacuagaauucugaaccugcuaaagcaaccuccuuaucuuccucccucugaaccuaucuauucugcuucugcuuugagucuucacuauuccuggaaccccauggaagagaaauggucugucucagccuuugucccuuugugacucauguaucucacuuaguggcccuggagcuucagucauaaugcaucagacgucagaauucccuuccuccuuaaggcugaauaacauuccauugugugaaugggucacacuguuuauucacccaucaaaggacacuugggucaguuggaacgagagcuguugucagaguggcuagacacugcuagagcaguguuuuuucaaccugugggucacgucccgucuggggucgccuaagaccgggaaaaacacagauauuugcauuacaauucauaacaguagcaaauuuucaugaauuaugaaguagcaauaaaaauaauuuuuauggucaccacaauaggagggacuguaucauagguggcagcauuaggaagguugagaaccacugcucuagagccacuguaaguucuuuggaugcaaauccuggaucccauggcaaggcugagggaccugcugccugugccucugauucugagccucagaacaagaacgauugcucauugaaggagaaacccagcugcuccgaggggcuucagugacuucucaucagcugcuuugcgcuuccuaaagauggaggcagacugaggaaggucgguuuucuaaagcagaggccagugacagccuucugcauaagugauaagcuugucuucaugucguaguggagugguucaugaagguaccgcgucagcacggccgcuucugagcaggucgguggggauccuccuuacugcgggcugccucaucuugcuggaagccugcucgugcuccuggguuccuucuggucaguauucccuccuugcugcaucuuggcuccuugcgcuaucauacaggaguguggauuuuaggaagcuuuaguuugcaguucuuauagcuacugcucugaaauauaaguuguggauggagaagcuugugaucugaggagcagucugacuucaauucauauucauucauagucuuccaccgcccccaccuccugucuccaccccuugagugcugaauuccaggugcacugcuucccgagguucagaacagaacccgggcuuuauccgugcuaggcaagcacucuuccagcagaacugcagccugggccaagaaccaagaaggaagugcuucccugagcaccagguuccucguccagggaagcaggguggccuguggacucugccacucccuucuuuccuucccuuuccuuuuaccguagguaggugugaguuuguaaacaguaucggaacugucaccagaugcaguugugauuuaacaggguaaucugaaacacccuucuccuucuggucuugguguugccuccacaacacugagaagugacugugaucauaaaggcugcugggggaugugguugauucguguugcuguuuccugugguagaauuagaacucaggcguuuuaagaguauuuauuaaggcuggagaaaugggucagugauaaggguccagguucuaaaugaaugagugaaagagaaagagagagagagagagagagagagagagagagaaaggaaggaaggaagaaagaaagaaaggaagaaaaagaaagagagagaaagaaagaaagaaagaaagaaagaaagaaagaaaggaaggaaggaaggaaggaagaaagagcgagcgagcaaagguacaugauuacuccuagguaugauggaggagaaagucuauuacagauauaugggagagucaaggguagacaugaccuugagcucuguagggagagggaaccagguacaacagccuggaggccgaaaggaacaaagagggcagguaaccaaaaugauuggauuauguagggaaagcagcccagcucccuaggcuggagaguucaggguagggggcaggguccugguuaacugaaggguccucuagcagcuaggaacugaggaaugcugggaaaccugguggccagugucugcuuucauauguuaaauagcaccucagccauucauccuggguuugaaaccaacagguucccagcacccacauguggcccacaacaauguaauuccaguuccacagaaccucacacccucucuggcuuaugcacauaaauguaggcaacacacucauacacagauaaauacgccuuucaaaguacuucuugaaaugacagugaacaggagggauguaugggaaaacugacaaaaaacccuucaccuucuguuauaaacaauauuuuacaaaaauaauuuguccacggcaagagcagcguugcccaaagacuguguguuugcaagccucugccaucuggaugcagagcggaccacuggguucucuuaccuacuuuucgcucagccuuugacacuggcauucaccucagcagcucuguuaguugggagaggaggagacagaaccggauaagauagugcuuuguguccuugaugggccuggaucugacauccugaggacccuggaaggagcucuggucacccagggauucugagcacacugagaauuauuguugaaauuucccucgggaaucugaccaggucucugucuucuccugcagguuguugcugcugcgggcugugagcuccaggcucugccggcggaaguugcagucuuuuuagguaaguggcugcaggcugccgugcaaaccaaguuacccucgcagcuacuugguguuuuaguuguuugacuccugcaucccagucaugguucuuuggaaugguuugcuuucucgauguauugcaugcuguagcagguguggugagcagggcucacauggguuccuuugaacauuaggauugccuaguggcaugggaguggggguucaaauuuagucucugaugaguuucugugcgucccuugguguguugagaggaugugcacuuuauaaucaguuugugcaucuccguggagagagugucccuuagguaacagggaugcagguaagcauauuauugugggcaaagggcugccugaaguccacuguccuggacaguucaggacacggugggggcugggggugcugaggugagcugccggaagacagauaggccagaugggagugacuguuggcugccccuuucagccuuaagucaagguggcauuucccccucccucacaugaacuacagaauacauggaaacggcaggaagugagauaggucucugaaggagccugugucugcccugccucauaaguccccacucacacaugugcacuuuuguaccucacaugugugaucuuccacccuuugcccuuaagaagaugaguguauguuucuuaggaguaaacgugugcguucagucacagcaggucagcuaucagccuugaguuacuuaguacugacccaucugugcuccaucuguuaccagcaucccaguucagguccccaucugacacagaguaccaguccuucacagcaucauccaccuacauccaguguccaguccagggcucggugcuacauaugacugccauguuucuuguguguuuguguguguguguguuuaucugucugucugugugccuguuucucucucucucucucucucucucucucucucucucucucucucucucucucccucucucucuguaucugucugucugccuucaugcuccuuugacagcuguagcugggcuugccuuuauaauguugucagggcaaguguuugaacaagggcaggaucucaccaccagagauggcagcaucaccacacacugucgugaucacugcacaggaucagugcgugaggcucauguguguggugagcuguggaagucucuacagaagggagugacugcugaggagcggcagcagaggccaggauggcuuuucugacauggcggccuuguucccuccugauaggaaccagaaggcaccacccacuuccugugcucagggaagcccuugagccuaaggaaacucugauguggaaacagcagugcagagaggcgaggaaugcuccagugcaggaaguaggcaggucugcaggguuuugguuuaaggaaggaaccuugugacacagcaucuguccuuccagugccaugggcuccacuccagcugggugucaagucggugcugucaaagccagguggcuggcugaggcuggagcuaccuggacauagcugagcacccuuuggcguuuucucaccuacgagagcuguggaaagcagcugugcuuggguuucuccaccuggaggacccauuuccagaccaacgcuuagugggucaccuguagggaagggagguccugggcagguccuagugugugcuuuaggguaagugguucugacuccugccagagauguuggguaggcaucuguaguguuucagaucauaguuuauuguguuauauauaagaauauuacuucauucaacccagacaugcacuggaggauaacucucccaagguaacugauacccauggacuuccuguaaacuuuaaaaguggaacuaauagcucagugggugaaagugcuugccaugcaaacccgacuuccugagcucaguccccagaaacaacaugguagcaggaaagaacucuggucuccauguaaugccccccucugaccuuuauccauguguauauauacacaugugcaucuauaugcuaguagauggaaggacacaccuacugugcaccaggcuugcaaugugcuucaguugggaagguguuuacaguccugcauuauaaggacuacuguuguguucucccucccuuagcgaaaagcuguugagucguccgccggcucuggguuuaugaaugcgagggcugggcucugcugcagaacacguuguaauuucauaagcuguuuccuuucugugguuuguuuguuuauauggaguguuuguuugguggcagcagcagaggaagguuuccugaaggaggcauucacugaagaacaauggguaguguucaggcuuugauuccuugugaaauaacuguuuucguuccauggaggcuugucucuguuaauuaaccaugugucugagagcaguuggggaaucugccacaucccgaguaguucuaacucaggcucuugugcuucugacucucuaggggcaaagcucuuaagaccuugggucauuugguccccuacacaccuaccuggccaacccccacuuugaaagaugaacagagacccuaagcacgugguccagccugggaacuauagcauggaaucagugacugacagacuucucuguuuacauuaaacuacacuuagcagccauccucuuuuucuuuaagucugucuguguucuuggcauugcuacuccugcuccacauccugugaagaugaagaugagcugcuuggaaaccagcuggggccucagagugagggaaggguugcaucucuggcuagaggacuacagcuuugagccauuuuggcacaugauauauguagacaaacacgcuaguacguggacuuuguguguugguggcagagaccuguaauagcaacauucaagauacuuaggcaggaggauugugaacucuggacuagguugggcuacauaugagacauuguuucaaaaaaagaaaaaaaaaaucccaacauaauacaucccaaaacugaguuugguagaaccugauauuuagugacaggaaccuucacugugucggucagcagcugagcaaggccagccaauugucaggguuuguuuauuuaaccuugagcaauuugccugaaccuuuuguuuguugcuggagauugagcccagggccuugagugaaaccuagauuuaagugcuuuacauauagcaaaaugcacuguagagucacacccagucagugaccuguggaaggggacggguccuggucuggugagccuccuccucuagugagccgugggaagcaccucaugugcaccccagcugcugggcuucaggaaugcucauuucaaccaucacucucaagguuucugaugaguuuuauuaauggggacacuugccacuacugauauagcuauuuaacuaauuucugggggagaaaauuagcuaaauuguugguaagaacacuuaaccaugaucuauauguccgugugacauaauuucuaaagggaauacggugaaaauucaaucugagccagaugggacugaccacaggcagccaacacaagugacccugaaugacuucuuccaccugggaagagaugacuugcguuuuauggccuccuuuugcucugugccugggaaucaaugcacuuuccauucugcugaugagagccucuggugagaguggcuccaggguuccugggcuaucucagcauuuuuagccccaggguuugggguaguuaggagucugcuaagcuuuaagauucaguaacuucuggcacagaaguuaaaaaagcuaauuggcuuuuaaagaaccuaggguaaauuugccucugggccugcagcacuguuacugguaguguuaggauggggcagggcccuagaagcccagagaggcucagcuuggcuacuguccucacuagagcacuuaggaggacaagugacagggaaagccaagaaaggagauuaguccgaguggccacauggagagagaagaggagcccagauguccagugacucgcccucccuucucccagcuuccauucuucagaguccugaccggagguuuggguugaauugagggcgugugugcacagcuaagccgugcuggucaagugugguuccgcccaucucugaccuugcucucagcuccugcccugcacagcgaucugacagguugucagagcugugugguaucucuuccugggagacaagcucuuccuuuggcuggcaccggauaucagccuuucccuucaugagguuacuuggaaauuccaguuucucagggucuaccccuccaauguucugauagcugggccaugggaagaggacacagcaucuacagaauacccucauuagccuguccaggacggucacagggugaggauguccuccagggcuuggggugagccaucugcagcgucuuuacuguagacaaguuacuucucuccaucuuggacgugcccugucuccauaauaagaauucauggcaaagauguuaaccucuguguugaaaaaagaaaaugugaaugcuaaguuaguaucagggauguaggacuauugaaauguggauuuucaguuuucaguuuguuauguguuuccugcuucucagagugaagucuguucaaucccuucgugcacuccacaagguuggugcuauuaucuuuugguuguguagacugugauggcuucgacacuaauaauggcuuacucuagacuggcgugugugcaugcgcauauauacauuucuaagugcagucacacauguauauaugcucacauggaggacagagccacccucaggugcuuacacucuugaggugccauacaccauggguuuuuuuaauuuuaauuuuaauuuuuaugguuuugcuuuugguuuguuuguuuuaagacagacuauugacuagccuggugauaaacucucuuagaaauaaacuaguuggucaaugaaccagaggcccaccugugacugccucugagcuguguguguguuaucacugucucccagccgugaccauauauguugucacugucucuccagcugcgagcucucaugcugggcuuuucuacuccgguucuugggcucaaacucagguaaguccucaggcuugcauggucagcgcuuggcaagccugagacccaaguauuuuguugccugcuuugcugggcuggucagguggccagugcugccuuaagcucuuagcugcucagucaagacacuuuuuaaagcaucguuguacuggaagcaaucaauguaauaauaaaaucuauguaucagagaggggaaaccucaugccacagugcguguguggcggucagaggacaacuuguaccgucaguucugucuucccaucuuaacauagguucagaauccaacuguggucaccaggccugcaaacacuuuaccaucuugccucuaagaaacuugaaaauccuguauuugguauuugagagccaaaucacuggugagcugccagcaucuguauuccuagacuuuccugggugacaggcaguggagguggagaagcugcuuuggcacaagagaaaauuagcaagaaccacgguaaucgucauauugcagguauugccuucaaagagugagaaaguucucuuuaguggccacgacuaugugacucauggguccuggcuugacuucccuaugucaccugcugcccucucaucuucauggagagggugugagggcugacgcgguucacccucugagcacacagagccugugggaguguccagcgaggaaggcagccagccugagggagcugcagccuacccuccuuuccuguccuuugucuauugugagaagcuuagcaugcagccauuacuccugugaucugccugccugggagccgcacuauuuuuaggaacuucuccacacaauagguuuauaaaaaggcuauugagccuuuuuaggcucuguguucugucugacaaggcugaguuacaagcaggcuuuccugccucacugcucaggagggcacgauucucucuucuucuacaucuucucugcucuuacuuaguuguuucuuccuuggaaagugcuuggagacccagaggucugcugguccuguacagcuauggcaggaaucuggggagcacucuguuguauguggagcacucccggugucuguggagcacacugguggauguggaguucuccaguaucuguggagcacucugugcaguuucuccagcucuguuucacacacacugguuaaguugcaguuuuuuauuucuccucuuuuaaaaaugugcuaacauaugcacaguuaguggugcugcuggggaaagugaacaagggagcugguuccuccuuccgagucuuucgugucuugaguuguuuucucagaggaagggaucccauuggccuggccugaugaccaauugagaaagcaaguacuguuuauuauuugacguuuguuuuaagagaccacuugggcuggggugucacuagcuuaguuggcagcaugcuucucuagcgugaaggaggcccuggauuccauccccagugccacagaagucaggucugacaucccagcacuuggcagguaggagcaggaagaugacagguucaugaucagucuuggcugcaaggugcauucaaagccagccuggucuuuaugagacccugucucugcagaaucaaagaggaugagaaagagcagucgggcaguuggaucuuguuaguuucugauuuuacgcucugaauauguuugcucaucaggauggaagggcugacuugcuugccaucacugaagccugccugccucuuauagaaccugacgcucuccugaggccacgggauagacuggccacuucuuccccuugguaucucucaguuaagaugcuguaccaagcaaugcacuagacuucacgccgugagacugacuuuuucaaacacacaacuaaaugaagaucauucucaaacuaacuuucuucuaggugauuagucaaauaaaguuguuguuguuguuguuguuguuguuuuuaguguuaauuguaggaggugguagacgagaagcuguccauauaacccugggauacuugcagagggcuggccuuccaggccuugggauauguuccugggaugucagccacuguaaggacagguguacagcuguguggagggcuccacuuagguuccacuggcugcauuugagccauccuucccacuuguccucuccagugucugucaugcuccuugaguuugucaguggccuggcuggcaucugguugauauuaauacauccuugggguuccucagguaccuggcucuauggcaccugcucacuucaacuguggaagcuguuuagugauuuccaaacaucaucuuggccccuagauccauuaccaaggucacugcacagagcauccuguauccucuucccuguugccucugguguugauuucguaaguaaguuuaggguggggcccagaggaugauuuuccuccaggcccuccagagggcauuguccaugugacccaucagggguugaaccauaaaagcccagacaauaaguagcugagcccaggguucuuugcucuguacuguuggcagugcagaaggcccacaggcuuccuaagcugcccucccagauucggcggcuggcuuugcccauccagaucgucuguugcuggagggcuguggcacagggugacuguggauguucauccagccccagaccacaggcugaguggacucucaucgaaugcguuuguauguugaauuacuacuuauuuuggccgccaucuuggucuuuuugugacuuguguugucgugcuuacuuuugcacgcugaugggucuaugaacugugucuuauuaaagaacauagguucauuucagggaugcuucagagccugguagggacaugucuaaacuguagcuuaauuuacauuucauggugacaaguuccucuuuguaaaaacaaaaacucaaaacauuuuugguuguuuuuguuugcugagaaagacucucgguuuguagcccaggauaaccccccccccccaaauagaauuguccucccuucucagccuccuaggugcugauauuccagaugucagccacuauaauuagcuuauaaaucuauguaaauaaucaaaggacaauuucucagaguugaucugacccucauucuaccuuagcauaaauuagcuuagggagcaggacggauaaucaagaaggauguggugaugagaaggguccaguccauguucuuucccuuucagcauuguccugaucucuucacauggaggugggccuccucuggggagcgggaggagggagugccugaaaaacgacucuucauacgagaggcagggauguguacaccacgacgccaugcuggcuuuuucugcacugcuagagacugagccuggggcccaugagcacaugcuaggaaaacacuucuccacacuuucaaacucgaggcagggucucacagaguuggucauaccagccuugaccuuugcucccccugcuucugucuucagagucacagagcuggagcaaagguagcaagcauuagccaaggcuccuuggacgucagcucgggguuuguuuacuuuucuuuauagaaaccgggggcucugaaaucagcgagucugggaucccacacuguccgcaugucuuaucugccugaguuuuucaucucuccagcugugcuaccuuccauucuuucuucaagaaauucugucuuuguagucgcuuccauuuccagcugacuuacaacuuguuacugauguagcccagggcccacagccagaaacuuccaucaaguggaggccccuggcucuaucuaggccugacccucuuggugcaagccugcccaugugagacacuugaagaggcugaggcaaguggcuguuguccuucuagaccaagagggaccgaccagcagcacugcuccucugagagcccuggacagacgcuggaaagcagccuccaucugagcuguaugaccugagguaaacaccugcucugugggcagguggaguaaagauggccccugagaucuuaccuccuggaacacuagcucuccaccugugcaucacccccccccccuuuuuggcaaaccucuagcuccaaaaaauauuugcauuaugauucauaacaguaacaaaauuacaguugugauauaacaguguaauaauuuuaugguugggaucgcuacaacaugaagaaguguuuuaaagggucacagccuuagagaggaugagaaccacugccuagaagacucauuagugacugaugggaugcaguccagugauggagacgcuuccgaagggucugaugugacuguaauagcuaaguuacugguuacugccugucuuucugguaucagcuaguagguuuagcuaguaggcagcuaguagguucaggugaagggucugugguacacagugacaucuuccucaguagucucuguuggaagaugacauugcagccaucauacugucaccugugugagaacagagaaccugggguguguguacauauucauguacguguacauaugugcauguaucugcauuuggagguaagcuaggccucuucuuggaaagucuccagcuuauauuuugagagagucuuucacuaagucuaaggucauugguuaggcuggccauaagcuccaggucugucucccaauugcugggacugcagacgugggugcugaggcuacaaacucaucaaaauccacauuuugugacaggcccuuuaucgacugagccaucuagugagccuuugcauuuguuuuuuaaaugcaaacugaauucuuuggugaaagacaaaguuuauugguugcuggugccuggugguugagcucugcagaggacugauucagccuggcaggcuucuggugcucucuucauacucccaggggcuggcagcgggccagcugggccuuggcucccugcugggcugggaggacuacucucuggggucucuuggguaaguucaggcacucugcuacuuuauauaauugcuguccccccucccccacccgugggaugaagacccuggagugugaaauuaacacaucaagugaauuugauauugcaguagccuugggcuaguuuuugcaaauuaaauuuugcagaaauuagcgucagccuugcaaaggcagcauuaauuuagugcuguugacacugaacuguuuccuugagacaggagggagguggggguuguggggggggguucauacuaggauaaugaaggacccuggcuauguaaauuuucuguuugguuaaaaaaaauacaaauaugccauuggcuaaaaaggcuugcccaagucaaacuccaggaaauauugcacacacuuaaagauaaugggacaugaacauaaggcugaggugggucugcaccacagagcugcugugauaacgaagcucgcuguccugaccguaaugagaaugccugcacaggagucuacaguacccagcgucaccuggcaccuggggacuagaacacgagucagcucugcagaggcuucaggauuggacugccuacccaggguuccuuccugucuggaugccaaagcuugcucucuguucauaugccaaguccuugucuugugugugcacguguguguagaggccagugaucaaccuuggguuucucacuguccaauauuuuaaaaaauuauuuaaauguauguuugcuaguaugauguuggauucccuuaaagcagaauuacaggcaguugugaguagcacagcacguuacaggugcugggaauugaacauggguccucgggaagagcacaggugcucuuaagugcucagcaucucuccugcccaccucuuugguuuuugaaacagggucucucuggccuugagcuugccaguuuagccaggcuagcuguccagugccccccccaccccccaagaauccacuggcuucuuucugccucuccagaagaugacaagugagccacacaggugugggagcagugggcacugagaaucugagcucuggcucaugcuucaguggcaagucccuuaccuacugagccaccuccagcugcuccaggccuuuccagguguccuuugucacguaggacggucuuggucucuuuacucuaccugcuggaggcauuuguuguuuucaguuugaaucccaggggcugauccuuccaggucccgugguggggagggggcagguuucccugugggcacuacaggcagggcucuauuugcacagugugucuggcaugaccuuuccagggcagcagcugcuacuguguuugggcuuagucucagagccaauggcacucuggaugugggauaguaagucacauagaaagcccuugucaggguacuugaacuugugauaaaacuguggucaugcagguaccaggggcuucugccucucuugaucaguuccuagcaacaaacaauucauuuggcuaguuagcccuuuguguuaggcagguaagaaaguguagccaggaauagaguucucagguuucuuaauccuugcuucugugaggcagacagguguguuauugguaaugguaacaauggguuggucccccaagaagagagcugggcuuucugaggcccugugacauaccagagacagcagcugagaggagcauggaaaggggagcuugguuuugcuuuguagucacagggugguacguagguguauucugggcucagagucugucccuguaagacagagcacuuugaccaugggacguaagaguugaccucagugugucagagccaucuuuggaagaacucuggacagaaacucaaaguaggcacuuggagguaggccuggcccaccugcuaugccaugcaguguucucuaaccagggaacucacuuuagagcugagaaguacagcagauaccaugaaagaugcgcuugcugguuugcucaugggcuagugcuuagcuaaguuuucuuaggcagcacaagagcaccuacaggugaacgcugcugcacaguuagugggcugaacccuccucucugccaauuaaaaccaagauaaucccccacagacacacccaucguccaaccugaugcaggcaguuccucuccggcuaugucacauuaucugggaagccuaggagggcagagggcugauucuucccuuaaacuuggccauuggaaauuacuuccuuacuguuacuguaguagaaaguaguugacccuuugugagccugaugauaaaaauaaacuaccaaacucugggaacguguaagccaacagcuccugcagucucgaggccaggacacacaacaagcacaguugcuguagaccuguguugcugcaaggaagcuguccucccaguguggcaggaucagcuauguguguugcagaaguaccauauugucacgaaaauaguaagugcuucguucuucuugagugagugcauucugaucgcagaaacagcguggggggagccugcgugccauccugagcaggaguaaaaacaucacuauuuuuagggaacgcagcagaaaggcuuugguggcacagaggcuaggaaaacaguuugauaaaaauaggaccugaaguguaaacacuuguuucuugguccuucuuuuagcacagccaugggaaggaaucaucucugggguccuugggugagcaugugucaguauguggugagcaucuuugugcagcucguguguccaagggucugcuugcugguaagguauggcuaacucucagauuucugucccuuugucaugucuuugugucccuccugugacugcauucaaggggcucagugguugcuaauacucaccagcuccucggugugccuuuccauggugauuucuuuuucuuuuccuuuuccuuuuccuuuuccuuuuccuuuuccuuuuccuuuuccuuuuccuuuuccuuuuccuuuccuuuucuuuucuuuucuuuuuuuuuuuuuuugagagauagucucucacuggcccagaauucaccuguccucucgucucuguguagcaucagaauuaugaguaggcgcuccaauguccagcuuuuugauaugggaucuuggguucauucuuaggucuucguacuuacuugcaaggcaagcacccuagaaaccggcccuucucccuggcacccauuugaaugucuccguggucuugcauauuuuaaacaaauuacaaaguuugucuuaggccacacuugcugugugucuugugacauugccuucccuguuggaggucgagccugccugggugugcagccugccuggguggauguuggcugaguugauggagccauuggugaugccggugagauugacggucugcuucugccugcccacagugacugugacaacagcucacuaaggcacagucagcuguuuuccaggggcuucucagagugcuucugccuaguggcaccagggcagucaggguuauuucuugugcaaaugaagguggcugugaggcuccugagacuggcaguccuguuugacuaagcuaagcuacccuggcauugaaauuucucuauugguuuggaaaauauagaagacaaaaaauacucccaggcuaaagugccaugauaaagucuggcucacgggugacugaauaggaauguucacauuaaaaacccugagaacaguaaauauuugacucgcuguagcauagccuuccuccugcguuacaucuugguucuuucagccucugccaggcuugcagacagcugauccugggaggaaugagcacuuuccuuugccugcagcaaggugccaugggugacccgauguaguagcuuuaucaguaaggauuuacacacagcagcaaaaguggauggacagcagcaguguuuuuuacagugugagacaagacccuuuucagggauucgccuaucugguccccaugccugccaugaagaaauucccuguggguuugguuccuccaucaagcacaguucaccaggagccuccgucucugaaguugacuucagaauggaugguccagaagccuuccuucuugcuugucaucuaugauagcauaggggugcccgcaccuucccacaugugaacaccacacacauaaaacacacauacaaucaagguuaacaugaagaagaagcaggguaaaacugaucauguauuugcacguccaaacuccaaguucagguuggaccagcaggggccugguucauaagagaguuuuuuccucuuaaguucacucaucuguccucagugaggccgacagugaccucacuuauuccaaaagcaacaucugucuacauaaacuuuccacaaacaggacacugggcucagcacuggccuucuuggcaccucuguggcuacucccuucuguagcugacggucaccccaaaccaccacagaugccuugaagugggccguuuucaucugggauacuuucuacagcccaaagcaggugccuuucagggcacaguuagagccugcugcuggaagagcaaguagguggacaaggaagggaagaaucagaggagagccucagcauggaagugcuggagcccgugaggugccugccgggcagaagugcagggcucugucccuacagcucuucugagguggugcacucucagcauacagggcuggguccuguagccucuguaguuacugcaagcaucucuguccuuugucaguuuucuccaugccucuggcucuccaaggccccuuggucucuguggaggugcaugccucugcuaacauucaccugcccgcaucuuuucuccaguccugugcuaacccuccuuuccuuacagccuuccucucuggguggaugccaucccuguguggugugccaccuccuugcaguuugucugggcacaggcauuguacuguguuccacuuugaauguggucuucacaaggugagcagcugucucucuucagggacacuaccgcagugcuggcuugcuaccagucugagcaagggcuuaguucauguuugcugcaagaguaaaugaacagugucuuaauugaguuuguucuuguuuguuugugucuucugugagucuucuucgcacugugggaagguaccugccacacaauagagccauuuggguuccaaguucauugugaauugagcaaaggcugccaggagacaggaagaacggaggggguuguuugcagucugugcuggucccagggcuggggguggggcuccucuguugugccugcucauccugcgagcccagcacagccccagaacagcucuguccgugccucauagaagucacuaaagccagggaggcucugccuucagcauccaucuccaugauuacugcacuaauauucauuugaguauuuauuuuccuuuugcucaaguaauuacgcugcagcaaagcuugacuguaaaaaguggauuauguaauuaccucucuagaaaauuggcuuucaacuugcacuugggauucguguuugaaaagaccgagguucugcugugggacacaugccgggucuuuccugggcuguuguguaucuggaggucaccucugcacagcauagguguuccacaaacccugugauaucauuuaacuuggguuaccacauacguccagagucagguccaaccaguuagaagagucaaaagugaaaaacagaaaaaaugagauucauuuucuguggcuacaucgagaggagggacaaagagauccagggaaacccccaagucugucuuuggguuccuagaaugggaauuaagucuaaacaggggcuggagaaugugccuaucucagcagccauaagggcccugcccaccucagccacgcucacugacccagcuucucugggcuucaguugcaucugucaggugggcugaguuauuagaacugugugaaauuacugucugugucuuaaauggaaagacgagcccggagccuccucagucacacacucugggccaacaggucaggacuguuucaugcuccauagacaugggucuuuuccacguggucuuagggaaacagaagagagaccgagagaggagaggauugcagacagaaaacucugucuuggccgggucacgguuggcuugggucacgguuggcucaugcugucucugaagggaacuagguuugaguuacuuugguguuuugacaugggguaucauguagcccuuccuacauagcugagguuggccuugaacuucugaucuuccugucucuguuuccugagugcugggauguggacuccacacagcuuucuugauguguucugagaacuggguggacacagauggguccguuuguuugucuguaauacuauucucucuuucccuaaaguaauugaacuuacaaagguucuuacauggaaggaaacaucaagcugauugaacuagcagccuguagaauggggggagcuuugucugcugugcaucugauaaggguuaaugucuaaauuacaugauaaacuaaaagaaauucagcaccugaaaauacccaguaagucacagacagacacuucucaaggaggagugcaggagcauaaauacagaauaauauccaacaucuuugcacagaacauaucuugcaagguaggguucaucagacaggugacuagaagacagcucaggaguagaggcugucugaauucugacgguuggguggagcccaggagagaccccugguugcuuccuucagagggaugaaggucuuucccccaggaccuugaacuaguucuuguaagagugaaguguuagaggugggaaccccaacccugagcuccuggcucccugcucauccugaacccaugcucagaagccuccagaacuggaacuaaacuucccccuauuuaguacccagcugcaggaaccucauuuuaguaacagaaagcugacugggcucccuaagacaagaucuggggaagccagccucuuccucccacugccuucugcggaugcuggccuucugccuguuguuuucaucugagucuuggguauuuguguauauguguuccuguguuuguguggggcaucccaugugagcacgugugggcuaggccagacagcaacuccaucgggguuguuccuuagacacuggcaaguggguguuggagacagaaucugucacucagccugaagcucauugaugagguuagaguggcucugcaagcggucuccugacaugucuucaugauacacagagcaaacaaguaaguaagcgccauacggggcuuaagagugacugagcaaaucccucauguggauguccagccugcguguacaugcacacacacauauguacaugcuuacacacagaccauccuucacauacauauacacacgcaugccuacagacauacccauacaacacacacaugcguacacacaugcugggauaaaaaaggaaucuugccucaacuucucaugugaggauugcagaugugaaccacauccugccucuguuuggauucuuucucuauauaauugcguuuaucagaauaaaaagccacauguuggccgggcgugguggcacacgccuuuaaucccagcacuugggaggcagaggcaggagaauuucugaguucgaggccagccugaucuacagagugaguuccaaaacagcuagggcuacacagagaaacccugucuggaaaaaaaaaagccacauguucuaguuuagagacaggagaaugguucuacauauauauaauugcucucuucagacacaccagaaaagggcaucagaccccauuacagaugguugugagccaucaugugguugcugggaauugaacucaggaccucuggaagagcgguuggugcuaugugcucuuaaacacugagccaucucuccagcccagaugugugguuuguggguaggagugcuuacaugugcuuaagacacuggguguugaugauaguaauuuuagaauuaaguaaucuugaauaauaaugcugguuuucugguuguguuuuauuuucaugacagaaaaucuuucuccaggucaugagacugcauuuguguaacacaaugggacccaucugggauggaggcauggaaggguauuggcuuccgugggucuccucaguuuaugguacuguguggcuccagacuguccuuugggcaguagggacacuuggagcuagacagagacacuacagugcugcgucucucagcacagccugagagcacgagcccauaaaaauccccuggaguagcucuugcugguucuuggguccccuggaguagcuccuugcugguucuuggacagcuuggcugugucugcagaagucgcaggugguaaagccuggcuuugucaugugcagcuuccacuguguacaaacaaggugugcuucacacacugcucacaaccacgcagggaggaagagaucugcaguuuucucucuucccuucuggcgucuucuccccucaccccugaggcuagacaagucucaccugucuuaggcugaccagccucgcacuuccguuccuugauuggaagcaauugagaaguugggcugcucagcuguguggacagacacgaggauggguucugacauuugcuuuccgucagcucacucuucugauacuuguugggaaucucuuugcguuaaggcuuugcguaaaggggacacauggccaaggacuucuguggcauugagucuugaaaacucuccaugcaguuuuaugguguggugugggcuguuucuuaguucugcucaggccuauuguuuauauuuugagugcuucuagcauguauuuauguguaccacauguaugcauugucugcugaugccagagagggcguuggaucuggaccuggaguuauagacaguuguuagcuacccaaaguggguucugggacucauucucagaccucuagaagagcagucugugcucugaagcaccgagccgccccagccugggauggggguggggcuguuaauuuaauaccuguuuucucuuguccugagaguuuuuguuaaugacagguaccaugugaagcugaugaggggaacuugucccucaauacugcgacgaaaguggucugcagagcugagauucuauccucaaagccacaucguggcuuuaaaugucugcaacuucuggaguucagucagauuuccuguaguucucaguauagguaucucauaugugggcaacauuggggcaauuucugugucucggcugccaguacagagcuguguggcuaucagagacauuguuugggaaaagggguggggaauuucucuggccauacugagacugacuuguagguagugaugacaggucucugugucccucccuuuuaggcuccauccucugggcaccaaggcccaucuuguuauaugccaaccugacucugaccuggaagccagaacaccuuccccccccaaccccagccccucagagcuggggcccuguuccagcugcaguguguccccauccucaggagagagcugugcagccucugcacucacagcucggguagacggucaggucgucugcggugugccuggggugguugguauuaauagaagccuguacaaguguuuuagaacugagguaggaaccggacacuggaggaucugcucaggguuucucuuucucuuguagucauguguccagggguuugacuuguaaaaacugugacucugauuuuggcagggggguggcagggaggacacauuuugccaaugaaaagcauuaaaauucaggcugcugcccgugucagauuucauacaaaagacauuuuacagucaaacccggaaaacguggaaauagagauuuauaauggaaaugcugauucaauuuaagccaaagccagacauuucaugggggaaaauuagauuaaacaguagaugcuuagagaggccuaaaaggcauaugcuaugcaugcgucucaagcauucggguacuuucuguggugagcaggaggcagccccuugauguuagagcccuuuauuaaacacucuuuuaucugucuuuggacuuaucagaccccaaaacgaacggccugcagucuggugauucugcucauuccugcaggaucacagcggguguuguggguggaagugauuguguccugucacggugugccgucuuuaugagguuaaggccauuuagauggugaccauggggcucccaguuaccacugaccacuuacaugugagggcaaggaacucccagagaggcccuaggaccugcuggcaaggagagaggcuuccugcugugguuagacaccuugggccucuacccugaccugagugaggucaaggcuguucccaggugugcccuccccugccagggcuaccugccuaccucacucugcugcagucuucuggauacacaaacauucccgauuuugacaaaguccaauucccaaucauugucuuggguugacagugcuguugguguucuauccaggaggccaaugccaagacugcacucacacuucagcuuccaugaacuauaguguguguguguguguguguguguguguguguagggcagaggucaacauuacacaucuuuuucaaucauucuccuccauaauguuuaagucaugaucucuuacccauucagugccacugggccaagggauccuccugucuccacacccccagucaccccugguguaagucaugugccacauagaagcauggcuuuuaugagagugcuccgaggccucaugcuugcaggacaagcuccuucccagccaucucccagaccuguugucuucugugacuuuuauaguuuuugcacuuuucuauuuaaucuuuuuuuuccgagugauuuuuauauguggaguuagguaggauccaguuucauauuuugcauaagcacaucuagugucuuuuguuggaaacguuucccccauuagauuuuuaccauccauauugaagaagacuugaucguaggccugagaacaggccacagaggcaacuucugaaagauuugcuguauguaggauuuaaauggucagacacguggacaaggauggggagaaggccuugcggagucuuugguaggaagcaugcaaaaugcccuggaugauaacauaaaguagcccgugugaacagagaggcgggaggcccaggcucuggcaaggauugggauagguacagugcuccgugcuggcugaaucaagcaggcuuuauucuaagggaauaugacaggguucaacuagguggcagcugaagcagggagggaagggaagcaugacucagaggaagacuguguggugagcuugacggcugugguuggauguggauucgaugaucugugugagagcuugcuggguggcaguguugggcgcagccugaagaggcuggaccguaagcaugagcagucacagugcaggugggaagcguggagugcggagcuuuuggguugugaguaaaggccgacuugucagcgucagagaguguguggaaccucccagaugcacucagaguucagagaaggcagccagggauagagagcuggacagagcaucugcagaaggcccccgaaggaggaggagccagcaggcaauucaaagacacaaacagggagucugagucugacccacgugucauaaugcugcucccugcucuacccuggcaccugggucugcagccucauagauuuagauagauguaagcugaucaugaguuccagcccagggccagacacaguugugagaagggacguaggggguauggggcagcaaggugggggacaauuuguguaacagucuggggcccugccuguucauguggaacuagcuggugcauggucugcaaucauccuagcaucccaccugauagaccugugguucaaguucccuuguuuacuuugguccuccaagucuguacaucauggguucauauaagggguucucuaggguuugaauauuucaggguucaucaugaaguccugaacucugguggaaaacauccuaaguguaucuuggggcucugcuguccugaagcccacacugggaaaaaucccccaccccaccccuuccccuaguaacacaaggcuugccuaaggaacuguggaguuaaugccagugugaucuuucuaccaagguagaagcuauguguagcuuaccccauaucauaaaacuccagagagaagaauccuguuuucugcauuuucguggccauguuaauguugcuaccagaucuguguauugguuugguuugguuuaaagagucucugaaugaagcacuuauuuuccugcucagauuuaacaaaauguuguuaaaucugauuaaacuugccuauuuaauaauagcugucuuggcuacuuuucucauugcugugacaaaaugucugacaaagccaaucuaaggaaaauuuuaacucauuggccaguacuguccaucaugguggggaggcaggcugugcugugaggcaguuggucacauugugucucauucguccagaagcagagacguaaaugcuggugcucagcucacuuccuuguuuuucuucaguuuaggacccagcucauggggcgcugcugcccacauuucaggugggucuucccuccucagcuaaaccucucugaaaauccccucagcggcaggagcagagguguauuuccuaggugauuccaaguccagucagguggauauaaaaacccauuucucaggucacuacacaucugcaagugcauugaaagcuguuugaugaacauuuggucuugacuuccuaugauagcaggcugagcauacuggacaucgcauggcucaggugauagaccuucagagaaggccacagccucguucuuguccucuuggccacaggggccggccggccgggggucaaagugggguaccuuuguuucuccugcauuucccagccaugcucugauuggauucugcuguggagaauaagcauuccccacacaguuauccuugcauuaucaaugugcuauauaauuuuaaccacucuuuucuaugaaugggacucauaaugugugcauuuuguggguuucaaccauuugcuacagcugcaggccugauaagaggcucaauuauaagcacaguauuggucuuuaagacucacggaugucucguggaagauggggaaaugugucuuacguacugacgauugugcuaaagcagccaagugcugugguucugucuugucccucucugaugaauaccuaggcugugagcugagggccaguccuucucagguucccaguccuugaguuuguccuugagcugucuuccuuugcccucccuaacuccuuacuguaggucuccugcucaugccugggaggccacacaacuuccuuuuuuccuuuuuuucaaaugcccacagagggcugguuguuuacuuuugauggcagcagaagccauaggacucauagugcaaggcucauuguagcuggggauguaguugguaaaguugcacacuugacaugcaaaaagcccuggguucgauccccaucacaaaguguguguguggagcaaucuucuuguacuggagaggcagaggcagggggaccaggagcucaaggucaucuuuggcuacauuagugaguuugaggcuagcuaaugcuauauucacaaaauaaaaagcacaacagagggagagggagggagggagggagggagggaggggggauagcugcaaggauggggugguguguucuugauauugaaaaugagcuugagaaggaaaacuaauaaucuggcgagugccugugucuucuccuucccucagugucagugucuggacucgggaacuuggaagcaugguccuuaugcuaggccuagcaggauagagcagguuagaagacuacguaauauguaauuaggugcccauucagugcuggguauacuuuauaacacaccuucauuugucagugccuuucauauuuauaaggaaaugugcuagggcuuaucgucugagccccgaaauuugccagugugcuauguaagcuaguuacagugacaagccaggaagaguaagcgcguggaggaucaugggaagaagguuguagaggcuucuugucucaggcuuuugcuccuaacucugacaugaagcuugagggacagaauaacaaguccccuggauauucaguuuuccacaacaucuuuauuuguacgggaacuguucauagcaugcauugggaguuucugccaggaagcuaccuaacagaagaggguucugcacagcccagagggcucagagacccaugacagauggccucuggugacuaguaacugcuugcuucugugcucccgccuugccagggagaguugcugggauguggacagaaugaggguggcagcauuuuucagucuacuaguugggccaucagcagcucauuugccccauaccucagugggauagggugccccuugacagaauggaauagcugcuggguauuaaguucauagucacuguaagggucugaggaaaagcauggggcaguaauauccuguccugucuucccauguguuuacacuuaccgaccuugugaacuuguaucugaaaaguugcagugaucguucagcugccucagguucccuuuguaacuaaggugaccuuggccuucugcuccuacaggcuucccucuccaguguguuuaguaugcugccgugccaagugguguacagggugggaucaaacgcagggcuucaugcacaccaggcaugaacucuacugacugagccacauccccagcccugaacucuuacaguuaaagccaauuaaauuaguagaggcucuuauauuauugagugucggcaccugaugcauuccuuuaguuauuugucaauuugcuugcgugcuugcuugguuauuuaguuauuuauuuauuuaugguacauuuaccacauacuagaaacuguacugauccccacaaaagaaauagugagaaaaguuauguaagccuggacccacguggcugcucugaggggaaauucacacacagagagucaggaaucugcuaugaaguacaaggagagagaaaguagccaacaucauggaaaccuggggugugugugucggggggggggguggggggggggaacgacacagcgagaggugacuagcgauguggucagcucugaagcagcuggugcuccaguuagagggcgcgguuuggacagcagccuaaaguguggggguccuggaagacuguaaagguacucaguauaaugugauugagacacagcauagaaaugggagagaacaccacacugaagagcuagcugcacagagggaggugggagcucacagagcacaugggcuucuccagcauccaguguucugucacacagcuaucugcccagccaggaagaguuuaaguaagaccagccccuaauuucuguagcuucaugguuugucuuucuggccgacaucuugucuucacuacuccugggugacauggcuuuagugggucugaugauugacauggcuugugggucugugugguagcugagucucagcacucccuccccucaccucuccaggagacccugucugacucagcucuacagcgcugggguuuggcuccuuguuggcugugcaggggucuuguguauuuucccacuuuguguccuacguguuagguucuggaccuucagugugugcggggcauggggaagagagggggagagggaaugagcaucucagaggugucaggguggcccuuagcauuucauagguggccuugucacaucuuuguuagguagguauaaguuucuguucuuuucaaugacagugaaucuacuuggauuuuccauuccugggucaguuuggagaaguugauuuugcuaggacauuauugguuuucgauuuuugucacguggcugcuucugguauugccuguuggggauucauauagcucuauaccaaacauuaaagagaaaggggugggaacacacacaugcauguggauguggguaugugcccccguaagggcuguugagaggccagaggaauagagcagcucacuuccuuacauguccgucuccuuaguuuuugagaugcgaucucuuacugaaccugggauggcagggauggcuccuagguccaccuguguccaucugccaguguugaaguuacagcugaagcuuuuacacagccucucaggauaucaauccagguccucaugcugucauauaagcacacuuaccgaccaaggcggccccuagccagcauacauuuuuaaguuuaaauuuuuauugucuguaaaaagcagccauccaaagaacugaugggucccucagaaagcuaguucacagaaucagaugcaucucaguggaagagggccaaaguguuugcuuuuuugcugucgcucccuugguuuccaggaacuguuucguaagagucuaaauuguguaggaaauaacagcaauucauagcagucuacaauccuuuuaaaaauagucauucuaggugaucgagaagaggcagccauucccuugugucugagaacacaggucaggauaucugugugugcaucugcuugcauuuucucccucccuccauuugucacauccaggagaucucuuaucuccucgguuacauaauggcucugggauaaauagccugaggccaugagcagacugauagcuuuuuuuaguauuggggacaaaguagcuacuacccuaggaaaaugucugcacgucuucucaaggaugcccaucuauucaucuuggcuaccaggagcuugcccaaacguucucaaucuguuuagcugauuaagacuuuucaucuuggccagugaacuguagguggauacuuaugggagggacaagagagccacuuagccugucagagcugagaaaguaugcaguguuagcaacauuuuuuuaugguuaaagauaaaagagaaaugaaaauacaucugaucacauuucugcuccacacauuuacaucugcuacagucguuccuguguggugccugaagcgaauccugcauccugcuaacguuucucuaagagugcugguguuggguuucugugagaguuccagucagccuugcacaacaggauagucaggcacaccugagcucugugacaguguaaagaggcuugguaucagcagaggcaagggugaaagaugagaaaucgccuguagaccgguacugaccugaaucaugucaaucacaacugacuguuuucugucuucuaauucaggcaaaggaaugcuaacgacagaaguauuaaagagugcugccgaagccgggacagugucaccacagccccuggagcacacucgucguggccucagagaaaccgugcuuugaggaugcuguuugcguuuggugaaaaaggcaaccaccuuucugucucugucuguuacagugcugugugacgaccauggagggaggcucacaccacuacugcugauaacugcuuccuguuccuguggacaugagugauccaaggccgucacaggcagagaagcacaagcuuggcagagcugcugccaaacucaaggacccuuccagaaccaugcaggcugaugauuauuuugcucggaaauuuaaagccaucaauggcagcaugggaccugcuacuuuaaacacuuccaguucgagugagggcggaggaggugggggugggccagccaaugguaccccagcagugcccaagaugggugugagggccagaguuucugaguggccuccuaaaaaggacugcuccaaggaccuggcuugcaagacgcugugggagagucguucucaguccagcuaugagaguguuaccucuaucauccagaauggccaaaaugaccagggugacaggcagccagaggagcagcuggaccuggacuuuguagaagcaaaguacaccauuggagacaucuuuguccauucuccccagagagggcugcaccccauacgacagaggagcaacagugacaucaccaucagugauaucgauacggaggauguccuggaccaacacgcagucaaccccaacacgggagcggcccugcacagggaguaugggagcacuucaucuauugacaggcagggucugucuggagagaauguuuucgccaugcuccgaggguaccgaauagagaguuaugacccuaaagugacuggcuccuuuggguuuccagauuucuuucccugugacacugccaucucccccagccuccaugcagcagcccagauuuccagaggagaauuuguccgcaucucaggguuggacuacauggauggcggccucuugauggggagggacagagacaagcccuucaagcgcaggcuaaagucagagucuguggaaaccucacucuuccgaaaacuucgggcagucaagagugagcaugagaccuucaaguucacgucugaccuggaggagggacgccuggaccgaggcauccgcccauggaguugccagaggugcuuugcccauuacgaugugcagaguauccuguucaacaucaaugaagccauggccacgagggccaguguagggaagagaaagaacaucaccacgggggccuccgcagcaucacagaccccgguuccuguaggcccagccggaggcugcgaguccccgcugggcaguaaggaggaccucaacuccaaggagaacccagaugcugaugagggcgaugggaagagcaacgaccugguccucagcuguccauacuuucgcaaugagacugguggggagggcgauagacgcauugcccucucucgggccaacucagccucuuucagcucuggggagagcugcuccuuugagucaucccucagcucacacuguaccaaugcaggugucucugucuuggaggugccacgggagagccagcccauccacagggagaaggucaaacgcuacaucauagagcacgucgaccucggggccuacuacuaccgcaaguucuucuauggcaaagguaggcaccuggcuuccugcaggggcucugggacucuucuauacuacuguguuaaugccuuccugcgagauauacauacacacacacaaacauacacacacgccuuccccaauguccuaaggacaaaccaaaguacaauuccaucagcauucacucuggagaaucagugagugagucuauuagacugacaaagcguagguaaggaagggguuguaagcaagguggccuuauagcagccauguggaaggaucugcagccagcauggaugacucugauagcugcacagaugggagccucuuccccaguucuugcuccaccuuguacuuuagcccuuucugaguuagggcagaauuagcacacagcugauggauggauggauggauggauggauggguauuguaggggcccucacccucccugacauuccuuuuacaggaugucaguaguccaaacguccagcugugacagucuuuuguaagcaggcaccccugguccuaugaagacagcagcaguuuggcucagagaauagucccgcacgacacacugggacccaaauaacgcagcacucgaggggcagcuuuggaggaggaaggacuuguucugacaugguugcagagaguccaggccauagccaagugucccuguguucuugggguagacaugggaucaugucgugcagagaauuuuuucauuuuacagugcauagggagggcuagacagacggucagggauuggguaucaguuguggugacacaacuucagugaccugcucuuccggcaaaguucuaccuuguaaaguuucuagggcccuccauaguagcaccaccagcuacagacccguuguuuagcaugagccugugggagacguugaaaucaucccaggcuucaggcacugccgugggccuuucugcuuuagagcagcuuccucgguacccgucaccuggacagcucucaccaagggcaugcuuccuccccucugacaucgagcuuuauuuaaacuuuacccccuuacuaaguguccugugguuacauccauccuguguuguccucugugucgcuccuugcacuguguagcuggauaacucuguggguuccccaccauucucugcucuugccucguuaauucauaggcuggauaugcccaagucccugcugaaagaauucugaguugaccagauguguguggcucacaugagcagguacagaguuaggcuuccuucugccguuguucgggacaucuuucauauaguauagaauaaauuauuuccacuuuucucugucugaccaucugugugcgacacaggcuuugucaccagaaugcuccuuucccuguucccagcucuccuguuugaguucaguccuugucacaggaaagcccagaaccucugacugacacccccaugucgugcccucccuuacguaggaacucuggaaaggaagaagacagcuaguugcuuuuggcuuucgaaaaugaccucagcaaaacaugcuuccuccccaagacuuguuauagcuagaagcuggcacaugaaaucaagucuguaaguggcuuagcauccaggcugagugcuggagaguugggccuucaggaggaaagguucucagguccuagugugcaaaagcuuaacagcucccacucaagugcguccaucucaccuccagaguguguaugagaggagccaaguuuacugccccugacugauggcaccacuggacuuguuaauggccuuggagucuguugcaggaagugauuucuaaucuggcuuuucugucacuuguguagaccucucuccagugaccucugcccucucugauugaugauggagacacuggagagcuuuggaagcaaugcucucagacuauuuagguugguaaagaaauaaguuaaucagcucccagaaauagcuuguguguacacacccuggaguguaugguaaggagauguagccgugcuggcuggcagugcaagacucuuggauucauuucugacugggggcuaggccgaggaccuaggaaguagcuggaaaucugaguucuagacuguccugugaagcccacagaauaaggaaaugcaccaaaggcccugguuucucacugggaggaagccugggaagcccagcugagggggaguggccucagaggaaagcugccaggcuucaguguagaggagacuccugcuuccucagggcuacuugagauauaauuaagagcaggagucauuagggaccagacauugguggcuagaguccugaggauucaaguguagagacaagcuuaaccccagagccucagggguguguuucagagaggaugaggccaacagcugugagcccuugcucucccucccuccaugcucucccucccuccaugcucucccucccuccaugcucucccucccuccaugcucucccucccuccaugcucucccucccuccaugcucucccucccuccaugcucucccucccuccaugcucucccucccuccaugcucucucucccuccaugcucucccuccaugcuuuccuccaugcucucccucugcccacuuagcuucuucccugcugcgauguugaaauacucugacaaaugcaaccuuagggagaaagagucuauuuuaacucacagauaaguaggaucuaucaugaaugggaaaucuggacagcaggagcuugaagcagucaggaaacagagaggaaugagugagagccaguauccaguauguccacuccauuuuacccagcccaggaguggucccacucacaauuaagauggcucuuccuaugucaguuacuguaaugaagacuguccccacaggugugcccacaggucagucuuucagcuugucagguugacagugcuugcuucaagcuccccuccccucgcuccuucccugccucacuuuuucuuccgucuuucaguuuccccuuuccuuucuccuuccccaucuccuuccuauauaaaauggcaucugacaggacacauuugacuuucuucagcgguggaggcaacuuggaagaagcagggggcaagagaguggcaugaggcucccucgugguggcaguggcacugcccaaacuaagcugcuccaggggagccucauauuaucuggguucacgucuucaucaucucccacaagcccccacccagcucccuucucuccagugcuugccuuccucugcagcacugagaaugaaggaugcugcagucagagaguuucacacuggguuggagcuggagguguuugugcaacgcuugccucccaugcgcaagauccuaaguucagcagccagucuaauaaacagaaauccugcacuauccaccccaccucaacaccacguuccuauuuagugucugggaacucaggaacuaccccuuugccaaggcugaagugcccgucuguggaaguccgugcuuaauaacccagggcugugaaagggccagauggagaacauuagugauuccuagcccacccaaugcugucuucaagaugagcuaaggauucagggacacccugcaaaggacuuagaguagugccugucucaccacauggguguugugcauuucguguguguguguguguguguguguguguguguguguguguguggucuucucuccugaaagaggccauuaccucugccacacccagacacagaauuaaaggcagcacuuuguuuugaugguuaagagaugaggagagaagcagaaguauggguguaugucuggugaagcugccaccuggcuccacacacacucaccccccccgugucacugaugcuagccugggggcuaggggaggggcgugucuuaugaauucccugaacucucugcugagucagccaugacuuuccuuugaguuucaugucccugccuuuucuucccauuuuauagagucggugacuaaaagggaguagggcacuguuaaauucacgagggugagcagagugccaucuagcaaaaguacuauucuaagacacauguuccucucugagaggacauuguucauggacuuggcuuagccucucuccguggcccucaucacuguugcaaacagguccauugaguccaggaacucguaauaagaggaacuacccagaugaccugggacucuggcaccaagggacaaugccaggcacuugcucuccugugcaggcaaugaggccguagagagucaguguaagaaccugcaaaggccuguucauaccagaccccagcaggucuuaggucagcauggagaaacaggaaggagggugcugcuuaucugugaggcuugcuugauagccaaaguggagaccucaggcguauucugcucugguacaguaagauggaucuugcgcccgccagacugaccagcaguaacgcugcaacaggauccuucugcacacguuuauugggagagcuugauugcagaggcgaagagacccggagcccagaacuggugcugcuuauauaggccuaggagaggcgugucucacacccggauugguuaugcauuacgccucauuugcauguuccucaucugauuggcuacucucucucucuguaccucacagagccucauuaucaugcccgggccaggcagugucuuugcaaaaaacuuuacugcauauguacacauugguuguuuguccaaacuuaugcgugguggccagcaguagucagugccacucugcaauggcacauguggcuucccacagauggaagugaagguuaccaucaugguaggucccacagguucuggaauccuaauaaagcccacugugcaucuaucugcucagcuccaagcuccauucgcucgcccaucucagaauguacagaagcuggacagcugagcuuccccagcagccucuccucuuccucuucuucuuccucuuccuccuacucuucuucuuccucuuccuccucuugagaccacucagcugagaacugcagcaaguagaagaggcggcaauggcucccuccaucccuuguaugccaucacauguaugcccaugcauuuggagaccugagguuggcccugggaguccuucuggacccuuuacccuucuuuuagagacaggguaucccggcugaaaccaaugcucacuggugccacuggucuggcuugccaggucacuguaggaaccuccugccucugccuuccuuccagucagggauuaggcgacauuugggugggguuuaggaaugcagucuuaugcacauugucuguggggaggggugugaugaacaucuuauccagagccaucuucccagcccauagcuugguuuucacuucucgugugagggcaucccccagagcuguucauuggaagugcugcugccaggcugucugccaucuuacagcaggucacauaaucucucaccuuugaccccuucuaaaacaugggccuucauugguuuuguaugaagcaaguguaauauuuuuaaacauuucauuauuucacuucaaugcuguggguuuuccaagcuuaauagugguuugguuaaggucggaucagaaucacaugacaccaauaccucagucucccugcauggggaaugggcucucauaaugcaggaguauggguuucucaaggcugagugugacuucacaguggccugaggcaggaucuucacuugcccauuugcugggcuuuuauugucuuuuguccacagcuccuaaagccugguguagccagcgaucugaaauacaggcacacaguugacuagagggaaaggugaucagcugggccacuucaccccagucaguagcaugcgaaaacagaguggccagcuaguucuugaaaggcagaggaccuguaagcugcuuuuuaggauacaggagucacaggcuucagaggccuggaggacguggguccuggagcuugugacugcuacgaucuugcuguggguuuuaccacuggaccaacugccugguugcccucguccaucucugcagcccccggacucauuggugacuuaccaauuaaucagucuuccucuuaagauauugcagagucuagaaacagccuugggcuggggucccaggcaccccagaccuuugucuuccuuucccccuucuugauggggcagccaggguacaacaccaagauccugugacucauucccacacugcagucuuguuaaccucuuuuucuuauccugugcuauuguauucgugugauguguggauuuucauucaacuuaacagcuuucucgugguuuccacccugccagggaaggauuucauuugauucacucuugaaacaauuuuauggaaaucauuagcucauugguuuagaaauaaggccggccuguggggggccagagucugaaugcacacagcuaugagggcuugcucaugagccucuguccagaguggcagggcuucucagaucaaaaauaacagagaucuuuccugaaaggguccaggauguccuuuaaaagaguugccuuuguucccucuggggaagugggggaggggacagagcauagacucuguucacaucuucauggucuguggacaugcucuacgucggagcuagacaccauguucucaaaucuagggaaaauuuuaauuucuuuagaaacacaugcaggcauucuacagacuucuuacugaaacuaaaagcaccaccaggagggagguuccuagcaaagacuggugaggcggaacggcuauggggucugccgguacaggcauggugccuguggacggaccauggggaccucaccuccacaucugcuuucagaaaugcaggcaugugagugagucagagccagagccagaaaugcaagcaagauguggugagaggacaccuuccuguauucucugcccacuaggcucugcuccuugucaccuuugaugacagagcugaggguucuccaguucuucaaaacacgguuucugauucaguggaguaucaugugccacuugucgccuuaaacagauagcugcgugugcaacugcauuugcccagggaguccuuacaggacagcgggccugugggaaacauaaaaucuucaacagucuguuagaaaacacagaaacuugagcgggguguguguguguguguguguguguguguguguguguaauuugaagacaagugaccaucccagagugcuacagaacauggccgagaagaguagagcaccaaauaccaagccugugggaggauagcuagccgccgcagcuuggaaagcucuagacugauccuugucugcuauaaaggcagguuuagugcaguguccuaggccccuugucacuaaugcaugucaagagaacaaggcauacugaaguaaacaguuaacauccucauacuaugauuuuaaacuacugauuacagucacaaauggcugcucagcuucuucaaaccugacauguguuuggugacacuguucugucuacugucuugguuguuguuggcagcacauacuguaucuaccacacaagcuuuauccaaucugaaauuaauccuccuucacuccaaaaguagccuccuugcgguuucuggcuccgccugguucuagaaggacugaguaucuguuuuacacuauucugguccccaagcaauauaaaacaaauggccugcauuucagaaccaauuugggcaguguuggcuggaguggagcaggcaguugccccuuuggugacuucagaucuuuccagaaguucucagagcacaaaaccacagcuaggacccuugcagagcugcagguuucccaaacucaaaaacugagaguugggcaagagaagcuaaagccuagaagguagcauucagaggggaaacgugguguuuuguauaagggugggaaaauaucaggguugaagcauauaacccuuggagaacuggccaggcugugguuagcagagaaugaaugaacaguuccuuggggucccauguacccccuguucugcaugaaucacugacauggcugcugacaguaggcgugcucuugacugugucaguggguauauggcaguuguuccuguguuugacaaggcccgacugccucugcugugcugugguaagauuccaucaauacgaagcuacggagagacauagugacuccucacuguucugugguccagagagcaggagugcccaucacugggaggagggucauauugugaguggggauugcuuccuugagugcuccccuguguccauacugcuaaauguccccugccauguggcuguuauacagaagagugcaggcuggugacuguccauuagaaaguguauccuguguguauccucugcuugguagaugggacaccccaggguccaucccugccaugggguugugugacucaggaccagggguuuaugggaaagaagagaugagcugaccuuggcggagggaguugcuggauuuguaggagcagugaccuucacagcccagaaaccaucaugugcuuccugucucuaaaaacacuagggacacuuuaaugacacggugaccuuugccacuccacugauggcuaagauuacccuggcuagucugaguggcucauugagugaccuccagagucucauucagugugagaaggucaacuuccguauggaauggagcagugcagacuccuugcugacucuugaggagccaugccccuccccccuccacagugugaggcugcugacccaucuuccuaauggugccaucuacagaacagcagcuuugaggugggacccucagcauacugugacggugcaaagcagauaggaaagcagaaagcccaugagaugacaccagcuacgugagccugccuagaucccaagccagaggaucccagccgugggaaggguugugguguggccuuguggcuuugcucugggacuguggggagggucgugguguggccuguggcacugcucugggacucacuucaugaacugcugcugcaaugucacucucucacaaauaugcuguuuugaauggcagagcaccagaacuacuuuggaauagaugaaaaucuuggcccuguggcggucagcauccggagggagaagguggaagaucccagggagaaggaagggucgcaguucaacuacaggguggccuucaggacaagcgagguaagaaacugcuguuggucacugccacgcuacucaguuuuagaaaaccuagcuuugaugucagucauccacuaaggacacugagaggcgguuauguggucccaucccaaguaaacacuuggaagccuguccuggcucucaggugaccacagucucgccacauugcaugauaggacagcauggugaagguggacaguuaugagccugagacaugagaggaaaugccaucuacacaguucccaucagaagugggaaaugaguuuaaaaccaaaugcaaaagaugaggcagccugcaguguggcuggccugugacaggcaggcauaaccaaggugaccacaccucagagagcagcuuguugugccccacagacuuuguacugauugaaaccugagguccuuacguugugcagcuaaacagcagacaccaaccacccuaaggaaucaggguccccugcacagcgggucuuggucuuuuggcccacauaaucagaguagccgaucuucuagaaugugccagcuggccacuuuaggcuuuccuccuucccuuugcuucuguaaguguggugacacugccucucagcugguauuugcagauguccuguugagcuagacugacuaggugcugacgaugcugacugagacugacuaugcugcuaugagcuaagcccuucccuugagugacagcuuugaagauagaccugugcagacuaaagguuaggguaguaauugaauuuaaauaauuaaugaagcaagcugucaugguggcugucacgcuagucaccgucccuccaucuauugacagcauggcuagugugugugucaugugucucugggaugacacucgguucccaaggucaagcaguaagaccuccuggaccacagggcagugcuaucaugacagccuggaaugguggccuaggugucuuccuuaccucuauuucugugaagacaccaugaccaagguaauauaaaagaaagcauuuauuugagguucaugguuaccgaggguuagaguccgcaaucaucaugguaggaaccauggcagcaggcaggcauggcacuggaacaguagcuaagagcucacguccuucaucuauaagcaggaggcagagagagggcuaacagaaacaaaggcuugggcuuuugaaaccucaaagccuccuccaggcuaacaaggccucaccuccuaauccuucccaaacaguuccaccacccagggaccaagcauucaaauauaugagccuauauucucauccagaacaccgcaccaggcuuccaagguauagagcaaaacacaagacugcguucagugguccuccucucagccacccacacgcagcccagggauguucaacguggguucagucuucaaacagaagacauggaaaggaguggaagggauaagcagaagcgcacggauggaaggagaagggugugcuggggcuucagccugagcccucccucagcagccuccccaaggggcaucagagcuucaguugucuggugaggcucuggcuccuuucuuaggcucuucuguuugucucagccccugugaugacuucccgucccucuguagggauguuguugauaaaaggcacggucauuuauguuuucagauggagugccuugcuuccguuugauaaacuuuuagauccccuugugaauaaccagcaacgggcacuaaccagagucucauuugccacagcucacaacucugaggggagcaauccuagaagacgcuguccccuccacagcucggcacggcaccgcccggggccuaccccucaaggaaguccuggaguauguuaucccagaacugaguauccagugucugcggcaagcagccaacucccccaaggucccagagcagcugcucaagcuggaugaacaagggguauguacagugugugagcagaaagcucggacugcacacuugaaaauggaacuuuccgcuggguaaccccgcccccagacagugcuuacugugucuuuggcuggucuugaacucagaauccuccugccucagucucccagguagucagaauuauaaaagugagcugucacaccagauuucucauguucuuuccuuugaaaccauuucuaauaaaugccuucaagugaaguguguggccccaaagaccauacuagccaguuccacggaggcuccaucuuucccagcccauguggcuuugcuuugugggaagagaccacaugacagcuauagccugccauauucucacggugaggcaggugauucauggggccugccuggcguugugaacccgcgggugacaccgucugagaacuggauguccaggagccauuguggaggcaggauccagguguguccuugcuuucccucuugguuuugccaugcugauguggcuuuguucugugaugacuuguagacaagagcgucagcugaccuuuuggcucucacagcuccucccaugucuuugaaauaaagggcuguugggaaauagcugcugaggcuauuuaccccugaaagagaugcaguuugccaccacccagcugucucugcccuucuaacacuaacaccccugcugcuguuuuuuuuccuaaaagcaaaucugccugagagggcaccugcacaacaaaaagggguucagcuaucuaaguaguaauuaaccucgcuguggcuccucuggcuccgggucuguagccucgcugggcuccugugacuggcuccuggccaugauaauucccuucaggacacaguguggagacucagcuucuucguuugguuguugggauuuugguaagauguuucaagcaaggagccagaaugcucuggagagccgaaaagaacuuauaaugugaggccuugagggcuuugacggcaauguuuacagaaauuaccccccccccacccccagcuucuagaauaccagugugugugugugugugugugugugugugugugugugugugugugugcaugcaugauaccugaagaggggaucaguucccuaacacuggaguuaccggugauucugagccgucaucugggugcugggagcugagguuggguccucugcacgggcagcaagugcucuuuacacucauuucuccuuucccuuuucaaaggccguccuaguuuacacaccagggaauucauaggccgcucuucugugauagccuccaucacacaccucaguauagcaucuguaagagagucuguccugaagcugcuccucuccucuuggccacauggugcagacacaccugguagacaucccauuugcucugcccaggccucaggugcacaccaccggcugagcugcggcugagcuguggguggagccggagcugaaguucauagccuuucuuucuugcuaccuucauuuguguuuaaaucuuguugaucaugacaaacugucuuagucacuguuguucuauugcugugaagaaacacggugaccaagacaacucuuauagaagaaagcauuuaauuguggccuugcuuacagauacuccaugauuauggcaggaagcaugguggcaugcugggacucacagugcuggagaaggagcuaaguguuguacaucuugauucaugagugugggggagggggacuuagugugggcuuuugaaacuucaaagcccaccccugugacauacuuccucuaacaagacuguuccuccucucuuuaacacuccucaaaaguaccaccacacacacacacacucauacacacacacauacacacacacacacacauacacucauacacacacacacacacauacacauacacacauacacacacacauacacucauacacacacacacacucauacacacacacacauacacauacacacacacauacacucauacacacacacacacucauacacacacacauacacucauacacacacacacucauacacacacauacacucauacacacacacgcauacacacacacauucauacacacacacucauacauacacacucauacacacacacacucauacacacacauacacucauacauacacucauacacacacacacucauacacacacacauacacucauacacacacauacacucauacacacauacacucauacacaacacacucauacacacacacacaaacucauauacacacacacacacacacucauacacacacacacaaacucauacacacacacacucauacacacacacacaaacucauacacacacacacacacacacucauacacacacauacacucauacacacacacacucauacacacacacacucauacacacacauacacucauacacacacacacauacacucauacacacacacacacacacacacacauacacaccaccucugcugacuaagcauucaaauauaugaaccuguggaggccauucuuauucaaaccacuaccuaaagcuccugguguuggggauagaguggccagccuugauccugacccaggagaaauaguuguggcugaguccccucugucuguguguguauccugcucacaguccugagccacaggaaacugacaaucuaguguuugagugugucccugcucucaggucccagugagugugucuuggcucucaggucccagugagugugucccugcucucaggucccagugagugugucccugcucucagguuccagugagugugccuuggcucucaggucccagugaguguguccuggcucucaggucccagugaguguguccuggcucucaggucccagugagugugucuuggcucucaggucccagugaguguguccuggcucucaggucccagugaguguguccuggcucucaggucccagugagugugucccugcucucaggucccagugagugugucccugcucucaggucccagugaguguguccuggcucuggggucccaacuaugcugcuucccucacaccccugccugcaguuucucuugaguggguuggguuggcuugguguuuggguaaguguugcgaucagccugaggucagcaggugagggcugggagagcggucugggaagaagggagucagaaugucugcuugucugcgacagugagcagcggagccugcugcaggcuucuaguagacaagaagacauuuugaccauguuuuaguuucucccugauguuccaucuugguggcagcucacuggagagcaagcgauggagguguggcgcugacagccagggugcagcccugucccuggccauguuguauauuucccuguauuugcaagaucuaaguucugacuguuguaguuucccaaaggucuugguagccaugacgcaggccuagcauuuggaaacuccacucacauucuugguuuggaucuagacaguuuggguuuuagaugccuggauggcagaaagugagggucugcacagaacugaguggggagccucccaagaucucagucucaaggauucaauaaaucugccggguauggggagucaggggguacuugcaggcccauugaggcucugcucagccagccugaaccacaccucaggacacgaggccguggcacaugacacuugcuccaggguuuacacuguacacucugugguaaugaagucaguguguaaggacugcccacugugcaaggugcaugcuuguagcgucuugaugucaaccugaacucucaguuaagucaacucccucaguguccccaaagcucugaagguccuaagcuaucucccaagcaacuuaggcccaacugcucuucauaaagaaacaauagaacauuuuuaaauuaggugauuuuuuuuuuuuucuuuugagggggauuuucccuuuugagcacagcaaggauaagcucaugaccccaggugcucauagcuggugcucagccucucagcccacagcccaggccagagucauuguugcugucuuugugaugaggaaggagcuuguggccccacacccuccacucacccuuguaucugucagcagagaaagaugauucugucaugcugugagcacccaucaaagagauagggagacuuccgccggcgcucucuugccauggauaaugagguggaugagacucuccauucuguguucuugcuccaagagcugccugucccucugucuugcucugcugcuggggucagcugugggguucuuuuagaggcugagcuucccaucucaggacucaagcccagcuuguuucggcuccucaccugcagggaguuggugacguuuaaggccugucggucucucaggcucggcugcugcuaggaugcucaaggccucugcuggcaagaccgagaaguaggacuguggggaaaaugagcaauugcugaagcucauuuucugaagcuagucucccucugguucuggaggaaagcuguggcucccaccucagcacaaccuggacucugagguagaguggcagcagggacuguucaguugcugcugcagcuccuccugaggugucgugucuacagccaauguuuucuuuuuaaaauagucaaaaauguaagaaaugacuguaauuguacaaccaaacuuacuuugguggaaacaaaacauuuucuaugcacacacacgaauugcaguccucgcuggaauucuuuucuuacucgaccuuaauuugacuugauuucccuccuuugagccaacauuuuuccaugaauguucaaauaaauuacagaacaaaaagacaggagaggcagagagaaaaaugcgucuaaguccuuggccuuucccuguuccgcauuuggaagcuaauccuaauuaggccacugaguguguagaugaggugugugugcaguugugugucuagcuucaugucugacagggcugcccacucuucuucucaauucccacguggcucaggccacagacgcugccccucagggcuuuucaauccucgaguggcuuuugggccuuuuuccagcgugcuuuccugggaaccggaucccaggcuuccgcagcuuugacuuggcuagaagcaagcaggucuggagucucugccaaguucaucgaguuuccucucauuucagcugagcuuccagcacaaaauugggauccuguacugcagagcugggcagagcacggaggaggagauguacaacaacgagacugcagggccggccuucgaggaguuccuggaccuccucggccagagagugcggcugaaggguuucagcaaguaccgugcgcagcuggacaauaagagugagcaugugugcaagugcacacucgugugugucuaugcacauggauaugcgaguaaccuguguguucuucuauguagcuucuguuuaugugugaguuccugugguuuugugugaguguauguuuauacgcaugugugugugaauagccugugugccuaugcauaugcauguuuguguauuuauacacaucuaaaaacaacagaugacugacuuuguagucaacaguucagauaccaccauuucuuauuuaaaauauuuaugugugguauauguguguacauguuguguacauuauggugggugcaugcauguucauauggagaucagaggucauaucaguauccuggauuguucuccacuugugccuuuuucauuuuuacuucacauguaugacucugagcgcgcgcacacacacacacacacacacacacacaccaugcuggacauguggaggucauaggacaacucugagcgguccuguuccacauugcugaggaacguugcuguuguugucucguucccauugcugcaugaaguaucccaggcugucugacccuuguguaugggacagcucuguuuccacauccuguccugccacagaaauguuaugggugcaccaggcugaucuccugcugguuugugagggucccugggaucaagcuugaauuguuugguuugugcggcagugucuaucacacggugggccauuucaguggucugccacuugacuuuuuaaagaggguccuucucugaaccuagagcugacugaugaggcuacacuggccuccagcggccuccgucaaucagucuccacaccaccacaugcagccauucacugccucaccgagcuuuugcaugcccuucuaccucagguccccacacucacuuggcaggcacuugacugacugaaccaucuccccagccucacauuagcaucguaacauguguggucuugcaggguagacagacagaaagagagcaaucuccccuccuaaguccccaagucuguuagagcaugcucaguagaaaguugacaggaaaggggauguggggggcagcuccaggugagagcugauaacagcugagcagagggugcccgaggcauuacgucuagguuuacacauaguguggcuugugcuuuucaacccaacaccaucugcaaguagaagaggccugauucugugcuugccuaacuugcuuuauaauuacuuuguuuucagcggauuccacagggacucacucccucuauaccacauauaaagacuucgaacucauguuccaugugucgacgcugcuuccauacaugccaaacaacaggcagcagguaaggccucccgugugcucugcucccucauguccaccagcauaucccuccggcuuccaugucuaccaugcagguggcccugggugagagugagacucgauuuagaagucggaggcuguuccuaguaugcugacagucuuuggcuguuacugugggauaucugagccuuuauggggaaguuacuguauuuuucauugaucaggaaacugagaaucuagcuacacagauucuuuuagagaaccccaugucaaccaugcuaaugaugagaacaacuguguuaaccagacagguuucuacauguggguaaauaacuuauuuauagaaaauagucacugcagugugggcuggagcuguugcugcugcuguuccucacuggagguuagcucauuguuucaaugacaguguguguguguguguguguguguauguguguguauagaggguucuauacacugcacuggucaacacucccucaaaguuaggaaguguugaaagcuuaccgaugccuaaaacauaauaaaguaauuaccaggcuguuuucuauuuauaagaugaguugagcuuucuuacugagcauggaaaaaggagagcaaguaccuggcugcuccaggaacuugggaguuuggggguuuaagguggucccguggggcagcagcuccaugcucagcaccucuagacucuagacucuguccaggaugagcugagacugaaggaaaagugagugucuggaggcuccaagggaaggcuguucaugagcugucuggguguggcuuggggcauuugcuuuggaguuaaagucugacacauuuguuucugagcuuggguacauucuggaugccacaccucccuuccugugcagaugaaaacacagagagcucuguaccauucucugcguuggucuggcucuuccucuacaggucugagcucuuaaucucccuccucugcuuuuuucccuuuucugccuggaaguuccccccacccuccuuuugcccaucagaucuguauuacaaccaaucaauagugagacaaucucugauuauaaauagccucugggcaucaagggcugucugaccuucagguaucuucgcaggugugggaggacacgcauuuacaaauguaaggcuggugaaaugacaccaccacaguccugcaauccuguccucucugcugguacagaacuaaggacugacaauacagagacaaagcuuuacuccauaaaaaaaaagguuaccccaacaucuccucuuagcucugucaugagggcacucuaagaaaucccguccuuugggaacucugaaugagugguguucauaacagguacuguucuauguucuaugggugugcccaaugacagcacucagcugaguucuacuuuagaaguggcuauguuucugaucuucccaugucuggucacaaugcuaugaaaauaagcauuucagguaucaggaaagagggagaauuguuuggccaauuguuuugccaaguauaguuuucacuguauuuuuuuuuacaugaauuugaaaugguauauuuuacuuagagguguauguaacucuuaaaacuacagauuugaacaggaagguucaguggaucugauacuguguauuaaaacauguuucagaacucuucucucacaguacagugauuucucugugcuuagaaauuuaaccaaaggauauaagcaagacacuuccaggcugugacuguggauguccccugcccaucgagagcucuucugggggagcauuuccuguucacuuccauggcucgcuacuguguuaaauuaaaagccaggguacucaccauggauccuuuauauuuuuccaaaaguugaacuucaugcucuggacagcgagacaugcucuguaggcaacuaauaaacugaagagcaaaggucacggcuuuuguugccaguaaagggcagcuuacuccuggagacaggugcagcccuggagugacagcagcagcagcucuuuuguggaugucuggcugcaucuggagugcaugugcccacuuccacgguacuugccagcacguccagggggccuccuacacgugugcaggucuuguguggucacaggcgagugagcguggucugaaugcacaguguaaggaacacaaguugugugccucauuuguuuggggacuugcuuggugcugggcauggcuuuggcaggcaggaagccagucaguuuaccuccuguccucgggaaggugcauauauaggaaugugaaccaaccuauagggaacagggaggcacugagguguggggguggagccgagaugcagcuuugacagacuucucacugagaagacaucugagaagaucaguguggaugaggaaagauguacuguuucacacagcuccuaaauuuuacagccauggucaccugacuguuuccgguuacugugguggggcagaagggccuaucagaggaaaguugugugccuccuuggcaucugggugacagggcugaacacaaggugucuccaagcacuucccagaggucugcuaccccagccagacccagcuccucgucgccauagcgcuuuccacaagaagccggucagagaucuccccacuggagaugagagcccugaggccuuugaccugccagagucacacugugaacgcugcagcgagggcccaggcuuucccgccugagcuuuugggggacauugcucaaacuucaagcagagaggguuguccaggugaggugugccaaggccucacuccacacaaacaggagcuguccaggaagagcucucgcagugaggagaagucucugucagaagugcugucagagcaaagguguauuuagaacacugcagcucuuggcaucuccccuggacuuugaguuuugcaagauuacaaaagauuagguuuucuggcuacuaguguaauggaauucuggauucauuaauuaauguggauugcaucaaaaagccaaguuucaguuaauuagauugaagaccuaugcugcccccagagucagccuccuguuuuuguuuuuguuuuuuuuuuuuuuguuuuuuuuuuugguuguuguuguuguuguuguuguuguuguuguuaguuguuuuucagaaaugcaaaccagccggggagccuguggucugagccagggcucucugugcaguaggccacuccuccuccuggaacugucuccucucuaaguuaaagugcuuaaacuauaacauaucuuacaaagcauuuugaccacuagagugcuauuuuagaaugaaagaaauagcuggauagaaggagagaaaauagaagcagauuccuauguaaaagggauaggcgggaauguagcccaggguagcccacuucccuccuaggaccaugcucucccugauggcauuggauguugaguugcuuuuccugggggucuucugcuuguggcccacccacuugucaauaugcccaaggccacuggaacccaggaagggcucugcuugucucuguuccuuucucggcugagaggagcagguuguauguauuaggguacuuuuugugucacucugggaggagcagguuguauguauuaggguacuuugugucacucuggguguuccuuuccugcacagcuucugaggaagagacacaucgggaacgacaucgucaccauugucuuccaagagcccggcgcccuccccuucacccccaagaacauucguucacacuuccagcacgucuucgucauagugaaggugcacaaccccugcacugaaaacgugugcuacaggugagccugcggccccacuucucacuucuccuggcuuccuaacuaccuaaccucucuccauccuucagaccguccucccucccccacuguauagucuaggcugaauagccaggaacucaaccucucacgugcuggcacuauaaccugccugauauaauuguuauuuauuuuugguagugcugggaauuaaacccagggcuuuguguaugcuagccacauguucuaccauagagcuacauuuccuagccagccucaacaugcuaauuauauuuuugcaagcaguaauugccuuccucccuugagaaaagaagugcauggcaggcagcucagagcagugggguucaauguucugcuuuccugagaggcuaaacagggcccauggcugccaccagccucucagcaggacaguguggcccauccaccaccaccaaggaagugagccacaagcaaaagccuagagacucccaggcagggccuugggggcucagagcccacacuugcuuugaugacuaaaggccugagugugcuucagagcccaagaccgucuuuguuaggccugcucugagaccucgcuucugucuggggcugggucucaggaggacacuaggaugagugacuguucuguguacacugagaggggugcucccugccuuacugcuuguauuggguguaugggaguuuauuuuuuuuucuuaacucuuccaucuucagcguguguuugugugugugugugugcaugcuuugcauguauggguacacaccugcugggcggaggugcacauugcaugugugcaugcaugcaugcauuuggagggccaagguuaaugucaggaguccuccuccuuggcucuucucccuuagacagugaagcccagagcucacugauaugguuucuggggaucugaacucuggucuucagguuugugcagccagugugggaacgugucaucucaaaggagagagccauagcucaucccaugucauuuucuuccucaguguuggagucuccaggucaaaggaugucccucccuucggucccccaauccccaaagguguaacuuuuccaaagucagcugucuuccgggacuuccuuuuagccaaagugaucaaugcagaaaaugcggcccauaagucagagaaauuccgggccauggcuacccgaacaaggcaagaauacuugaaggauuuagccgagaacuuugucacaaccgccacaguggacacuucugcaaaauucagcuucaucacgcugggggcaaagaagaaagagcggguaaagccaaggaaggacgcgcaccuguucagcaucggggccaucauguggcacgugguggcacgggacuuuggccaguccgcggacauugagugucuccuggggaucuccaaugaguucaucaugcugaucgagaaggauuccaagaaugugguguuuaacuguuccuguagggacgugauuggcuggacuucagggcuagugagcaucaaagccuucuaugaaaggggagagugccuccugcucuccuccguggauaaccguucugaagacauccgagaaauagugcaacgacugcuaguaaguauggcgugugucucccacugucugugcuucagccucagaggcccagcagguuguacagggaacuccacuauagucccagggcuugggaaagcagcugcuauuccagagaggacggguucucuuuggguuguuuguuuguuuguuuguuuguuuguuuguuuguugagauaguaucucagggcccaggacaguuuugaacucaucagguagccaagggugaccuugaacuuguaauccaccugucuccuucaccucauaagugcugggauuacagcuguagucuaccaugucccauuuguauggcgcuggagaucacacccagggugugagaguugcaugguaguugagugauccaccaacucaccguccacagccuacuguuuuguuuguaaauaagagucagugaacauaauuagcgaagcucccacaaccccaugacuaggaaagcugagccaacuucaaagaauguuaugaaccauuucuguaauaguugaagagaaaccagaagaaaauuuaaaauauuucauguuugugugauagacacuacacacacauaaaaauacagauuugcuauuugcuaaugacugggcccucuuuacucccuuuugcauguuuguauagcaaauauuuuaauuuaaagauguuaaaugugaggccaggcaaugguggcacacaccuuuaaucccagcacuugggaggcagaggcagccggauuucugaauucgaggccagccuggucuacaaagugaguucuaggacagccaggacuacacagagaagcccugucucgaaaaaccaaaaaaaaaguuaaauguaauguuaauaucuccuauuuuacaaaauuagacaguaaguuaggaaaugaaaagagucaucugucaaagagagagacuucugaaaagagggggagcguuaaggucuggggcuggacaaggccagugagucaguuagcaaugagcuugcuguacaagcaugaagaccucaauuuccuccugagcacgcauggaacaggcguggugcuguacaccuguaaucccaacacugggcaggcagaggugagagaauccuugcuagccagcaucaucaccuggucugagaaccucaaaucgcaauaaagaaaccucaucucaaaaccaagguggacaucugaggagugacgcccagguugaccucugaccuccguacacacacgcauguacacacacgcaugaacacacacacacagauuaaaagauggggucuucccauguaacccaggcugucuggagcuuauagaauaucccaggccagcuucaaacuugagacccucuggccucagccucucgggugcugggauuacaaguaugcgccuccaugccuuaaugugacuuuaacaccaaaccucagcauugugcccaagguaggaaacaagucacaguuuuguucccagugauuuucuuugugugugcuuuagaacaauagcaauaauuugcuguuuggauugcuuggugcaguacaagaagaaagcacguuucagacauagaacaucucacuggucaauccucucccaaggagaugcauugcguagucaacugagaaucacuaaaaagggauacagauuacacuuccuguccuuccgucccggagagugagucucuuuuauuauuacaaggcugucuugagagaguagaaucagccaguaucuguugguguuggagugguuacagucauugcaggcaaugucuaucuaagaccagcgaguuagaggugguagggaccccacauuuuuguagauggugaucuuacugucuguugcgugugguacagaguacagccagaaguguacgcuguacauauuggaggagacuucacucccagagggaccuugggugugccaucugagaguccugggaagccauccucagagggccaugcuuggguggagguuucccugucacacuugaaccuaauagacuuugaauaaagacccucuauuugcacuggccagugggccccacaaaucauggagaugguggcaggcauguggaugggagaugcuguuuucacaggguuauuaugucugcguaaguacauggggcacuugagagacgagagagccugcucuaccgucagggaugucuggaugacuuggguaacacuagggaggaagucaggagcagcacuagcugaugcugccuagccagucucuccaauuaaacuucaggaagcagcuucguucucucucaucugccaggacguaggcaucuuagaugccacuguguuaaggcugcuuagagcaaaguuggaaaagaggugaggacaugucuguggagguuggcaccgagggauugcucgguuaacuguuuggaaugaguucagaucagugaaaaguugaaccuuuuggaacuucccuccugacugacaccagcgcucccuuucugcugaguccccagcuucaugcuggucugggagaagccaacuggcuuuuguaaccauggaaaccuaggccagaugcugaugcagggagcaagccacagcuccccagcugcgcucacagccacggggcucaauaauaggaauguguguguucagagccagguuccuggacgcgagaguuuauuaaacugaaacucuguacacugcccccagggcuuuggggaugggggaugauaccucccaacuugaaauuucccacaaaaaaagugaugucaucaucuucaaaugauguuuaaugagccauguuuuccuuucauggcauuguaagccacauuccaucagugccucugaggguuacagugaccaauuaccuuacuuguggcaccaagccacugagcuggcucucucaaguucuugguauacuguguagacuccuagucuucgaggggagugucauuggagcuuccugggauaucccuuagccuccagggcacaggugacagaaggaaggguggcuauaggaacagagggcuccucugcuaccugcaaagccccucauugaucagaagggcccuugggaccagauggacauagguggucacucccaggaggccagguaggacagauuaggaagucuucaggccagugcaucugagacaguuguggcuuuucucacaguccauucucuccugggcccuuccugaacacaggccacguguugcuguucugaguuagauacaaguacccaaccuggcaaugguagcgcaugccuuuaaucccagcacuugggaggcagaggcaggcggauuucugaguuugaggccagccuggucuacagagugaguuccaggacagccagggcuacacagagaaacccugucuugaaccacccaccccaccccacccccaaaaaaaaaaacauacccagaaagccuuggagucugagaaaugagguugucuccuucuuucucuugcuguacugcauccagaggagaggaauucaaguucuuuggagcccuguuagugacaggaaguggagggacuagcagaaaacgugcagagcucacggcuucuccagccaggcagccugccacaugagccaggguaaaacccagcuuugguucuguuguucuuugucaagggcaaccauggugaacuuuggauucagauaccuuccaggucacuugaagggacagagggguggcugaggauagagccaaaggggagaggggcuugcuuagauaugugcaggugguccccagugggaucccaucugugguauccagggagaaagaucaaaccugccuaacagcuucccuccccucagauaguaacaagaggcugcgagacuguggaaaugacccugagacgaaacgggcugggucagcuuggcuuccaugugaacuuugaaggaauuguugccgauguggaaccuuucggcuuugccuggaaggcaggccuucgccaagggagccggcuuguggagaucugcaagguggcuguggccacgcugacccacgagcagaugauugacuuacugcggacaucugugacugugaaaguaguuaucauccagccccacgaggauggcucuccccgcagguaagaccaggaggcugggcagugugcacugucaccagggacauuccugccugccugcaggauccucagagagcuggugagcugucaguggacaccugagccauuggcgcacuaguuaaaggguuucagaugagcauguggcaugcaccauuggugcgcuaaagagugacaccagauauugacugugagacugagucaccaagaccaggggguggguccauuuggcucaccugaccuauugagacugagugugcacaaccuucacagccugcacagcucaaaucaggaugaguagcuaacaaggcagggccugucuggagcaaugugagacuguaggcagauucugggggccaugcuguucucacacugaagccucagagguguccaacagggacagggcaucugcacauaggugguaggaagggacaggcauaggugugggaguggucugucugucugcugcagacagauggucguggcacucagccuuaaggugacaccacuaggucuguccaaccucugcauccucagcaagaacugcugagagucauaggugaguuucaaaccuugacguuuuacuuucgugugguucuuuuaguacaggugugugggcucugguggccaugcagcuugugucugucuccauccgguuagucaugaggcaggccccagaguuuaccugcugggaggaugcaggaggcugaggucagggcccugcuguguggucauggggaaggaaggaguccuaaaguuccuuucacaucugcaccacagggacccugaucccucagaguacucagaacuuaccagcaugauuaguguuugcucuacauuucaguugagggggaaagacgauugcuuuaaauucgcucaaguuucugucacuuuuuaauuaauuuauucuucucucauauauuacaucgcagcugcaguuuucccucccaggccccuccccgcugcucuuccccaacaaauuccugucauaucaaaggggacauuuuuaugaggacagugcauuggcuguaucuaccuucuggacucaggacacaaaggucuccuuucuccucccucauaggggcacacgccuggucgcaucugugccaugcccaagcugcaugcagcugccacacacuugaagcauggcugaauuuuucacuuuaauuaaaucagcuuaauuaaccacagguggcucuaauggccgccccuuuggggagcucaucccuaaauggggaucuuuuagaaaacaaaccacuccgcucugugucaucuuggucucggugguuaagaugccagaguuuguaaagucuguuagauugaacuuacuuagcacuggcucccagccugguggguuuguuuuugugaugcuguggauagaaccagaggccuugugcacacuaggcguggacuccacccuugagcuccagcccuagcccccuggucuuucaguggccauguuuccuacauuugccaauagguuuauaaaauaaagguuuaaaaagagcugaaauccuucuugguguuaaagguccgacuccuguaaagcccucacaaggaguuucucauaaccucacauuuccagacucugcccauuagacccuaccgccuugucccaggaccccaugagccaaacuuaagauaaagaagccacaauggaagauaaaaaacuauuucauaaaacaaaagucaaauugaguaagagcuaagcuuccucucggccuuccuagaauagaagcugacguggccuguaagugaacgucuuugacagcaacuuuuaagggcaucuguggugggaauacagaugugugccuccucugucagcaagggucaggucuucaguuucuccuggagacaagacaacugcagagaugagugaaaacguuuccagaccugauauagguuuggucugcuguugcucuguaagaaacucuagaagcuuuuaagaacguuagauaauaaaaauaguaacauucucauuaugccugguauuuugagcacaugauuucaaagaauagaauuuccuaaggaauauugaauuguuuuucagcuaaaacaaauaaacaaaacuacagaguggauguuuuugcugcugucuuuuccucaagagcauguuuuuccuccaaagaggcuuucuuaucugccuggaucugccuauaauuaauucuuuguuuuaagugcaauugaaaauagccaggauauuuauucagagacuucgccuuuguugaugcccuucccagagcacacagucuucuccuuacauugcucagcugcccucucucuguucucaccucuggggaaggaaccaacccagcacacaucaagcaggacucuccauugagcuuuuuuaaaguuaguguuuucauucuuccugauucacuuucacuucugauggggaugggcccugagaaugguaugugcuguagucagaaguccucugccugcagcccugucacaccagcucuuagcuaugcaggaagugcugcucugggugucccagccaugccccaguacagucaggcccuguaguacucuguuauguuagaaagagggaguucauguaugugucucacacaugcuccugugugcauguugcuagaggccucaggaaugcuaggcaaguaccaagcugcuuucccagcuuacguaugcaugcacaugcacaccaauaaauaauaaaccuuuuaaauaaaacugaaaacucucuuuaagggcagcuuacauugguuucaugguccuauaguuaaggauacaggauuugccugaggcucugacaucacauuugauuugugguguggaaaauuaccuccaucuucuuucauaaauuggcucuuagagccugucaggaaggaaaggaguuaaaugagcaguuaugugcaugugcacacaucugugugauuuuuuacuauguagugggccucugugcaaguucuaugagggugacagacacggcaaaacuagcuaauuauaaggaaucuuaccucagugcugugccucucugaaugagaaagugccucauucauucauagauagauagauagguugauugauagauagauagauuagcucaguaauacucuuacaggauaucagugagaaauaauuugagaacccaucugcuuccuccugcagccugaggggccuucagguuaaugggcacuucuggcuguccucaggucagugaugccugccugguuccacccuucacuacagaguugacugaagucuuguguggagcugguguguuugugugaaucaaaagccacgccugcucugaagucauuucugagccucaaggacaguccagcugccugccuccacccugcucccaguugaaagaaaccagggccacuuuugguuucuugauggaguuggugggggaagcucauuaaggaaucuccugcugggccaggacccuugaguaaauucuagcccaucucgggagcgacccggagcaccggggaugacucuucaaauggaaaugagcugaggaaugggcucauucuggcuacugggccggaagugcugccacucccugggcugccugauuaaggucuuucugacugagauuacuaaguaggugcagggcuugccaggaaguaugcagaccugaguuuagaucccuaggcccacaggagagcagcccugggagguuggaagcccagcguuccucuggcaagacgggaggcagagcuaggaagccccagaaguucagggccugccagucugcugugcaucagcgacccccguuucaagguggaccgugagaauagacacccaggguuguccugugacuuucauaugggcaccguggcccacaugcauccacccacccacauuuacacacacaaaguuguuggguuuugguuuuguucuauuuaaagaucuuuuucuguuuuucaaagaucaggccccaccccuaacccucgcauucagucagugacauuuuaggggaaaggcauccuucaaaggccgcugucugagaaguaaugacucuccagagccaugcaugacuugccacacauugcgaauuuaguaaauauguccaauaaaaauggaaaugaaacuccaggcuguacaucuggcuccugugauucuuugugcuuuguugacaaggguccacauuuccaugugacacagggcagcagagauuuccauggguuaucuagagccaaacugauuguucucacaguguucuauaaaauuaaagcuucgugcaccaugccuuugucugucgccugacucccugaaguacaggaagagggaagaaugggaaaugagaaacaggaagaaaauucuguuuuaacagcuugugugugugugugugugugugugugugugugugcgcgcacacacacacacacacacacacacacacacacgagagagagagaaagagagagagagagagagagaggacucaaaugagauuuuagauuacaguucuaauuuguuuuauuuguauagauaguaaaauggcuauuguaucuauuccugucuuaccaacccucuaaugaguccuggugugaaauguugaaacuguucaggacuugaagcucuagcggccacccagccaccugacacaugcucaguccugccaugccugccaugccugccagugcagugauuaccugcgcucuaagcgugguaagcccauaaucccagagccauugccggguugcguguuuucaucacucucucauucucuuucucuggcauccauuuguuuauuccuuaauucucuguucacuuguccauccaugcaguugucuguugguugguucaauucauuccacuagaauucccaacaacucaauggcagaaauugccaaucacuugcauuguugacaagucagccucgucuccacucuguugggucccuuuagucugcccgguguuauuacacaguuuuucuugugagugauuuguuaacugaagcaguaccccuuucccugauaacaaagauugugcagcaguuuguaagaccaucacccuccuguuggccaguuccaucuuacaguuuacauagaugcuguuacugcucgauaacaggagugcaggggcaacauggcagccaucccaugccagccagguugguuaccuguggccuagaugguggacaacuagguguggccuucuuagauaaccuuucguuaucuguagauaccaggaaccguuguaucacauacaaguguuacaaugcagaaaacauuuuuuucugcucuugaguuuucugagaaaacucugagaaauggugacuuccuuggucccucacaaccgcacaugacacacagaauaugugauaugugcugcaugaggugaggcacuggguucccaggagcaccugugaacaauuaacuaaguggugacaauacccauguggucaggugucaccaucaaauaucugaucauaggcuacagcuacuacagcucaacacaguuguucaauucauauuuauuuauguaugcuugugugugugugugugugugugugugugugugugugugugugugugauguagccauacaugauaucgugcauguggagcuggcuuugaaaccuuuacuuggcuuucagggcucaaacucagaccuccagguuugcacagcaggcaucuuuaaccacugagccgucucuccaaccuccaggaaaaaagaaaaagaaaaaaguguguguguguguguguguguguguguguaaaucccagaacccuauaaacuuagaaacucucauggucaagaacuuuauaaggccuuugcgguuuccucuguuuuguagaaaccgaaagcaagguugccuaucugugaagugcugugcugcauucugaggcaguggcucuuauguaccuguaccccagauccaucuucuuuaugcuucuugcuugcugcccagugcaggcuuccuucagaagacuucuguccacagaguucugcuggcauaucaagagucuuuauguuuuguaugauccagucuagacugcuuucugacgcuaugauaguuucagagucuaaaguaauugucaacaucacauacuagcaggugagaauuuuaggcccaaguccaaauucacucuucagugggaaguuugaugggugcugagugucuaacuaggaauagaagagacucuagcaccuaacugguccaggauggccaucuugagagaagcuguggauaaagggacccuacuucagauccaagaguccagcuuggccagagaugacucuguuucaagugcuuuuauuauggagggcaaacagacucugcuaggaagaaggggugcuguaagaaggccugugcaggugauacagaggccuuccugaaucucugaagucaugcugugcaugggcaguugguguagguguuugucacccaugauuggcaguagacauuaccucuuuguuagaugugguacaaagcuaggaagugggggucacaguagagccaagaagucuucuauaggguaacguuaacauugccaauucgacagaauguggaguuaccugggagacaaaccuagaagcuucuggggauugcuuuguucagguauuuugucaauagugaggaaaaacacaugggagaugggagcccaguguuagggagcaggagagucaacaggcacuccguacaggcugaaacuaucccaaaguccucgugcugaguucagaggucagaauugcuuuucaggguacagcaccaaaauauagggugcucuaaaguuucaguccaagcaacucucagcccccugcagacuccuacucuauccagugcaucacuggugacccuggccugcaacgcauucgcucucagguuauguggugaagagauuacagccagagaagucacuggagagaggggagauguuaaaaucaacuuuauuuuuaaccuagaagcuagauuucuauugaucucuaccuaggcuagaaauugaauccugaaguugaugaugucugugaguguuguggagcaaagaggaaauuggugugcugauaaacuagugaucacuuccacggccuacaccaacguguuuuagcuucucacugacaagaaagcucacgaugugucuaaugcuggcagugugcuccugcacggugacucgguccucuggguggaaaggaagccacuguguacuggagcugucugaacaaaugugucuuugccugacagagguuucacuuacacauaagaguaguagagcuccucccaccccuuaacaaaugucauuuucugacaggucuuucugacauguuugggccaucugcaguagucuaagaguaguuauccagggucccaggauguccccagaguccacugugagagccacguaagcucugcuuucugucucuauggcagaacaccugaucagugcagcuuaagggaggagggguugccuuggcucucggucugaggaguuacagcaggagcacucuaggacuccucacaucucagaauagaagcagaggcaggcaggaaguggagucugggccuuaaccucaaggccugucuaccagagauccauuuccuccuauuaggccucacugcccaaaacaacaccaucaccuggagacugcguguucaaacacacaaacuuacgugggugguucacauccaaaccaagcagggauggugaagucaaggcucaggcagguccgccucugcacaggggucucugagggcuacccugcaauucuucuguauaugcauucucugacgauucccuuggaccuguggaacagagguaagguugagcaggucugguaacuuccauuacagucuauguaguuugacauauuagucacgggagucaagaaaagucuugcucauuagaguuagugcuaugaaagugucacuuaauagcaguuacaugugugugcacauguauguguucacaugcgugccaguaaacauguaaauguggaugcacacguguguagaaaccagaggucaacaucaggucucucccgcaguguucuuugcccuguuuuuugagucagcgucugucagggaaccugcugugauuugcuagaguagcugguuagucagccuuggggucacaggucuccaccuccccugcauugagaccucaaauucgugccaccuccgggauuugggguagguuuaagggauugaacuuggcuccuaugcuugcacagugugagcaccucagugacugagcuucauuugcagccugagagaacagguagcucuuguggcagaagacuguacaucuaucccucccucccucccucccucccucccucccucccucccucccuuuugcauuugaaaaagccucuugcauaggacuuugagauguuuggagagacuuaguucugcuguuccucacucugccuuaugcacaacacuccccucaaauacgaggugugagugcgcauuuauguaaguucuuucuuccgagauucaaguuaaauugaggugugcuguuggcagcuagaguccacaggugugaauuaaguagagcacccuagucucagccauccgcccucccuuugcaagcgcaggccuuagaagugugggcagagccuuagagacuagagacgcacagccugggcuccccugcaccgggggaccgcucucuggaagugacagcagacacagguguggcccuccuacuguaaugucccauuucgugacuuccaguuagaucacuggccguguggaugaaucugcggucccagcggguguugaaucuggauacagagcagaauacucaugaacuuaagcucuuugguaaauguuuccucaaauuccguuugcaauaaaacaucacaauccaggcaaaucucaacuuaaauauugacugucaaacucagaaaauccagagaaauauaggcuagcuuaugaagcaaguuuggcuuugguggaagggaaugaaguuagaaggugaggaauggggugugugguggucagagccuccucugaagacagccugugccugucucauggaggcuuuucuccugcugcuccccaagggcggcacugacgcauccucaggguugugagauacaaaccagacugcucuguuggccgguucucucuucaugguuggagccauugggaauuauuuuaaucagaaaccuuccagcauggcugcagagagcagcgcuccggccggcccuccaccccggucuccugccauguccagaucaugccuuugacccgggaucugauugcacaggguguauguagguggcuguuugucugucugugcuucgugcccugugggccuucaaaucugguuuucaugucuucugguucugauauuuugguaguguuucuuauuaauuuucuaccuuaacacacacacccuucuuuuuggugaaagauggguguuuugucucuaaguucuucggaagaguaccucaguuugccauucuacugacuggcuagauauuuuuucuagacuuuaagaucuaguuauaaugucugucaguaucagagccuuggcugcucagggagcuucacuauaaggacugagacauccauugccuuuauggugggagugguccuuguucagucuuuggggacaggcugaacuuacagaaagaacugugaggcuaagucucaucuuucuccacuuccuaccuacucagugucacuggccuaaguaccugucuuucugcagagcacugaagagcccugcuuucuaggacccucuguuugcucccugccugcuggaccucagggccuagcguugaacuucucauggacucugcauucacugugucggugggucaugcuggcaucucugacugagccucugugggcugucagggcaugguaacguuguucccucuguguguccuggugacguucccucugugcguccugggggcugcuaagcuccugcugcuccucugcaauguuucugaaagggacuggcaagccuuacuccggcaucugcuaacggguggauguucuuggagcagcucuuuuaaaggguggcuaggagacaguuuuucacguugagugucugagggcacugccuucagaggcugacugcugagccagcauggccaguugggugguugacacugaugccugggcccuggugaacaaugucuuguguccguguccagcucugugaacaauauuugcagcacuugggucuggccaugaccuugccguuuaauagugagcaggguugcagcaucucugggcuuugauaucucgugacaguaggcagaaguuggaggaauacagaagggcuuugaaaacaacuaagaauaacccacagcauccaaagggccguggucccucccacugugcagcacuucccaacccaaccagccuaugguguguuggcaggcaggagaaagcuacaauuggaucuuuuagaaucuccgucugacuguuggccagacagcagcugaacgguuuugagcaucuagggaaggaugccuuagagcacauguaaggugccauccuguuaggccccaggaagcacaggugcacgugcaggagagucugcuccgccaugagcaggccuugccugagcccuccaucugcucagccacgagcaggccuugccuggguccuccaagaagcuauagucucaccgccucuucuuggcuccacaggggcuguucagagcucugccggauccccaugguggaauacaagcuggacagcgagggcacacccugugaguacaagacaccuuuuaggaggaacaccacguggcaccgugugcccaccccugcccuacagccaguuuccagagccucaccugugccuggcacaccugaccgacuccagugccagccgcugcugcagcaggcccaggccgccaucccccggagcacauccuuugauaggaagcugccugauggcaccagguaacaccacagccucccuuagauacuaacugagcagccuggcugguucugugauagcuuguugugaguuuuggcaaacagggcaaugggauagccucagucacaguggugcucagagucuagccuuguccuguugucagagcagauacccucugcccacccgggacacagcuuuuagagcuaaauacaguaacacgagaagguggugagagcucagggcaccuaaauugcauagguuguguuuaagaccaaaacaguugauucuauguguaauuccugucuaaacauuccugugaccuacaccauagagaugugagccuuuacucuggacacuugaucccugagggcucugaucugguagaccugucaauacacaccaggagccagggucuugcuugccuauugggcuguccccugggccucucugauguaugucccucgucuggaaaauaaggaggauguagaccccggcaggaccuccuaaagaccacccagaucagcaucacugaagggcuuagaaccaggcacuacacacuguaaaccuauacaaauauuuacuagaauuaacaaaauguguagcucuucuugucuguucuaguuuaugcucccaggaggagcaggaaucuuuuaacuuaacauuaaucaagucaucugggcuccaagccucuggacuugaggaucaugggguuuaauacgcagcuucccugcgcucaaagcacacacaguaacaccuggggcaagagucugcagcaccccucuaaucacauagaaccuagagaauuauggaggaaaccagaggggcccugcagccagagggaucuuggcgagcaucgucucugucaagugacuucucauagagauuuggaaagugaucucuagaauuacaguaggcagcugugugaaagucgguggucgugccacauuauagcuuugcuccugcucacuugugcacucgacccagaugugaucugcacuaggcucuguguaacagguguaaguggugucuucugacuguacacucccgccgcaugccugguuuucuguccccuggagccaccauugugccuucaccuucagaaagcaaauguccccaaauccacacuccuuccugugauggguuucugucauaaaacugagaaaucucgggcuucgccgauucucagauuaucucccugauugguuccauugcacauugcuuugugaauggacauagggaauuuuuuguaaucagcacaagucagaauggggggaggcuggacugagauguccaaacccugcugcucuucuuccccuuucagaaguucucccagcaaccagucaucaucuagcgacccaggaccuggugggagcggacccuggcggccacaagugggcuacgauggguaaggcuccuuccugccuuugucuccccaggggagccugugucuguaccugggacucauucaaaugcauuccugugugugagcugcauagaaggccaccuguaacaagcacuuuuagcaagugcagaguuuucugauuaaaucagaggcucacacuguagccuaugcugguuucuaccucaugauaauccaucugugugcuggggugguaggugugugugccaccaugcccugcugggaaacucuguuucugugacaguguuccugggucuucccuguuggguuuuuuguuuuguucugacauggaauggacuucugagcacaagagaguagaucugaggacuuuguggaugggaacucucgggaaguuccccugacucaaccugcuaauaggagacagcuccugagagccagagaauaguuuaucauugaagcuucuucacucccuguuggagaagcaacauagcagccaccuggcuggagaggccuccuugggaggagccuuugugauuugugucauaccccaggagucaggaguguggguacaacuggagacccuugugaauacacacacgcauguacacacacguacacacugaccuuaugugggacucuugagguagcauguagcacagcauucagguuuuagauguguguuguggugacacaguccgucuaugguagucaacagcugggcccuuuuguggacaaaacacagucauccauggaggccucagcuggcauggacagaaaacgccuguccauggaagagcauggcaaucauggcacugucuucaggugcagagcagaacuccaggccaggcauucugcuguccaauuuggauaccaugcuuuucaucucacauggcagacagaauucuucacagcuaaauagcaaaucccuuuucuaagugaagccauggcuaagcaaggagagcagagccucgauuuguucuuauauaaaugggaagccuuguguagucucagacccacgguggacucagcucauggcauuacacggcagcacaagcacauugccuucacuuccuucauuucuaagauuauguuuuccuuuuuccaguucccguaucacacaggccaucagggcagagucuagacugaaucagguuuucuuuucuuuacaugcacuaguguucagauguaucagugccaugcgcuuuagucaaaaguaaggccgaucaugugcuccaccagagcuggaggacuugcggccuugacgcugguggugcguguuuaucuguugaagcuugcugugugucagaccuggugaaacagcauccuuuucccuggagagaucgaccaggauacuguguuuccacagucaggggacuguuuccuaggacagcaucagcccuggaauggugguagccucuguaggaaaccucagccaucucauaccugauccguccuguccucugcuagcuggcggugucagaaaagaauagccggacucccucuuugcaggugcccaucaccccuccugcuggagcaccagggcccaggcucuguggagugcgauggaaccggggagcaggaggaccucuuggagggaggcaggcuuccagguaacacagcccuggggaccgggccuccagggccccccuugaccuguacuuucucccugucuccacucauucacuuggacaaccauaguugaugaguuucucugugagccaugugaggugccuguggguggcuggcugguucugggguagcuaugauuauagcauggcuucagauaacugguuauaaugccuggagaaaucugucccucuguguggggacucugcugccucccgugugcuugcugauaaccugggaagucauaguaaaguuucaaaccaucagaacccugucuuccucccucuugcuaacacuggaaauugugugcucaacucucuuuaaugucacagaaaccaaauggcauggcccaccuuccaagguccugagcuccuauaaggaaagagugcugcagaaagacggaagcugcaaagagucccccaauaagcuaucucauguaaguccucuaucuacgaccgaucgcaccuguagcaggauugaugugugucagcauauagaggguggcacagcacaccuguccauggugcucuagaacaugggaugcaucucaguacccaguaggacuacauaugguguuuccaugcuugagagugugggguacagcccagcacacaguauggcagcaugugcccacaugugguguucagugcugugugggguucagcccaguucagaguagggcagggagugauugagaacauaaacacauuccagcacacagcagguggcacaccuguggcagggaucagacacguguuauuuuccacaaaggacacucauaaaagaggauaaaaagagaagggaaauggguaaguuuuguuuauuuucucaguucaugaaggaccacggaaagacuacagcagauuccugcuaaagccaacaugcacgucacccugccaaccucgcuguucacggugauagugaugagauccugcccccaggguuagcuggucaaccauuuagcuacuuagugggacagugcaguaguggaaacagaaacagucccucucgccagaggagcugcagcaacgucccucugcugaugucacugagauguccguaaccauagcagcccagcagccugcugagaguccacugacagcagguuccuuguuaaucccacagaccagcuuaucuauaccauaaaaugaggggaguccuguaggagaagcagcuuucaaugagacuccuuacaaaggagcugcaguugggugguuugaaaaugugcaggugaaagaaacuuacaaacuccugggcaacacucuucccuccccuuggcacaucagugagcuuugcaguuccccuaacugcgcacagccauucuuccugcagccacagcccugaccuggccugagccacuuccugaguccacucacaucugcgucuacagacguccagaguaguucuguagaggaagacaggcuguggaggggccagguugaaaccagagaagccaggauuugcauaaaggugcaggaggauggagaaaaaaagagagauggccaagccccuaggaaauggccuggacaggagcauugucccggcuccaaagcccugguccuacugguucucgaacugggacagcugagucggucugggcacagugacagagaggaucucuucugucuuggcauuggucuucccuacagcaugggugauuuucagacaguuagucuggaaucuuccucuugggacuucacuuggcuuuagcucccugagagccugcgugcuucuuugcagggcacuucacaguugcagaguccuucucugcacaggaggcauguggcacuaugaccucagaaagcacccagggacuaacuggacguuuuaccauuaugacucagaccugggucuccuucaccaaacuuggagucuuuaagagaaaugcuauacugacuguaaauggcaggaaguuuauaaauguaaacugaucuccuccucugccugaguuuuauauccuucuccaucuauauaauccuugucagugacauuuguguguuauacaccagugauugacuaaagacaggaugcuaagcuccugucagugauggaggaagcaagaggcaggaccucugcaugagaccaggcagaagcagacagaucccugggacuuaccagcuggaaguuaaaagucaaagauacugacuccaaaaggaaauagacugguacccaaaggagcaaagcacgcacacacacacacacacacacacacacacacauacacacacacacacacacacaaacaucgacacacauguguauacacacacacaaaacuaggauauugagaaaauccauuucuauaucuauugcugacuuagggagcacauaaaauucaacccaagccuuggcuauagccuaauguuuggggugaucaguauauggggguuuacccaaaggccgucugucuauccucuucuccagauuggggauaagagcugcuccagccacuccagcagcaacacucugucuaguaacaccuccagcaacagugaugacaagcacuuugggucaggggaccugauggaccccgagcugcugggacugaccuacaucaaaggcgcguccaccgacagcggcaucgacaccacgccgugcaugccagccaccauccuuggcccagugcaucugacaggcagcaggucccugaugcacagccgggcugagcagugggcagaugcugcugaugucucgguagcugacgaugacccugccaagauguaugcccugcauggcuaugccucugccaucuccagcagcgcugcugacgguagcaugggugaccucagugaggucuccucccacuccagguaagccagcauacgccaaacugcaccugcaguauggguggggccugaggcugucacugcuaacugcccagccaucugaucccacagagagugcucaucuccugaacucugcuauugaguugugugucucuugccuccccucucagccugugacccugauaucuuuugauagagagcugcaaaccaguuaaucuucagugucugucagccauguccacccugcaggccaccugugucccagguuaucugugaaugcauugugacucacuuauauaugaaguaucucaccauuccugucagaaaccguuguagacccuggaggagggaaggcacagcagcagcuccuuguuggggacucaccucacucccuuauguaagcuugugaacaccaucacacuaucucugucccugaagccugauggcaggccauguacugcaggaauuugguuuggggucugugcaugaacaugugcacauaguaaauugcccacagagaccagaaaaggaguuggacccucuugaguuagaguuauaggcaguugucauucauccagugugggugcuggaaccaaacuugagucuucuggaagagcaguaaucacuccugaaugcugaacugucuucccagcccccaguugggauuuuuaaguaagugucugacuaagccugauggugcaggccuauaaucccaucuacucagaggcuaaucaaggcugccuggggcauauuccacuuaaaggucagcuugggcguguuagugagaccugucucaaaauuaauugauuuguuuaugaaguaucucgaggcugugguguaugcagccccccaguguuggggguaaagaggagcuaaauauaaggggauuuuauccuaaauauagauacagaauacaugucugcgcaugguuuuguacucuggcuugacagcugucuaucuauaugcugguuuaaaagcugauaauuucagguuucuggguucucuuugcgagacucagagaagaggcucgugugucagugugucucagugugucucaucaggggguguggcuucugcucaccuuugcucccugucccuggugcuguccuuccagggcuuugggucacucuccagcuuuucagagcuuccagucacagagcauagauggacaaaccacaguggaacaguccugugggaccuagaacucugaaaggccuguccccaagggguggugcaugccggccccugguuucuggugacaggccucugcuccugagcaguggacaccagagagaccuggagccccccucugcccuuucuuggauaucacugaagaacagugcccgccaugagugcuggguaugaccaguaaggucgaccuacguccucguaggacauacaaccaaggggucacucucugugccacuuuaacucauggaacccaggcaggccaagugacauugccccacaccgggugcccugucuuuauuucccuuguggcuaaaacuuauugucauuugcuggcuguguucauggcuaucuccuggugagaaggaguucuucucuaaugucuacagaaggcacaggucuccccugagaggucccuauacugguuaggaaagaaggguugauuuugguuugugauuugagggauauagucugucguggcggggaggacuuuggaaggaaaaggucacguggugucugcagucaggaagcagagaugaacgcuggugcucagcccagugucuccucuuuauucaguccaggacccagugugugggaugcugcuggccacauuuaggguggguuuucaacauaucucagacaggcacaccugucaccucagaaaucacagaucuagucaaguugacaaaaccaaacaucacacccagcacccaugugucuucugcacuguccuuggcuguaaaccaccauggcugagguggugccacugaggacaacuaggacuucugcugggugugggcugcuaagcuguggugagacagccacccuuccagggaagaggacaggagccuggagcuagcuccuguugaccaggacagugggaacagaggacggggcugugugccaaggagacauuccagcugcuugcuuuucacuagugcuguucaaugcagcucagugcgagauaacauuauauucagaagucacaugaguucuaguuccuggaugauucccacccuccucggaacuggauaaaaguuggcauucuguaaaagccaccuuggggucuuguagcccugcagcaucuuuucaaaguucaggccacuuguaagagaccuggugucaagagucaagguaccucagggacucguggaaucuguauagcaaagaguuucguguuacugcuaaguggaaaguguucaguguucuuggacacuugccuucagugcacgcccuucauuaggcaaagaaagggaguugggggggggggauuucuacagcagcugucuauuaauacgacaggcuaagggacuagaagccuaugaggagcuggccugaagcaccucuuuggccuaggguuuuguacuuaugagacuggaggcaugagcagcugaguugaaauuugagucacugaguggccuacagcuugccugcucuuugcuguagcauuucccccaguuguauuucucagcuugcuccugccacacccgagcguggggagccucuggacacagaggcuucccguccagcaagcuaugugguagagaggucaccugccuucccagcccaguggccagggaccacacgucacugcuguaucugcuaugaugccaccuuuggcugucuucacaguggcucgcagcacucaggaagcccuucagcucacugcuccaaaagcaccggcucucuggacaguuccaaagucuacauugucacucacggcggcggucagcaggcaccuggggcggugacaaagccuuaccacagacaaggagcagcaaacaaauaugucauuggcuggaaaaagucagaagguagcccaccacccgaggaaccugaagugacggaaugccccagguaaaucuauaaccauagucauuguacacccuuccuaccaucucugucuguccaucugucuguccccugguuaggguuauuguugcugugauaaaacaccaugaccaaaagcagauuggacaguaaaagaguuuggcuucuacuuccacaucacuguugaucacugaaggaagucaggacaggaauccacacggggcaggaaccuggaggcaggagcugaugcagagguugcuuacuggcuugcuucccauggcuuguucagccuacuuucuuacagaacccaggaccaccagcccagggaugguaccacccacaauaggcugagcccgcccuauugaucacuaauaagaaaaugccuuacgccugaucucauggaggcauuuccucagucaaggaucauuucucucagaugacuacagcuugugucaaguugacauaaaaccauccagcacagaguacagucaugugaguccagaggacacccucugaugaggcccugcaggugcugccugccuucuuugagaacagggccugucauugaccuggaacucaggccagugugacuugccagcccuugggccccagugacccuccugucuccaucugcccaacauugagguuacaagugcagaccaccaugcucagcuguuuacugugugcuggggaugggugcaaggcaagcauuucacccauggggccagcuccauucuugccucugcuuuaaacacuuuaaauguugggauuuauguuuccgucuuuaaagucuucacuuuauucugauggugacgguggugguggugacagcaguggcgguggugauggcagucguggugcuaaugcuuguggugaugugcagaagcugcgguggcaugugucgagugauccccuccuucuaccauaggaauccugggcuggagcucagcucaucaggcuuggacuuggagaaggcaggcccuucaccuugaacucggagaaggcaggaccuucaccugcuaagccaucucuguagcccuuggcuuuuauugguagcagaguauaaagcucugcugucuuugacucuguaugcagaaagcugccugcaguagagucguggugacagcugguggugguguggcguagucuccauggugucucaaggccaagagcaccaucaaccccacagucagagaacacagaagcaggaacacugccugcuuguuuuguggaacucuugagguuugauuggcagguagggggugggggggcagauauccuauguucgugaaaaaaaaaaggagggaaaacugaaggucugguauuguucagaguagcccaagaaacccugacuugugcucugcuagaggagcgugccaugguguaggugugggcugugugugcggugugugccugugaacacacagcucauaggauugcgcacacagcucaugggagccugcacagacucuugaagaauaaccuuaacuaaugugccuugggcucuccccauugugauuuugaagauagugucugucacuggccuggagcuuacuaagucuagacuggcugagcagugagcccaaagaucugcuugucucugucucuccagugccaagcugaccaccaaucuggcuuuuuuuaaaaucugaguucauacuaacugagcuauccccucaguuucaaaugcuuucuggacuuucaucugacugccaagggacagcuuauagguagacugcagcuccucugaaccuguguucugguuuauuccaucaggauauauggugagauggacaucauguccacagccacucagcacccggcaguggugggagacucuguuucagaaacucagcauguccuauccaaagaugacuuucugaaguugaugcugccggacagccccuuaguggaggaggggagacggaaggugagugaguaaccacgaaggcuuuggugcaacuccaggugcucauuugcuccccacagcccuuccugugguccaccaacagcccgguguagaguggccaucaccgcugccucggaugucaagguuugguuuguuuauaguacugaggguggaaccccagggccucacacauucuaggcaagagcugcagcccagcccuggcccuugccacuagcaauuccuucagagacaaaugagcugaggaggcugguguggggggccauuguguucuuggaguugcucugaaagccaggcuggcuccccucgggucuuggcucuggcuaugaccuguuacauuagcuuaugcaaaugggucccugugugcugaugugauaaagaguaggucaguaacuguccuucagggucagggcucugccaggaagugacacacaggagccuagcaugguaccuggacacagccggcccucaaagguaaccagugaggccacacugcuuaccucgcccaggaccuccagccuaugcccuguccaggucggccuggcagacugucugcuccagaaauggauagagauugguugcaaccacaucuaucaagccuugcauucugccacacagagcugcagcucucagcgacagccuccucacacucaagucagcggugccuucucagugaggaguucacgucuuugcuuugcuccucccaaguucuccucccuaauucacuucuuaaaauaaugcaaagcaggagcugcuaagccugaugaccugaccuggagaagacagacagacugcccuccaccaguguaccaggacugucugugccccacacgagugaaugaguuuaacaaugcaauguuuacaauaacgcaggguaauuaaaaagcauaaauaagcaggccagucacuucucuuucaaguagcugagacugguagcagacuguggagcacacguuagugucugguucuagaacagacccucucccacuuguagucaggcaucugugcuucccagggcaagugaggcauuaccugcauggcagugagcaccagucuguguaucuuaccgcaguuagcugccuuguguuccuggagcagcagugccaucagacacuacgccugucccuguccacugugaucugagcauccacacucagcuguaaagaacuuacuggggugugaaccgggaaucucgccagaaugucucacaaggagccuuuucucaacgcuucuuucuaucuggaucccggcuagggaacugugugugcuuggguucaaaggcagaugaccccacagcaagcaucaucccagaauggcugaacuugugcuugacauguguguuuucuucuaaaacaaauuacuuccccagugccagugagcagaucgaaugaguaaaacaugggcaauagcagggccucuagccugcuugccacauccagaaauguuacuggccgcucuguguguguuagaaacaguauuagagugagacgauugggguucagugccacaaaagugcugcagguucggucgagucccugcuucuuuaauuggaauuauuuuaguguaugaggguggacagcagaaucacugagccuuccaauucuggguuguaguucauuccagauacaaucaaggugacaaucaggaauaaccaccacaauccaccccuugucaaccaauacaaaauaacaucucauguccacaugaaacaauaacgaggccaugaauacaccuaacaugauauaacuauuucucguacaaucucaagcacauuuguaaauauacaauaggccagugucccuugggaacauucuuuuagugucucuacuuaaauaccaauugaugcuaaagaaauuggaagaaagacaaauguauucuuagcaaaauaagacggaagcauccauauuacuuuaaaauccucguuucugcaacugguuccauggccuucgcugguauuuauaacagugaugucagugccuuccuuauagcuggucauacuacuuucaugucucuugcuguuacuuuaaaagaaaaaaacugagaagagaaaaggggauuuauuucaucuugcaguuucagauuacaguccauaaguguguggaaagcaaggcaggacccucaaacagcugguuuacagcacccuacagacaagagcagagagaaguggguggaugcuugcuugcuugugcucugcucaguuucuccacucuccugcacacaguuuaggcgcccaugccuagggaaugguaccacccacagugggcugagucaucccucaucacuuagcuuaagacaaccuccacauacuugccacaggcuaauccaaaguagacauuugagacacucuacccaggugguccuagaguuaugucaguugacaaagcuaacccuugcaaugguuuugucccacuaacuguaaauucaauuuccagcaauuauacaaacuuuugcaagugguaacuuuuaagugaacagcagaauuuacuggauuuaaauuacuucucuuaagcauauuuauauggcucuggaaaugucaguguucagaauuaguuuuguuauuuagacucaguuggacaucccugcugucuguuggugaauauuaaaauguagucauuucuaaucaccauccauccacagugugugcuucuaugaauaucaguugccugaaagauggccuugcguauuugcaggagcgcuggccucacuacagcuccgugucuaaucuguacuaguauuucacagagugucagaggaggggacucugaaacccaggcaugguccaggagccuuucugcaugcuugacuuuccugaaccagcagaaaacucaugaaagccauagcacaggcagacaacccugacugcauauuuaucguagcgguuugaucuaguuuugagacagucuugguaugguagucuggccuuuacuugccauguagcccaagauggccuugaacucucgguagucccccugucucagcuucccacguauucggaguuauggaugggcagcacuacucagaccuucacauugucaaugucccugccuuuaugacccggaguuuccuucacauugcuaacauuccugccuuuaugaccccuaguuuucguucuacgggaacgugucuccacggaggucgcuguaccgaacacuguccgaugagagcgugugcagcaaccggaggggcucuuccuuugccagcucacgaagcuccauccuagagcaggcacugcccaacgacauucuguuuagcacgaccccacccuaccacaguacgcugccuccaagaacccacccugcacccagcauggggagccuacggaguaagugagggcugugugggaggacuugcgggguaccugugguuccaugugauccucaagguggauccagguguaacauggggugcgaugucagcuguuuggcacuauuuccuugucuucuaaaccguuucuaaguagcagacuucaaggugguuuacauuagacauuauuaucaaauacuguuuuuacuuuaucucugaaggaagugauguguagacucuguaacuuuuucaaagaggagcaguggcauaggguggcuuuucaggcugugccaagcauucuuaucgguucacuucaugguccugguagcaggggguaacagguagguguugggacacccagcuacagcuuuguggccucugcaugucaccucuguggcccugugucacaccacaccaugcucacaggucagauuuuaaaacuguaauuuuuaguguccuguauaucugugugcacacacaugcacguacacacacacacaggcacauauacauguagagacagagucucucacugaaccuggaguuugccaucacagcuagccugucuggccacccauucccagggauggaauugucuugucuccccugcuagcacugugguuagaggcaggcaccagcacacuugguuauuuucauggcuacuggggacccaaacucauguccucaugugugcacagcaggcauuuacccauggagccaugucugcagccagagugugaugguuucuaugcccggcuccauuccugcugcacaauaagccuggcaguuuaacuauaaagacauauucagguuguuugucaaauuucaucauagggagaacuaucuuuagaaccaguuucugcaguguauauaaacaucccaggcuaucugacauaaggcuucuaguagugucucacaagcuggucugaaccucacccugugcagugcucaguguggagcaugguaccugccuguuauaaagucucugaguuuccaaauagcaaggcaaaagcucagacagacaccucugucccuaacccccaccccacccccacacugccucuuuuaagacaggguuuuguguagcccaggauggccacuaugugucuccugagagcuuuugugaagcucuugaaguucuguuuuaugcucuuguuauuuuuccguuucccacauacaaguggguucuguguugccaggguuucuauucagcccuucuauuguuccccuaugagagacacagggucuuagcuucggugucuuaaaauagugguggugaugaugguggugauggugcugauggugcugauggggauaaacuccacuucuuagcuauuagguucuuacaaggacugagcagaaaaugcugugguuuucauguguucucugcuccugggagacucccucccuaagugugagguccccuguccugaccucaucccaagcagcauugcacuuugguuacagcggagcccagugaugcagcgcugccauccaggcccacagucccuguguacgguuucacacuguacaggccugacagacggacggucaguaacacaggccugacagacagacagucaguaacacgggccugccuccgcaguguuguacagagaguuucacugcccuaaaaagcuaguuccuugaauaucccuccuacccuccuccuguggcaaguccuggucucugcgguuccuguguugcugcgacgcccgguagcuggaguguguggcguucaugcugccuuuccuaguagcagcaguugaggcagcucuaagccuuucucaccuaugaauccuuucagaacugcccacagccuacagaggaaagaagcagaugcccccgucccuguggcuccucccagggcccucgcuuuugggcgcacucccuuacuugguaaugugccucccggagccugacccugcucagcucagaugcugcucugggauacaaaugggaacugaaauguguaacuguguguaaauaagaagccuugcaauagcauguagugacaucucccccacaaggccucugagucccucccgacugcauccccaugagccuuaagcaucucggguccaggugggggaugcuaggcccuaguccacgagugccuuaggaaccaugacacuuuccaucugucuccccaagaugcccaaagggaacacagaugcccucugagaauguggccgcagacugaguuucuacaguguaaacccugauccccaugaacaagugccugggaauaccucuuaaagagaccuaaacauugugucacaugaagacuuggaguguccuugugacgucuucuagcuuggguagcuauuuuuguuaaacugacccaacguuugaccuugggaaacaacagggagcaaccuguaaaacucacauucaagagccaugugguugcugucaggguggccccucagcguuuauaacaauaccaauaaagugagacagucaggacaguggagugacaauaggaauccacaagacugguauccagacauagagagcaucggugggcagcagggccuacacaguggccacacuucagagucuaaguucuccugcaguguggccagggauggucaagcagggacauugccagcuucugcccagaugcuaucuuaagagucagucgugugccgccacaugcucugcgacuacgccuagggagcugguggccagggagcuagucagugcugucaccagcuuucuaccugggucuccugaggcaccucaaggcuuuagagaguuagguuugaaaggguagcuguggguaaccauagcaagggagucuuuucuagaagcccucaagccuggagaagagagcaggaacagugugugacgucacaugcauggcggugucuccuccuucccacuggacgaugggcaguauucaucugccagcccuggcuccacaugggucuuugcugguuucgcuguccucugucauggacuguacuugcuggcuucccaguguaaaagccaaguuaugccugcagagguguucaugucaguuaaagacuuguaacagacuugcugguuugaaacuuuggacaaaaaauuaacuuuaaaagguagaucuuauuccuaauuaacuuauuucuacucaguggaagaaaaaaaaaguuaaaguaugccugauuuugaugauugggaaaggcacaugugccuccuggguugucugagagacagucacagccugaggcucucccugcucuggucaagccucaggcagagguucaaaucuacccacagucagcccuagcuuuugugccacuagugugucagacgucugccagcucccccugucacucagaucucaaccacgugucaccuccuuagacaggacuucgucucacggugcaucaccuagccugucuucugcagaagccccaucugucugucuccuagugacagagccucagagcugagccccagcugugucucagcugucccacucaugauucaggauggagcagucaccaucuaaaaacaucacaggaggcucuagcuggaggggacuucucagcagucuccucucccuccguuccucagugucaagucugcaagucccccucacuguggaggggacagugacucuaagcagcuuggccugcgucuuccgcccuuguucccuggaugucugaaagugggaggaggccagggugucugguuaugcaggauacuucccaagcuuccagugucacuuaguggugacugcccuggugugcuccugugagcagauuccagggcuggccaagaugcaccugucugcaugcccagucacucacaucaucuccugugcuccagcauucuuauuugugccucacuccagaaacagagcaugacuuacuuagcccaagucugcccaaguagacuugcuuuguugaguagcugcaggaaugaucuucccacaggacaaugucaacugcaccucaccuucugaauuagagccagcgcugucccuucccuucucacuaggccuccaucccaccuuuguccugucaugucagccagccacugugcuuacucuacugacaccagccacugccuuucccuagcaccggccaguggccccuucauuguaccccagagaaggccucagacgaggaaccuaaaaaucaugaguguuuucucucccaguuccugcuccauccuuacugcuggcuuagcacuugacaggggcagagcgcaagcaugagcugcuguuaguguagagguccagagagcggcuccauaguguucccucacaggagagacugggagacacuggcaggcaucaccacucucagcauggucgccuggaaacagcccugucugguuggugucacugucacugucucugugagaggucugcccaggcugcaguuguggagugggagcagacuguggguauccuucaaggccaccugugcaaaugcugccugucccauuccagaugccagggccucacggcgccccagaaggauggaggcgcagaaaucacaggugcauuuguuuaauuacgccccugaacuuaauugcagguucagccugccagguggccauuacuuugauuggucucauuagucagaugcagccacaagcagcugcaugcagugcucugggcagguucaggaaaggcacuuugaaaguguccggucaggcucuuucagaauuuauucucagaugcauaaggaguuccuaacaaugaggguuauuaaugaccuaagcgcuuacugagaaaggggauugcugggaaaaccguggccgcacuucaggaagugagggagcaggugaggcagcguaggccuguccuguggaaucaggaaaguaggccagcagccacuuccucagaggucaugaggaggcuuccuuucuccuuccagucuguuaacugaagcagccucaccgcuccuuacgcugucucagauguuugccguucagcuuugcaaaccucguuccucagacuuuguagcuccucagaaaagauguggcugccagcugucucaaggcagcaggaagcugcagcacuuguuaaaggggaccggcuacccugagaaagcaggggcuuaucucagggcacucagaucuggguacuucagaaagccucuguaagagagugaauguuccacaggacuccaugcugccccccuacuugcuuuccagugcccaguuggucucagguuggcugcuugugacaaagcucugucucgggugauagcaucucaggggucccuguuuuggcagaucauguuuuacaguuuccugggcuacuuuauaagaguggaugguagugucugugcuguaaccaacucuggggacugugguggucaccguuuguaucugagucgggacaugcuuuccacacugacugacucugaccccagguggaucagcagugcggugcugugacugacugauucucuggggauggugguaccugggcagggacugauggacuaaaggaucacagacuaacagacucuacacagggaccagugcuacucaggcugugaccagcugauugugacagugguaguacccaugcucugacuggcugacuaucugugaggacagugacuaaugacauaauagguugauugacucuagauagggacuaugguguuuauaugggacuaugugcaaaugacgcagcggagcuaugaccuacugacuaugggucacagugcucacucugugacugacuguguagacagugacugauggguugagagaccaguuaucuauaucaggggcugugcugcaucucugcacaugugugcauguguuaaaguacauguggcaucucugguuccauguugugaccgacuggccuucugacugacucucugugagggcagugguacccauguucagacagacagacugacugacugucagacucugggacaguggugcccaugcugugacucuggguggagacaggcugacuuacacucugauuuuguuucuacuuagaugaguucugguucucggauggguccuuaucagacaaguccaagugugcagauccuggccugaugccgcugccagacacagcugcaggguuagacuggucccaccucguggaugcugcacgagcauuugaagguaaagauucacccacacccagggucuuucugugugcccagggagcaugcuccugcacugcagggccugugcugcagccuaggagcccgucuguggguuggaucaucuugcaaauguugaacacucugccuauaucuggagaugacaggaggggaagcauuuagaggcggccagccacuugauaaguacucggcagaggucuaaaucccuaaauucuguuccauggaccaacugccaccugacgcacaagccccuuuuccuccucagccucguugcccugugggaaaagcaaaccugcuugccuagcucauacugucucaccuugaagcacacccgggugacauaggagggacccacaugaggccaggccggagcuuccagguuuaacacagaugacugaagcaggauugcuugccccuugcagcucucuaucucugugggucuuggcuccuuuuaagccuaugggccacugugggugaauugagccuguggucaguuggccaccgugggucagcugagccuguggucccugggccgccgugggucagcugagcuugugguccgagggccgccgugggucagcugaguucugagaguucuccagcuagcaugcugccuuuggucagcagugaggcugugacuguccaguugaagcugcacuggggagcagcccucuccagcuuuuugggaacuguacgcacaguagaugaagacccugcuuccaggaguugggcuuagugggauguggggccacaacucuuaggaauguuugccguuguucacuuguauugucuuucucaugacuguggccaaaaccugacaagcaauggcuugugagaggacaaaccuccuuuaucucaugguuugagagggacccuugacagcaugguggugggcagaccuuggcuggggagugggcaguggguguuaguucauaccucaguggacuaggaaguaggccaggcuauaaugacccgccucucaaguuucuauaacuucccaaagcaccaucccagcuaaggacaagaacucaaacacacuagcccucaaggacauccuacauacuagcccaugggaacguauuacacacuagcccauugggacauuuuacacacuagcccccagggacguuuuacacacuagcuuaugggaacauuuuauauacuagcccacagaggcaucucagacacacuagucuauggggauauuuuacacacuagcccacagggacaucucagacauacuagucuauggggauauuuuacacacuagcccacagggacaucucagacacacuagccugcagggacaucuuagacacacuagccuauggggacauuuuacacaccagcccagggggacaucucagacacacuagccugcagggacauuuuagacacacuacccuauggggacauuuuacacacuagcccagggggacaucucagacacacuagccuacaaggacaucuuacauacaaucugacacuucagcauucuuucugcucccaucuuuauagcagaugaauugauugggacuguucacagggcuggccuucaggccucaucagaggguguggcccuagggcucacagccuccauuggcuccucacaccugugacaucaggcuuugggaaacagguuggaucaucucccagaggggugucagguuacagaaggcaaggacugcuacuguaacccauccucuccucuugugaccuagccugcugaagagaccuucuguuuacccaugucucuggggcgcgugucuacagggugggacggggguguugcuccaaggcaggauugcugagaggggacacuguaagucaacauacccuuccuacuucccacuagugagucucucccuccaggaaacagucucaaugguguccauauacuuaauuauuucccuguuacaaacugcugaaggugguggauucagacuuuaguaccauguugauagaaguagcagcuagcacaucugcaaacaguuuuuuugggggggugaaacaucagugcaacugauuccuccagucagaaaccuuaggucagcagccaugacaugcaggagagcuugccugguugaacucacgagcacucccucaugacaaacacucaugggacgcugaucugagacuucaguugccguaccuucuuaccccagcacaugcgcgguagaagggugggaugaggcucuucagcaaugcagcugcuucccucccaggugcuuguguuccccuaagucaccccaggaaacucccuggcucaccaagccaccuugaguggggucuucccucugguuugucaagggugugucugcaucugggaugaauauguuuccuuccaccaacuuauggacagacaacaugauuccuacuuagaaaaucaaaacaagaaucccucccuggaaguugugugucccguugacgugccucauucaucaccagaaaggucauguucaucuucacugagcuaaagcgugggugcuuggaugcugucauguuauucaagaguacagccaaggcaccagauucaccacccccauuacaacuguguguuacugagaccaccggauaagucaccagcacccuccagagaggaauguguucccgggcuugcugaccacaggcagugagacaauucaagaaacuagagaugaaacuugaggucugaacuuuggagaugugugauauauuacucugauaacuggcuaagaagaauuaaggacugcagaggggcuggggagacugucugguggguaacaucacguucagaguuugaauucccagcacuacaucaaagcuaaacacugacugcacaccuauaacccagccuuguuggggggagcugaaauaggcagguccaggagcuugcuaaagaaggaaugaaguaaaagaaauccguuuuaaaauacagcagcaaguaaggcauccgugcacuguguagacagagcaguagaguguuguguagacagagcaguagagugcuguguagacagagcaguagagugcuguguagacagagcaguagagugcuguguagacagagcaguagaguguuguguagacagagcaguagaguguuguguagacagagcaguagagugugucuuuggacgcugacuggcauuuggcagacauggucccaagugguacaaacagagcaagauggaguugaugugagagaggaggcuccuggggcuagagcagauugccauccccuggagaagucacagguucuguaaggccucucuugggcuugugucaugggaccuugucauguuuggggucuugcuguccccugcagaaugcauaccuugcccaugccugucauccccuacuuaaaaccuacgcaggaggugaagcgcagccucagugccugccugggcagcaggaggagauccugacucaaaaagcgcagggcuuggaucccauaucuuguaucacaagaaacagaacucucccuaggaaacucagacacaguuccccagugccaggaauuagcuucgagacuaaagggaaccugucaccagaccaucuauagauggcaacucagaaagucccuagcuaauggccuccucugcccgugcccuagcugacucugguggggcucucccucaacacagugcuuguugggcugucuuuggaauggggggaggccaugcaccuggcccugcucugaggccucugccaggcuggcuccauuugcacugacaacgaggugccgccucuccucaccccaccccucauuccuucacacuuucucauugccuguucucugggugacacuaaagaaagauuaaaagaaguuauugaggaauguccgcugcauaggaauaaauuucauggugacauaauugaguauuuauugcaagacacaauaggggaugaagaacaaagggcaaaguguggaggucacugaaaagccaccgagaauguuccaaaaccaagugucacucagaacuaccaagcucagugaguuguuuucaguuucaaagaauaauggugcccuugugcaaggcuuuccugaaaucuagcggcagcuuucuuauguaauagaauucuuuuucaaaucucuuaaaaagagagccccauuuagacagccugggucuguaagauugcagugagaaagcauagugaacugcuguaguggguggggauuauucauuguuacagucgagaguuuaacuaguuuaauaaaagaaaagcuuuaauuauaguaaguuauaguaggugaaguaauuaagagugauuauccuaauuucuuaaaaguauaucuaauggaauugggaccgauuucuaaucagagauaagacuugagagauccuaacacagucuuguggaggauguagccugauucccagauagucuacaggaugcaguugggaauaugcugaugagcaggguuuccucagaaguuaaacaagaagcugccuuaguuucuuucucauugcugaaauaagaugcccugacagagcaaugugagggagaagcaugaacucugacucacaguuccuaagagaauagucccccgugcagggaaggguuugcauugcugugagcagacaccaugaucaaggcagcuccuaugaaggacaagguuuacuuggggcuggcucgcagguucagagguucaguccauuacuauaaaggugggaacauggcagcauccaggcaggcauggugcaggaggagcugagaguucuaugucuucaucugaaggcugcuaggagaagacuggcuuccaaagucuuaaaguccacccccucggugacauaccuacuccaacaaggcuacaccuacuccaacaugaccacaccucauaauaaugccacucccugugccaaacauauucagagcaucagcaaaggcauggugugguugcccacagcauuggaagcugguuggucccauuauguccacgcacaggacacaagacuaggaccuggaugugguguggcucugcauuucgcucugagagggaagcaccaauacacugcuggggcgugggaaaaugcagccuaagaggagggaggccaaagcugggguucccugacuccaaggcauucagucaccacuggaaaccgcacagaggaguugaaagggaggaucaggguccacaggccuuagaugaggagcuggggccaggggucucuuuacuccuggacuuccagacgcugcugggucucagggaauugggaacagaguuggaucagggccagggaggauaggaaacucgggcuuagcucauuggcgauuguccuuacccuggcagcaacugucugggagcauggaggggccuucugcaggagacuuaagacggcaugacucuguagacaaaggcuuccuccaugcuucccacagcaguucuugauaagagagacaguccuugguuccacacuguucauggauuguucaccggagaaaaugagugcuuaccgacuccucaggguggaccagagauuagauaccuuuuguaggaagggaugucggggaagggaagcucacuggcugagcccucagggucucuaggcaccucaucagcauggagaacucuguccugaucuaagugaccauaggucaccuuccuauguaaggagcguggucaugugacaggggccugguuggcagcaggugaagcuccuaccguccucucuggguucuccggcuuccaacccgcucagcuuuaccaggucucuaggcacagucacugccccacaggagcugguugcaggaccaggcgcuagagucccagggcccucagacacccucgucuuccagcaagacuccaccuccuaaagguucuaccaccuucccuagcagugggaucaaauguucaaaccgaugagcuuauggagagcacacaugcagaccacaacaggaacccccugaacccacauccuuuacuguuugcauuggggucccuaacacaucaacagugucauguggaaaggggggggaugaauuccaggggcuuaagacugccgucaugcuuauacaccuaguaggaucaaauggaaauuauuaaagauucuaaaauugccaugcagugguggcacaugccuuuaaucccagcacucagaaaaucaaguuccaggaugcuccaggcuacauagaggagacccuuucucaaaauacaaacaaacauaaaucuagaauuaacuagaugagcaacuuuucaaaguauuccugauuuuuagcuacuauuuuuauauaacaagccaucccgaaaugcauggcugccgccaucagcacucuaugcccuccagcucagccacgugguugguucuccugcuucauaggccaacagggugcacgcauggagcuuggcuguguccagcccauccagaggaccccacuccugugcaugucuggaauagccguacccuggcugaacucugcacccaucuggggucguggugcuuuguuguaugugauggaaugauaacggcaguucugugagggcuuguugucugaucugagacauacuaggcugugauaccagccauccuugugggucauucaggacacaaggacagucagauacaaggcuggggcugacaccaauaccucauggugggguggcauguucacacagcagaggaaggucugguuggcucagaucccauagacagucacuggagcagccaugaaggacaguuuaagccaaucagcuagauccagcuauguguucuuuguaaaucaagccauccucagaaucacaaugagaaaauggagccacuguuaacuguagagucuuaauauagacaaggacaggaauggauagaauccucugugguaaaaaugacaguccuuuuugaauuaauuugagauaagugcaguuucaauacagcuaucuaaagauaugcuaagaacuuaauugcacccauuuaaaaaaagaugaacaguauucaacaagaaaccuauuauaaaucaauaauaauuaaaauagcauaauaaugauucaaaaauagaauaaguccuuuugaaaaaaauaaagaauauaagcaucagaauguauuuaacacuaaaugagaaugcaauuuauauacaccauuuagauuuagaaacuagaaaagucaacuuuauaaaagugaauaauaaucaauaucaccauuuggaagcuuuaauuacagaauaaugagaaaacaugaaauauaaaauggccauguaaaaacauccauaaguauuaaacauuucaugaaccugaaagaguaaguuuuaaaggggacaugugaacuguggagaaaggcuuauaaugaacgugguagugaaagccaggauguguccagugcgaaaaugagcaucagaagacgccaccucugugcugaacagcuggugugugugcguguggcacacugaaaaagacacacgguaacuaacugugcagacgaugaagaauacacccaguaacuaagcuggccugcucagagugggaaaugcugcugcugcucuagggagccacaaagaacacuggaagccagugucgucguucuguggauuauaaagcaacccaucuucucauucaagcacggugacaguucauacccagaccagaaaaauguaccacaaccccuccccaaaccugaaauuucacuccuaagaacugaaugauagccaguuauucaauauaaaauaauauagcgcaguuagaaugaaucaguagauaagugaccagauuguaacccaaaaggcacagugucagaauggagccaucuccuuggucuaggagagggugaucugggugcuaaugcugucaaccugggccacugacuccccugugcugugacaguccuuuaagaccuggcugggucccauucaagcuugaguuguuuauuucccauucuguuugguauggaaugugauaaugcccuuugccugucagaguuccugaacagaacuguagauuugccuaacacggcaagauccuuuagccguccaccauguggugcccaguuuaucgucugcugcuugagauguguuucuauagagucauuuucuuaauaaugcuuccacuuuccaaugguucaagagcaacacagcucccuuagaagcugccugugggaucugcccagcuucgggacccucuccccaggugcugcuugcacuuucaucagcccugugaugauaauagggagccgcaggcacucgucagugcucuguguggccgggcugcgguauccuguaggcagugugucacaugcauuucugauaauguaugaauaguguguucacuuaaacccagguguaucaggauguggccucaugaacaggaucaaagccaaguagaagauucuggcugugggucagacugaggcagggagggaaaguggggucucuuuaaaaguccuagcaguaaagggcuggggagagggcucagucaguaaagggcuaggugcacagacgugaggaccuaugugaaaaaucacccauggucacucugaucagugccgcacaaggcacggugaucucuguaccaggagagcagcggcucucagccuugggucucuccagccagcuagcucaccccagucagugagugguccaggccagugagaggcccuguuuuaaaaacaagauugacagcauccuaaggaauaguaguagccagaguggaccucuggucugcacacacaccuacauacacaugagcaugcacguacacacagguccuggaguucguggcucccguucaucguuagaaugucaggagcacuggugugguucuaagaguuggugccuuagaugcugagcaagccugagauguggucaugguccaaguacaucgcucauuaaggugcagguuacugcaccaugugccugcagcugaggaucaagugcuacauggguaaugcagcucccuguugggcugaguggguacaggaucucugucaugugucagagugucggaguaggucaguuaaaggaccugcaugcccguggcagguguuaggugggggcugugcaguuggcaaacccugaugugacgagucacuggaugggcccagggcaccaugagcuucugcgccuuuagcgcuguguggcugcagugacuuuccaucaugugcuccuggcagccucagcaccacuacccuuuuuaauuaacugguaguaugugacccuacaucaaccgaacaggcaggucaccucauuaagaggccugcacagcagccagcaggagacagagcucccagugcgccuggguacugcuccuccccguuaaucagucccugugagaagggagggccuccucaguacucgcuggcagaucacauccccccuuucccagccgcaaauucaugcacgcacucaguccaggggcagggugaugcucuguaaccacaaggugcuuucugccuacugugcagcguugcuggccagccugaguucugggucagaguucagucccaagcggcugggcugcuccuuuuuccuuuucuuuccaauccaacuuccuggaaacagugaaugccaaguucauaaugccugugguaggagguccugagucuuacuugcuuguggcuauugcugcuggcauugcugggaccucugagcuucgugcaguuucuagugagaggccccagcuggcugcugucaccaccacuguucuuaaauucaaagcauggaucauuccugucagucugaaaugauggcaucugugguugauccauugugucagacacuaccacccgacuucuaaguaggacacaugaaauguuaccucaccgugguaugugacacuauuuaauaccuggcugugucuuuacacauucagagacaagagaacacacaccuauucaaacauaugccagcacucuaugcaugcuguacucacacaaccccguauuucaagccuuagaagggucccugagauccucaaggucagagagaucuuccuguucacaggagaauucucaaucuuauuucaggucuugacucagaugaagaacucgggcuucucugucaccacgccuccuaccuaggugauugacacgcguucuugcuguuuuguagccuguuuuguauuccauacgucugcacgccugcauggugguccacauacuguguugggggugcacagggacgugugcccuggcuguccugucucgggaauguucucgagcucaugggagcuugcagcaggguccaucuccaugguugucaccagccacgucauccagcuugcuaaaccacacacagccaggagcuuuagauuccucggaguguggaaagaagaaagccaacuugcucuguagcugugguauaugcaccauacccucccuguggagggcacccagccucaugcuucuucauugccaccagcuugccugaguuucuguuucuccauuuuguuucaaacagggcauugugguaaggagggucagcagauuccauucaguaaauuggucuuuacaaaaucacgugaacugguggcucucaccaaccuccuuucuuucuguuccucaucuccagaccagaggguagccuccuucuguacccugaccgaccuccagcauggacaagaacuagaaggggccccagagcuguccuuguguguagaucccaccaguggcaaagaguucauggauacaccuggguauguagacccucccucccacugucccaacgcuuagagacccugggccaggcuggagagagucuggcagugggacuaacucagauacuagaaaugauaacacuugucugugugaccaucauacugcauagacagcugccuaacuucuacaaaagcaccaggcacugacucucaucauccagucuuggccagccaggccacacgugcuguaggaccugccuagggcacaguucuucccagacccugccuacaguugacaauauaugagggaugcacccccauucgugaugcaugagcuccgugaacugagucaugguuaacuugcuggggaaccugguucugucuucaggacaaaagcaaguuaggaaaaucaugucuacauguggcucccaggacuuaccucuggcccaccucuucuccauuuaaauaagccugguuuuuuguuuucuuagcagccuuagugucuuaccgguucucaguucauggugguagcuaugaacuugucucaaaucaucaacuuacacauaaaauuuucagugaaaaguuuacuaacaugaacacaagcaauguccuaaccuuaggucucuuaaauucucuuuauugcaccauuuaucagggagcgaucgcccuccacacugacugggaaaguuaaccagcuagaacugauucuccgacaacugcagacugaccuucggaagguaugugauugcuggaguccacagacagaacaaagcuuuccccacagucagccccuuuaauuccugcaaauaguuacaugagaacccuaagcagaccuggauccaaagagguucccucaguuuccucucaucuucucacuggcagcuggggugggguuuucccugaagguacauagaguccuguacacaugccugagggugucugugccuuguaaacucgaggucuccacauaaaguaagauucugcguuguugcuugcaacagccacauguaagucaacccaaaggaguaucaguuacuccucaaagacaagaucuccaagagcccagucagcucucacagucagucagucagucagucagcucucacagucagucagucagucagucagucagucagucagucagucagcucucccaacucagaacagcugccuuguacauacucaugugccaguuucuccccagaggagcaagaugcugcagugccccuacugugcugggugucuuugcugcccuuggaggcagaguggagugugagucacagagagccccagaagccuccuggggcgucggcuugguuuggcugugggagaugaggaauuauagguaguguaaaaguggauaugguuagccgggcaugguggcgcacaccuuuaauccaagcacucgggaggcagaggcagguggauuucugaguucgaggccagccuggucuacagagugaguuccaggacagccagggcuacacagagaaacccugucuugaaaaaccaaaaaaaaaaaaaaguggauagaguugguccaagccagaaggaacuagugaagagaauuaauuauacaagaguaaaguucuuaucuacuaugcaggaccuaggauggaacagcuuuugcuguuugcuaaacacaugugggucuguguauacaugcacacucauguguugacacacuuuccucugauggucacugucucccaccaccagcuaaggagcuagagcuaaggucaaggacaggggaaacuuccagggucuauuuagcugagcugcccacaaggcuuugcuuccacuucauguuaaggugauccugauagagcagugugugugugugucugugugugugugucuguaucuguguaugucuauaucugugugugucuguauguguuugugugucugugugugucuguauguguuugugugugugugucuguaugugucugugucuguauguguguguguguguuugugugucugugucuguauguguuugugugucuguguguguaucugugugugugucugcauguguuugugugucugugugugugucucugucugugugugugucugugugugcgcgcuccauacacgugcaugagccagcuccagggaccuccuacccaagucugccugagcuaggaaguuucccaggcccugggacuuuguucuaacccagcagagcccccaggaagcagacgcagcucaccgcuuuaucuccuucgcagaugaggacacugagacaguugaguuuaacuaacuuggucuagauaagaaaucaagagagcaauugagacacgaggcccccuggggugugaggacaucaggggugaugugaugcacucccugaugaguccaucaggaaacagcgugagcugccugagcagguauauaccagcacagcuccuuccuugcaggagcacuugggacagaagacauggcggcgugggacaggaauagcugggggugggaggugaucauccaggugggcuuagaagacaguggaggggugggcaccaggaagcuuccucugaaaacaggacauggcagugggccagaaaguaaaacacgugacacugcucuagaaggggcuguggcaucagugcugaaguguggugcgcuguggguuggagagagaagaggaaccgggcuuuagaguuguccauuaguggugaggaauucuuagagacaggacacauggacaggguaaagaguuaggggaugaacuggaggcuguugaaggauggaaguagacacccugaggaggugaggugcguccaguaguucagcugcucgcccgcugaggggcacagcaggaacaguggcugcuaugacuguccugccccucagcucuccagagcugaagcuugucauguaguucucaugguagaagcgccuaaagcaguuaauuggaaagucccaguguguggucuugagaggcaaacuuugaaggccaguguggggcuccaccagcaccagaaggauggcgugaggucgagcaauuaucccagaauuagcaucgcagcugccacacuggugccagucucaggcagagaagaaggcagcuggagacgcccugcaaaucaggaggguucugccaaccuaguugccucuguccagguggcauggagcgguaaagcuucugauugauagacuuccuacacagcggcuccgcuccuccuuaggaacggagggagccaggaggcuagagugacuccagggucugugagcagcaaaacccaggggcccucaugcagcucaggggggcagguggccagcugcccucuaacaccaucugucuccgauccacacaggagaagcaggacaaggcggugcugcaggcugagguccagcaccugaggcaggacaacaugcggcugcaggaagagucacagacagccacagcccagcugcgcaaguucaccgagugguuuuuuagcaccauugacaagaaggccugaucagcucgcugcuccucaccuugggaccacgggcuggucggccugccugccugccacccugccuacccguggucccuuccaagucagcaaagcaguuuuuacaugugcuuuccaucaccuguagguagaugucucacugucugucugugucucuacucaccccagcaggcaggucaggggccuggacucccgcauagcugcagcagaagaugaauguaacugcugguggaugcugacagccuguagccgagugguuucccugacgaugcucgggucuccuuccuguggggagagaaccuaggcaggugaccugcagagaugcuaagccaguggacuauggcagggcuguagggcuguaaaauaacuauggagacgagaaucagacauguacuuuaauguuaaaggugcucuauuuuucggauguacaguaguuuuauuuccacagccgcauuaucauagcaauaagaagggcacgcaguaggcggucugcagagcucugucagagacggacccugaaguuuaacacuagcacgaacgcuguugcuguagagacguauuuauuugcaggaacaaacggugccugaauauuaacaguguucugaauuuuuuuuaaaagagaugcauaugccuugugaacggcuggaccugucaguagucacuccugcgcgcguaguuugcuuucuuguaguugcucugcugcagucagucagucuacccuccccgauagagcccccgaugcugagugccagcaggauccuguguccgacaccagaucuguuuaucuuuguacagaaccucugauaaagugucuuguauuuaacacucuuauuuaagcuuauuuaacccuaacuuguuaauuuuauaugauuuuuguuucaccugcgcuagcuguaaggcgggaggcaggcaggcagugacugagcucaccuggaccugacugaagcaggugggcgagcugaggaccggaugcugcuggcuaacacguuguuuguauugcuucuccauuuuuaacuguuauauuugagaugaacauacauuuugcuuuuuuaauaaauguucaaaagaagucaacaucagaagcag

SEQ ID NO: 4897 - RNA, 13234 nt, Mus musculus
agcuuaauaaguuuaauuagugcuugcugggauguugacugaugcuuuugacugggccuugcacaggugacacagcugcaguccgucuguacucgcagucacacuccugguccagaagauaguauaucauagacuccuccgguccucugguucuuagaucuguuucuacuccugucucccaugguguuccugguccuuggguaggaugaauguugagauaaauauccuauuuagggcucacucaguaggcguuauucucagcacuuuggccaguuaugacccauggcauuaagugaucucugccuauugcagagagagacuucucuggucaagguuaauggaagacuaauccauggguauaaacauaaguguuucaaaggcagucugaugaucugucuuaugccaaguugacuauaacagguuccccucuagggcccaugaccuccugagccaugcuuuugaccagguuugcaguauaaggcaugaguucucuccuguggggcaggccucaaauccaguccaaaagcaguugguuauccccaggaccuuugugucacugucauaacaaugggcacaucuugcauggcagguauuagcauuauaguaguaugguagaaugcaggguccagugcugaguaagaucagauauauuuucucccccaguggccugggcagcauuuuccaguacugugaaagcuagcauguaguaggaagaaauuuucagaucaguuuuagcuugaguuuucuauauccugcgaccaaaguaaguugucucuuuagcacuaggucuuauugucuaguucuagugggugaccaagaacaacagcaguggcauguauuguuuugggaaccuuugguaccuccacaaccaaugacuuacauagcgguauccuauguccagaacuggaauuuucaucugauaaucgagucuucuacaggaaaucuucuagaagacuuccuacuuaacuuugugauaaucagcuuucucucuguguguguguguguguguguguguguguguguguacacgcacgcacgcacgcacgugcacacucuguguucauggaugguguuugugugggagucuccauggaggccagaggucagucuuaacugucgucuauggcuuuuuggcuuuuagcucugccuuuugagauaagaucucuaguuugucugguguuugcuugcucugucagcuagacggguuggccaaggaccccaaccccagccuggggucacgggcacaugccaccacacuugggugcuaagaauccaaacuuaaguccucaaggcuguucaguauucaccuuacucacagagcuaucucccugucccaacguuuuauacacacacacacacacacacacacacacacacaagagaguuuuucuuauccucuggugucugaaguccgggaaucugucgaaugccuaaggaaucaccuuuuguuuuauuuuuacauacgaaccaaaacuauuuccauuugaagccaguagacucauguauaauaaaauacuuuuuuguguguguuucuuguuguuguuuuugaagagguaaauguuuuagaugauguaagucuucuccccaaauaagaaccuuugagaagccagcagcagguggcccugcuccacuacaccaguuuagaaauguucaccucuggagacauggcugccacucacugcuccaggagagagugcagaacaaacgugucuuggcugcucauuccucagugacuucugucugccuggcuucccguuuuuaauucuggcaguaagcgucugcgaaugucugcuaaauauuccucccccuaccagacagccuccagucaggcugugugcgugugugagaaccgauaauuuucccucccuccuccucccuggugguuugcucccaguagccaguuuaugggaauagucuuucagcagugauggagggagaggacacaggacucagucccaggcgcagagucuaugggaguggccuuccaugacagguggccuuagaggccaagagucuugccauuucaacuguguugcauuucuucgugagugucugaacauauuuuaggaaauuaaaagugagaaugggaaaggguuaggaagacagguuagucugcaaaugcuugcuguggaaguaugaggccugacugaccccaggacccagauaaaaaaagccacaguccugggaagcagagacaggcagaguccuuagccuaacccugaacuccagguccguugauagacugucucagaaagcaaggucaauggggaacaacacccuauggugaucccuggucuucauaugaguguguacaugcacacacacacacacacacacacacacacuugggacaugaaaaguguacuuguucuacuugguucucacagagaagagagagagagagagagagagagagagagagagagagagcacuaagagaaagcccucgcuguugguagcuagccagagaaagggcuuacaagacaaaaguacuguagaagcaacgcggguucccaccagacacggguuagaguccaagcacagcucugcccguggauggcacguggacccaaccaacugcauccuaggcugcagaggcaguucccuggggauuccaaagccuaucaggcagauggggucagagcuggcacagcucacauccgcugugcaguuacaacagccuugggcugccuggucagugcaacucccacggggguggcuccaucucugaccugcucuaguggaaaacuuuacuaccaccauugggcaccucugcucugcagugcaaauagcuggauaauuuucugguuuagucugggaaacgggagcguccaaaauacuugagcuccaggcaggcagcugcuaacuuuucauuaccacaucuucccauucagaugccccugguuacccauccuuuagaccagcaucugaaggcagggcccacagaaggcaggggccucugcaguucacccucuguugucuguaguccaggaccaagagcaccacucccaccccacauacacugaguuacugggcuuuuuuucucugcuagaccuccagaggggccgagguucauugccuuuucuauguuguacauugcauggagacagccuggaagccuggccuguuugccugcaugcgcaccugguagaucucgguugccccuggcuacugaccuggugcaugugcaccacacuggacaucgugucucucucugguguucaggaaguacagggucucauuccagcuuucuuguggagcagccaggccuagggaggagcggcuguuggugaguagcugcuucuacaggcuggccucuggcugugcacagcuccugacuacagcuucuggcugugcacagcuccuggccaagcucagcuucuggaggagaugcuggcguuugauucacguggcugucgaguccacugucuuuucugugugcucccucccccuuccagaagagcgucugagcacaggcuugcucuccuccucugucagccuugcuguugccuuguucucagugaacuaaguuucuuucuccuuuaguuguauugagcuuugguaacuuguuuacugucucaaacucaggcugugugcaaauauaaauuuccccuugauguaucuugcugucaguuguugaagcuuaguucuugugggcauuccugagacaggccgcagaagcaggcagugguaaaacccuggagugaggguagacuuggcagagggauucauuacuauucuuguugcugugguuguggacagaagcaacuuaauggaggaaggacuuuugcuuccacacuggaaagaucuggucugucacgggggcaaggcaugcagcaagagcaccuagcugcuugcuuucaucucaguggaccaggaaguaaagaccagacaggaagaggguugggcuauaaaccucaaggcuagaaaccugcuuccuccuaugaagccccaccuccuaaagguuccuaaccucccaaaacaaagccaucagcuggaggccugauguuccugagccuguggggggcauuucacaguaaagccacaucaggagaugggguggccugucacauuguguguccuggggucucaguucccuggugaggcauagggugggagagugggaaguacuggguguguggaucacacacauacccccauggacucaggagacccuguggaggaagccuuugccggagacaugcugcaucucuguguguggcaucccugucaccccauaagucucgcaucaggaagcaccguuggccgagcagucaguacuucaggaaguaaauccgccuuuccuuuggaggugauagugagaaauuguuucuuuuucucaugcguguaccucacgcaucucacuuuuaugaaccagacacagucacucagcaucccucccuuggacgcagaaaaaccucauuucuccugggauucguguaguaaaguuguuggcaggauugagcaaauuucucccuggaaaacauccaagccugggaccaaguaggaaacaagucugugcccacucaagugucuggugacaacugaacuguuugcaaguuaugcagaagauguuuuuuagaacuugucucauccucaggguuucaauuauuuugaucccuccucccucccccgacuccagaaaggagacugaggagaaaaucccugcgaagcuaagcccgagugacucccgcuaugguaauuaauuggcaggaaaaucaauaauugagugagaagucucucagucaguggugacagagacggugcagugagaugcuagugaacuugggagacagcaccaggggcagggagcuaauuggaugaauuuacauacugcaugccucuguagugccugggcugcuagucagucggagacucagagacccaaauguucaaaccucuuaagcguuugacccugaaagaagccucagugaauagguaucugacuuggugaauuaaaaugggaccaccuuugcauugucugucagacaauucgaaaauguuagcucacuuccuuucuucacagagcaaauucuuucccauucaucgccccuguguguuuccucaagggagcugcugccuuaaugauguuugaggauacugacucugggccaguuuaauuguagguucuuguuguuuguagguuuuuuccauccuuacaaaucauugaggaccucagagauguuuguuuuguuuaugugagaucugucaguagucaucauauuggaaauaauaaacaaguucacacacgaggagaggcugcgacucacucagcacucaucccaucaaaagcucugcagagcccaggcaaggcaccgugagaugucagguaccagccaagggcggggccgauggugucaccugucugaaggccuguguucuguguaagaagcagggcaguucuguuuuccuuuaaaacaggcgcuucauuccuucucuuuaagcccucucugagcggccucuuuggguaagugcuccacaguuuacucucauguggcagguguguccugggacaaaguagcucucugauuccuaggucugucccuaggugugaucccucgagggauagaccacaggugcuguggagcucaagggucaagacuuuauaggaccacuuauuuuuacuugucccugaacaauauugaaggagauagucuaaucaauuuguagauaguguaaguuuuuuaaauauuuaaaauuuugagauuauaauauaucauuacuccuuuucuucccuccaaacccuccugugcuucacccccucuggcuugcuuucaaauucauggucucauauucucucucucucucucucucucucucucucuuguguguguguguucuuaaauauagaauggugcuugcucagucuguacaguguuguguguauguauucucagagcuggccguuugguguuggagaaccacucacccugcuuaugugcuccuggcuagggaagacugucucucccacuguuagcuuccuuaguugccugcaguucuuugucuagggugagaccucuugagcuuucccuuguccacauuagcaugucuauugaugccuuccuuguucaggucuguuuccacugacauguugguggguaguuucugacauuucuaggaaacaccaugucacagccaacucuccauuccucuggcauuuagaauugcucucuccccucuucugcagugaucucugagucuuaaacuuaggaguucuguucuagauguuaaauguuauuuuauguguauaaguguuugucugcauuuguauauguguauauucacauaugugcagugccuguggaagccaaaagagcaucagauccucuggaacuagaguuacagauauuuugagcuuuccauguaaaugcuaggaaccaaaccuauuuuucuaucuagagacagucuuguuauguggcccagauggugaccgaggaguuuguccuguuaugucaugugacuuugcccugugcgcagaggcuugucuacugcugacacagugagaagguccugucuuggaauuagugugaaaaucguuagauuugcauauccauuaggagcccgagacagagcccggcauggucuauagcacgugguuugggggcugcuaccuaagaugcagagcagcuagagagccugacucaguuggcaaaaucuacuggagacacuugaggacuugaauuggagcucuagcuggggcaguggugccuguaaucccagcacccuagaagcacagggcagaaggucucugaggcugcugacugcgcgcgcgcacagcugacugugcacacacacacacacacacacacacacacacacacacacacacgcauacuagccugcacacacauacaaaagcacauaggaggugugguaagugaaaagaucaagauuugauuaugugucaguugaauauuauagaaauagacuagaacucuggugucccuuugugggcgagaguccucauuauagacauuuagucaccucgcaaccauacggagcggugggaccugccaggguggcuacugagcagaugcuuucuuuuggggacugagugaucuccauggcugggugacagcacggaggcccuccccagacauggucacuugauccuggacuuugcagaugcagaggcauguaaacuuaaugacauggucuguggccuuuuguuauagcagcaggagcgugugaacugcuaaggcauggcacugacucccgcagcccugugcucuggacagcgacuaagugcccagcacaugauccacugaauagcuuugauagucugaacaauuugaaggacuuagauccagauagagaguguaaaaacaacaacaacaaaaaauguguuagugcauaaaccugaguccaggguagacucuguuaugcaguaaagcaucagugcugugagcugugccugcccagccccccaccuuccugacucucuuucacucuguacccaguucuacuuguccauggccccucaaccuccaggcagcuguguggugcucuccugaaguacuaggcacaguuagaaaaacugaccauaggauucugacuggacugcaggaagcauaagggacuuccuguuggugccagcugagcucacucucaguuccgcaguguuucugcccugugacaugcucuguggguguccgaauugugugcacagagcagggaacuccacuugugugaggcuuugccuagaaggauuucuuaguaagaguuuccccgguucuccugccuuugacagaaucuauccuggugauagcaguguucaauuuacucuuuugugggucaaagccaucaccuugugcuuugguuugugccugucuggaagucuuugggauagcauguucccugugaguugacauuuugcccugcugcauucuccucuaaguguugcugaauuugugugacugcaagaagggucucuuccaguagcuuggagcuggagaagccaugcagccuggugugaggguccugcugcucccacaggagucugugcagucuguagguguggagaacugggaccuagugaugucauacugucuuccuaauggugucccaaggucccagguuccuagugagaggacaugagggugacugugguuggagguagauuccccuggcugcacauucuacacagcauucuggcagcagcagcucuagacacagugagccucacuugcuuuuccuauggaaucuuccugggcuggcuccugaauccacaucgagccauccuuaacuuuugguguuggccucauguuuugaaauauucccacucgguuguccuaccugguuggcugaguauaguuauuauuuuugcaguuagaggcaccaccuuuuccagucuuucucaucacacaguuuccuaauucaagcugugagagauuuaauucaguucuguaggcguuuauaggguguuugcaagucgguagccgcauuauuacaaaccugccuccuuguuuuccguguugccuggagcccuuugauuagcaugcuccccaccagugcgcugagccugcuccucccccucucccuugguggguuguuaaggcugagagccuccucgggagaugaguggcccaggcucacucuuccucucuacucaacucucuacuguugcagugcugcaguuugcuguuuggugggcgcucagagcuuugccaggccuuucuggagugggaagucaggaguggaagagaacauaggauccagagggggaaauggcucuucgccguuaccuuuaccagagcaauagaauacacucaccuguccgucacagagaaauaggcauuaaauucugauauuucuggacgcagugagcuaccaaaugguguaaaagcugauucucuugcauuccaucgccagagcuuucuuggaacuuuucucucacguaauugguugcagacgcugggaauguaugugaugaccuacacccuaggugugcacaggguuaaaaugugagcaguuugaacuuaggaacccugcucugugaggaaguacucaguauuccucagccaaaaucuuccccuccccccaggaaaagacaacuacauaauuucaaauggauacauucacugauucucuucaagaguggcuuagcccgugggggacacagccacacgaguuuauuuucuuuuuuuguaccuuucuuuuguugauggagcucauggggagcucauggauucucauuuguguuuagagggaaugguaagcagauguguaucaagacguccauguggcugugagcucugccccacugaguguauagacacaggggcagcagaauuggggaaaagaucagccucagcggugcgccuguuaaagacacccacaggcaauuguuuaaguuggucuuuucuuaguuuguuaugguugcucuuaaucugcauccuugaaauagaaaauacacuuggauuucacgagucugauucauucuccuugauuuaaugagcaccacugaagguucacacucugggcacccgggcugaacacguucaagacauuguucaguuggagcucaaaucagccgcugcacacagcacagcacagcacggcucccacugugcugugugguccagaguuggaucagagcucagcucuuuagauaaugaauauaaaugauaucuucucguuucuaauguuuagcuugucuauaagcaggugcuggugcaaacuagcagaugauuguggaagccuaggucagcugugcgugucagguccagggccuuugcuguucccggguagguaugucuguguggugugccuuaccucuugacacagagcauccugugagugagccuacaucccaugguucuccagguuccuacuccacccugugcccaagccacugucugggcaugagaaccagaguggcaggauugguagcuggcuggacagaggguuagaaggcuguuugccuuuuguguucauuacaggaagagcuuuuuagcauuagugcaucgggaauguauuuaacauuaguguagcaggaauguauuuaacauuaguguagcaggaauguauuuaacauuaguguagcaggaauguauugguucugaaguuuuccuuauucauuuuguguaugguaaaugcugaaagaggcagagaauuuccuauuccacauaugccugugauaauaauuuacugcuaauuaccaaaaagaguuaauaucauaaaguuggggacaggauaaaagaccauggcagcagacagugguuuugagucuaagaaacuugccugcuuuuguuaauucacuuuacaacuauuuuuugauuccugccaauuacaccucaggcuacuaccuauuuaaaaacucacaguugaguggcacgggcguuaaaggaagucauguaagaaacugaaaaugucagagcagaaaguacagcauccuuggagagcagaggggaagaaggcauuaggaagcucuuuaacuguauucugggacaugccagagaaguggagagugaaggucuuuaaagccauggaggaugcuacacagaccugagagggcccugugagggaagguauaggcccgagagacugcuuuauauggccaaguacugaaaggcugagagaaugcccugggagaugaagugcugucagacuaagagaguucucuguaaggugaagguccgaggguguccucugaggugauuuggagcucagagugcucugugagguaagaugcuuuauguuuuagccuugagugguaauccuggucccagguguguccuuauuagcucugcucugagacgagaggggcaggucugacugaguuuacuaggugcauaguaaagucaguguacauguaacugguaguuuccuaacagucuuuaggugaaggaaugggggccucucugguaucuccugcccuacaaagccuuuccuuuucucugugucuucuuccaagucaaguaugacuuccuccucuccaaugaggaggaacucaccagaaaucucuucuggugccaucugaggacacugggauucauucugugggaagccuggccaggcguuagagagugauucuggugccaagaguuucauccugguguagacaacauguaaggcugcguguuggugcuagauuugcuacauaaauauuuguuggauauuaaauagcuucaaagggucucuguguccaguuucucuuccuuuccugaguaacuugaaaggaagcagaguagucaucuuaaaccacccagauuucagugccauugauguugggaauuccacaagaucgugauaugccucagugcagugugugugugugugugugugugugucugucugucugucugucugucugucuguacuagccugggugaguugaguggucagcaugcuaaacacauacuaucgucaggaacguuagugcccaaagcacauuuccaggaagacugaugccaucugacguacuaaaguccccugguucccacuguccuuagugcaugcgaucuacaccgagugcugacugggcaagcugggcuaagucuguguugguguccagugcugauuguucacgucaucaucguaucucagaguggugaagggaauguggaggccauccuagcuguacaggauucugaggggagagaugugacucuuuugcugauugcuagagcuucuaaggucugcgcagaaaugaacagggcgugcuugacuuagacugaccucaguauauugacaaggaacuuugguuuuauuuguuuucauuuuguguguauguacaugucuauguucuuaacaugcagauguauggaagcauaggucagccuuuggugucuuuucuuaaguuccguucauuucauuuuaugaaacaaggucucccacuagccugggguccaacaauccagcugggcugucuggauagugugccccagugaccguaccugucucuuugucucuaaaucccagcacuguguuuguaggagcacaccaucaugcuugacuuuucuuccugaguucuggggaucgaacucaggaccucaagcuuacauggcaagcacucuacacagccccaagaauuuuacuguuaaagaaaaaaaccaaaccaaaccaaaccaaaccauagccuugcuuagaugcuggauuucccugcauaccagcagguugucuucucaccguuggcgggagagcuacaaggaauaacuguguguuggugcuggcugcacuuccucagaaccgcacuuccucaggaagccugcggguaggaacaagguguggggaggggcaugucugcauggcuuguuucugugcagagcaucuugugagguguccccagcacagaccuaggaaugcggaucuuccugucccuucccuugcauuccaguacauaacaguugcuggggaagacccaguuuuaggugcuccccucccccacuucccagcccagacagagcccuuaccucauuaagccaccugugaaggaggaaguguggccaggcuccagaguccucauugaugcuacucagagaaucuguggcuuccuuuccuggccauaaacaaaagcagcugaaagaaugggcuuugcuucucaugggaugcuugcuaugucaggggaaggaaaggcgcuuucucauaauguucaucuuguaggggccucaccauaaaauacagacaguaacccagaagugccgugugaagcugacuauuagcagcagacuuuucgaguuuguguuggggucucauaauacaugcacacgaggacacaugaggacagaacccuccuuacaggaaaauuggaauauugaucucugaaaacagcgaugcuucagaaaugccucucucuuaaggucuggaaggucauacuguguucgcaagagauacuuguuauucgcagugcagucaugucucccgcauaggucucccuggugacggcuccauguguccucuugcacagccucaguggcagagaacaucacaacgcagugugcucuuguccuacuacaauggcuagaagcuaggggcugccugugggaacugguggcugugauagguggacagacaggccagggaacacuuggauaggaaaucuuucacaaauauucugguguugggggucauuauauuguaacauaagccguuaggcauuaucaaguaaauucauauauuuauguagccguucugucugucugucugucugugguuuuccauaagacuagaauucugaaccugcuaaagcaaccuccuuaucuuccucccucugaaccuaucuauucugcuucug

SEQ ID NO: 4898 - RNA, 18276 nt, Mus musculus
cauuccuuuuucucugcuuacaacugcagauauauucugaccagcugccccauguuccugucaccaagccuucuggccaccauggaccguaccugcgcaugguaagucccccaaacucccuucucugugcuugugugcugcuuacaucggguauuugagccagcacugagaacgguaacggacacagauaggcuggggacacuuucaugagaagagucugcauacccacauggacggugugucuggaccgaugauguagcccugggcaagccucacccucugugugcaaugguuucucuguguauggagucaaguuucugugaguggauaugauuuacaaaacucuuugaacugagccucgccacagcucuuauuaaugcuagcgauuaccgcuggugagaugugcgagaggguucagaggcugccagcucccuuaacagcagaguuuauucaauaaagcagggaaugcaugaccuaaagagguagcuaaggaaccuccccacccaacacaaauaaaggcauuuuaauuuugaguggaaaagcacuguauauuuauauuuuucuucaaaacuugguccuuagguauaaaaggaugugugcaugugugugcgugugcauguguguacaugcaaaaauuagaccucagguauaaaaagaugugugagugugugugcaugugugagaguguguguauaugugugcauaugugagugugcaugugugugugcaugugugaaaguaugugcauguaugugugugcgcaugugugugcacaugugcauauguguguguauguaugugcaugugugcauacacaugugugugugcaugugaaaauuagaccucagguauaaaaagaugugugugugugugugugugugcaugugugugagugcauguguauuuuucucaagacaaucuauuucagaugcacaucagauccugacuaucauaauaucuagagaaaauggaagaggaagaaagaaagugaagggagguggaaaagaagagaggauggaggggagagagggaaaggaagaagggagggagggagaaagaagagggaggaauaaagggaggcaggcaagcagaggcauggaaggagggagggguaugcuugagggaacaucucagccagucucagagcaccagcgaccugcacacucacucccugucagcucugacucccaugcagcagaggcagauuuaggcgacagcaaacauugcugccuacaaaccacugugaaccaaggggggcagauucaggaccgaccagacgcaccauccuuucucacccagggacgccucagggaagcuggcuccagaccgcuucucccugcccuauccccuuguccucacuaauucucugggaaacucuggcuucccauucccugggaggcuggagggaguucccuugguucuugcuggauugccagagauugagggaccaaaaagucucaagcaaacgaagauaagaaaucaaaacuaguacugucuugcagacccugagguucucagugggagggggauccaggagaggcaggaaggaacagcuggaauuaacucucauucaagacugugucucagcucaggcuacuguaacaaagagccuacuccuuguuacaacaugcaacaacaaacauuccuuccccauaaucccaaagaacacagggucucuaagaucagacugcucucugugguccuuuucuguucacucuggaagcuuuuuuguauuaggugggacuggagacgggaaguaagccugcccuggugggcagcauccuaucaggcuuuagagacuuccugguugcauucaugagggcuccacucucccaaacugaucacuuuccuuggucgcaugucuuggcaccuucacagauuguguguggugggguguucauacauccuuuggggaugguacauguccaccccauagcacccugauuagauggaaugacaaagucuugcacacacaaggauugagguucaaucccccagaauccauauuagaaagucagaugcaguguugugcacuuauaaucccaagccuggggaagcagacacaggaagauucccuacuuggcaagcuccaggccagcgagagacugucucaaaaacaagguagaugguucccuagggacaccagaggcuguccuguggcuuuuguacacacaauuacauauaugcaugaacacacacacacacacacacacacacacacacgagucaagauaaccaaauuugaaaucaguauuguacucacuugcugugacccuuugaugcuaauuuacuacauauaaaucauugaaacuauguuguuauuucguggaaauuguaccaagugagcacucauucaaugaauuaucauauagugaacauacuacugucaucucauuuuuuuucuuuuaauggaugaaggauuuccaucuaacuuguuuugggggcgaaugacuguaaucccaacacugaggaagcugaggcaggagaagcuugagcuaaccugggcuacagaaaagauccugucuuaaaaagagagaaggagaggaagagggagagugcccaaggccaagcagaucgauguagacauuuucuuuguuuccuccgguauugauucucuaugucgauucugucucugagcuaccgaaaacaacccaacucccagaacgccuuacaauuccaguccccuugccagcgauggaaaauucuagaggguuaauauuuaaaaugaauauucuggauacaagaagcacuuaggauucuauacauguugucucucuguguaagguucucccauggguuugcuuugcuuacaucagccauucucugaguccaugcaggugcaagaugcggaaggcaaguuacccauugggauaagaaguaauaauacuccauuagaguaacacagggcuauaaacaacacugagaugacaguggcagguguggcuugccaaucuuuuuaggugauuuaaacagcaggaaacugagcuguuaaacuggcauauauugccugcugaaaggaguccaaaaaugugugugugugugugugugugugugugugugugugugugugugaauguguguauguauauuacauucgcaaaccaauuaaagguaaggauuccuggaaauggcuuucucauccagaauggagggugacugagcacaagcccaacugcacgcaugcucgacuagaagggucuacagguacaucgcgggcaaaagccacugccacuucauuugcugguggaaugagucucgaggcuaacugagguaaggauccacuuucucuggguaaggcaguuguggguugauagacaaguguggagguauggagcagagaugagggauucggugcauggcuggggauaggaaguccgccugcaucagaggucugcaacgugggcaagcuugaaaaccuccugcaaacagguucaaguucuccggaccaaugccaguuacuccagucuaaaggaggccaucgcuuugggccaagcugcugugugagccccuagcaguccagaucgggccaaaauggaaucaaggcacuaucacuaagaugaccaucaaacuggcuuugaaaaaacuguuuugggcuaguuucccccgagcaugggcgucccagucagcugaaugaagucagugaggaaguucuuuuucagcaauggaaggggagaacucugcggagagaagccucgcuuuugcucuuguuucugcuuuccacaacucuuucugccguuucugccgcucaggucaggucacuggaagcuccuucuacuuccagguugcaauaaaaaagcuuaaucagaucuuuagacucuuacuaccuugucucagauauucaucucgggagguggaggccaggauaaauugagguuagcuguucuccagcugacugcuccgcagccaagugaacauuguacacggaguucaaaucccaccaacggcugcuccuucaaggaggguuucuauugcuacauaggagcucacuugcagccugaggugagggucucagggacagaacucagauacuuaaguagcaacggccaaguaucuggaauuuccacgaaugcauccgugcagacaccucacgugagucuggcacauaggacuguucccagaccuuacagccagccacugccacauagcaccaggaguagggaagaaugcgcgugcgccuugugugucgggaaggggggggggggagcguuggaaacgcaugcgcgaccacggggcggggcggugcuuucccugccgacaggggcguggccuucagcguaagggguggagccuggccgcccauucugacccccgaccgccccgcucuggaccaccccgcacccagacccccacgcacaugucgcggcacguguuccucaccgggccuccaggugacccagagccugcgggacuuggcggggagguagagcgccuggaccucuguccggucuccggccuggcuugguguaucgcaacccggcgagagggaaggccaggaggacuggggagcaccgguuacauguccccaaggaccgguugucacccgggucucgcgccacugaggcccagguguacucuguagacuuuagagucaguugaacaggcagaggcuuuggggaggagcagggggccgcaguuggaggcgcgccggccuugcacagcaugcccugcauuugaaaucagggugcaguuggguccccagcuuccugcuguaggguucacccggagccaucaucaauaccuauguucauaagagguuuagugaacaccggacucacaggcuuuccccuccuccccgaggagaaccugggaguacugucagucccggauuugcaccucuacaccccugccuccugucucaagaguuaguaaugcuucgccccuugcgcuacaggccccacuccagugugucucacuaacaucccaaaggguuuggcuuucuaagccccucuccagcaaguuagcgagacuuuuaaaaagaaagcacccuuugucagcaccacugccucucagccucuuccuaaauauugaccagcaucuguaagucaucucagagggggcuuugcucagcugguuuuuuuuuuuuuugguuugguuuuugagacaggguuucucuguguagcccuggcugucuuggaacucacucuguagaccaggcuggccccaacucagaaauccaccugccucugccuaccaagugcugggauuaaaggcaugggccaccacugucuggcuugcucagcuguuuuuaacauaacaaucccugugaggagauagccucugggucaagagcucuugggcugcuguguguugucuguuuggaaauacggauauauggaguuugaaaguugcauuuauuuacguaugugagugugugcgcagguguggaggucagaggacaacuuugaggaguugguucuuguugccccauugagccgucuugcuggcccauaaauauacuccccuccccuuauaauaaaagugcugccugcuugguaugagagcuaaagugaaauguuaaagugacaggcuuuuuguugguggugggguguguguaugugugcaguguuugggauguaaauaauaaaagacaaaaagcggggguagccccagggaacuccacccucaggagcuaagugugggaccuuuguuccuuauuguucuaggccacaaacaucugcuguuggcacauacauacuuuugcuuaaaauccauaaggauuaugcugcaacccucuggcccaccaccacugacccaccuucacagccaggcuucaugcccuauaaaggcuuaacgaccuccccacacaguaccaucugccugaucagacacaagaguggcuggagggaugcuuuagauuuaaaccagaacagaggguaaaucuaggagugaaggaggucccagauauguccugggacugcauuagaaguaaguaaacuucaugccgccgccugccucugcugggguggaaaaucccucacaccuggagcaaucuggcaggcagugacauuugcagcccguccuguuugcagcuauugcuuuuuugcaggccagaugggcuugacaagguaaaacuucuugaccccucuucuuccuuugucucuuucagggguuggcaaaacaaccuugauccagaaagccaucgagguccugcaguccuccgggcugcccguggauggauuuuacacacaagaagucaggcaggaagggaagaggauaggauucgaugucgucacccugucuggugcccaggggccucuguccagaguuggguacugguguuuuguuucugcagggguggggguggggugucucuagccuggccucuguacuucuugggaacauuucuucucuguaugagugcaugugguccaugggucugugcagaggccaaacggggacaucugauguccugcucuguggcucucuucccugagacaaggagucucccaguaccuggaguuccaugguggccagcccuggaagugucaugggcaagccucaaucacuaagcuauacccccagcucucuguuuaauuuuaaccuuaguuuugauacaaggucuugcuauguauggaacucacagagauccacccgccuuugcuuccuaguacuaagaugugugcaccaccaugcccagcaaccccuugcuuacuuuuuauuuugagaaagucuaaguugcccaauggccccuaagcuuuuuguucucuugccuucacuugcuucagccuccugacuaguuagaacgaugacaggagaccugccacauugggcucagcucuugugcuguggugugugcacucacuggagagaccucacuguuaauacugcaucuuagcgaggguuuuacugcugugaacagacaccaugaccaagacaacucuuaugaggacaacaucuaauuggggcugguuuauacauucagagguucaguccauuaucaucaagguaggaacauggcagcauccaggcaggcauggugcaggaggagcugagaguucuaccucuucaucugauggcugcuagcagaauauuggcuuccaggcagcuagggugaggguauaaaagcccacucccacagugacacaccuacaccaacaaggccacaccuccaaauagugucacucccugggccaaacauauacaaaccaucacacacugcaagacugaauuuggccagaguggugcugacauucagagagggccugguuucaggagagaaaccacagugaguccaaccuuguacacucucuccuuuuauauggggauuguuaagggugugugcagagagcaagugggucagcagaacagaccaaccccagaaaucgguggggaauccuccagcaaacagugucuucuuucaggucacagccucuaccuggaaagcccgagugucgaguggggcaguauguggugaacuuggauucuuuugagcaguuggcacuuccuguccuaagaaacgugaguguauguuuucugucuugagagacuggcggccucuguguauugugggacuugcuggccacuugaacacagugguuuugucccuauaguuagguugugucuuaugguuuaaaaagucuucuagccacugaaccuugcuaaggauaggcaguccaauugacuguugcccugagcugucacaugcccagagcauguguaaaauauuuccuguuaggaaggcucuaaugcaggucuguauccccguguucuggugcccagagcuugcuugagugugcaccaaagaaccuguaaauagucuacacacugcuccauguacacagagccuacugucaggggguacguaccgcguagguggagccuggagcucuacccgaggagcuagucacugccugcuaaggacagccucugucuucagaggccuggggaugcuauggucuguauuaaugugcuggaaucccacccacugagcucuccucugccuccccucucccaccccuuccucaguuccucugggcauuuuugccccauuucugggcugagccaugcuggcugcucuguugcuacaagcuggggacagacagagauuuuuauuuccccugggacccaugccccucucucucauaucuacacagcaucaagaagcguccgaugacaucccgaguggagaguccagcuuugggcauuggauccauauacagaauugaguuuugcucaggcaaacagaauccugggaagaggcaagagcccgugcucccgugugcucgcuggcugggucaacaacuugccucuuguuucuaaugggaaaaggacauagaaacgguucauagcuuuacagucacccauguuucuguaaugauuacagccauagacucaggccgucaaacuggacuugggugaaauaaucacgaccugugccugauauuccgggcuauguagacauugguucacauccccccaggaagggccgugcucuguccucaugccuccaagcagugauggaggagaaggcuugguggcugcccagggcuccuggggaccauguaucauggcacccacuaugggaaauaguuugucaggcugcacuucugcuggcgcugagcacuucacacaugcucaguagaaauguccucugguuugcauuaagggauaauagaaauacauacuuuuaaugauuuauuaagugaguguuuuagaaucuagcucauugguucagcccccucucuguguuucauguuuugauguaaguagaucuugcuuugcuuuguuucauuuuaugugucuggguguuuuggcagccugugugucuguuuaccaagugugugcaguauccucagaggcuaaaugggggcaucuaguccccugcaauuagaacuacagacaguugugaaccaccuuguccugggaaacacaggcccucugagagagcauccaauguccuuagcugcugagcuaccuccccaguccuagccagauauuucuuaaagcaaaugaccuuuaauuuguugauucuacuuuuccguuccucacauugauacuuuguuucuuucuuuccuuuuuuuuuucuuugauuagcacagaaaagcucuguccugauccaaauuaaugcagcauuuuaccuauauguauuuucugaugugagcuuguuaaaaaugcauuuuuaauccaucuggauuuguuuugaauauauggcaugcagugacacccuuaauuaguuucuucgagauacuuggccaguuuacuaaaagcauuugcuaaaagcccaugucuaauuaguuuauucucuguaaauugugcuuuaaagcucgcgcgcauguguguguguguguguguguguguguguguguguguguggacuuggggguccucuucucuuucacuggccuuucugauucuugccugaauaccacucuaguuuggguaccaagcuaguuaacuguguuauuuuaaaaaauauuuuauuuuuaaaguaugagagagaaagugugugugugugugugcuugcgcacauguaugugugugcacgggcauguauguguguguauguaagaguucaugugcaccuacauguccacacauacaugucaauguucauagacacuagaagaguguaucucauggaguuggaguuacagguuguugugagcucccuaaagugaguuccaggauccaaccuguguucucuucagagcagacagugcucuuagcccggagccaucucucaggcccuugcauuuguguucuuuaaaacuuaucauccauuuccauuuauuccuuccuccacaggaagcccugacugagacagcccggcuggcuuccucacuaacuggagccagcgaggagcccauuauaaacucagaugggaaaccgaggcacugaauaggaaggaccuuagggagggcacagccuguaaguagugggacugaagugaaccauagcauggagaucauuguccauuaaaaacauggcaaaacagagucagaaucucaccagacuuguucuguugucuuacucuugcccagugaggucauuuguagaagucuuguguuuaaucagguucuucauggucuucuaucagccagggccgacaggguagggcugccuucucuguaacaguccuuuugacagcugugacgcugaaugcacccuaggaugucacgcauuauggaaugcauuauucauuguuuuguguguguggaggugaagucugaccaggcccugaagagcagcuuagcuguggcucccugcuuugauccaaaauagacuuggaaguguuugggaucuacuguagauccugcuucagaucuuccagcccugugcucagaugggaaaagacuucuaucaggggauggcgugaguguguguguaugcucgugcccgugugaacgucucugucugucagugucucuguguaacauacacaggaaguuccacuugaucuucaggccacacagcuauggaaggaucccaacuagcagauuccaguuggacgccuucuuagcuggggaccacgguguuccuuccuugcuuccacauuuuguucuucucuaccucaccacaccugugucacaggguuggccauggaaaccaaaggcugucugguauaaauacagauauguguaggagucuuuaaaaggcuauugguggagacauuccugcaggagacucccauagcaaaaggaacuagaagcucagccccauguuggcucauuggucaccccuccccgccccagcccugcccccagcaccugccggugaugucuuuauggcgucccuuacacauggcuacacccugagcagggaggcacuccccguggcuauggccuucuugccagacuuucccuaauggucuacuuucucucacuucaucuucugaggauuaaaauaauccccucugaagcccaagauggcaagcagcuuuacccgccaauucuuuccccaccacagugacagcgauuaacaccaagcagccgugcagugcagggcugagcuccgaaggccucaugcuguccuccuaccagaucugaucucgacugccuguauccagucaccuuguuuagaaaacaggucaacaguacuucgauguaggaaaaaccaauuaucugccucacgggcaauggagaagauggugccaggcaucaaaaaucucaaacuuuuaucaaaaguagaaauguugauucacaccccccccccaggcuugugcaacuuuuagagaacacuuggcaguugugagcggucagcauggcaggagugggagcccgcugguuucuguucacaggauccgugugcagggcagccccugagcuggggagcagacggugaucuuacgggcucccuucagugaugggagaucaugaugucucccacacucacagcguacguuucucgugaccaugugagccaucuugauguguggcucuguccucuguggcccuccgggaaccacagugacgcccugcucgggcaggacaguggucucuucauggugagaggggcuucuuagacacagcuccugccuccugccaggaggaggugugcagauguguaaggggggcuuuagaguuaagugcauucgaucucagcacacccaggguuacagcagcugggggcagggcacaggacucugcucaagucuucccaguguugcugacaggggagcugagcggaagugguucugcggagaaggaggggacucuagguaaccaugcugggaggagaucacucagcacaguuugauaucuuuaccaggaagcuugagggggcaacaugaggacauggauccgucauggagucccaggggcacaguguccagguugguuccaagggcugggaucaugaauacaggguucuucaccccuuacgcagucagaugguaugagcugucuugguccuaggauagcucucccauucuggaagacaccuuggaaaccacccacuuucugcuuggucccacaaauauauaucagccccuaggaucaaagggggccagguaggguuuucaggcagcagcacaacacuucccugccuagguagguccuggcuguaggcugcacugugugugcugggacagcuccugauugaggaggaagugcccugcggcaggcagccuggacacaccuuuccuggccuccccuguguucuguggaaugcacaggcuggugcuuggugugagcucugugguucagagggcugaggcacaggcugcaauucugcuaccuaacgucuggugccaccuaauauccuaggaauauuuguugggcaaacaauucagauaagaggagggccacuuuaauuaguucauccuugguucaauauuuuguuuaaauaaaaagccaggcacaccuuuaguucgagcacucaggaagcaaaggaagguagaucucugaguuggaggccagccugggcuaccuggccagccuggguuacauaguaaguucugggacaagcagacaaaugcuucucuguguuuuaaaaaguacuuaagaagauaagacaaaggaacaacaaagucggucauucuaucuggauugugcaacugcguucuguugcccugaguccguuucaucuuucuggaaggcagagugguggaguguugccagagucgauggcugcccacugcuccugggacccugggccugccagcucugggcacaggaagcaccuuuuucucagguuuuccucuuguggcugagaauuuacauucagcuagaaugcuggccagaaccgggugcaggauagccgugaugcacgaggcaaggguauagugcagaacuuggaagugccuucugggguagcggggccacccagaggccaggcacacagggacuacaauguggcuaagaggcaccaacagcucucaguugcacagggagguccuaggaaggagagcagccugacgcuggcugccaucuucaaacucagccuggugcuguaggcugaaucuugggagcucagaaucuggguuagguccgcagggcgagccuccauugaccucuguguuguuuccaucuggauuagcuggagucuguaugugaaaacagcaguuggggcauaaugguguuucuuuuuuaagcucuucugaauacccuguugagcuguuuagagaagcaagcuguguguugccuguucucagugcccugaccuucagccccucucucuaggacaugugaaucacuuccauuuuuauuaaaaacuuauuuuuuuuuacaauuuugcuguccuggacagaaugagggcauuagaaagggcaaacacuucgcaugcagguccaggcaucuccuuaccugucaauguuuuggagagcugcaggggauuguacccacauguguguacuucgaugcaggacacaugcauuuauaacccaccacauguauuucugcaaucauguaaacacgcacaauaccucccuuugucugguuugauggcuuucaaaguugccaggucaguguuccaugcaguguuggcuucugggaaggugucugccauaauauccucugucucugggguggcagcgaguuguccuugcccuuguaaggguugggucaguugcaguggccugguuuuagaaagagagacaccuaugagaccggcugauuuucaaaaucacaggcugcugauagcuguuuaccccccucuccaacuuggcacucaguuuugaggaaaaagcaaaaaacgagcacugugucagucgcagccuccccuugagcgccucagcccagcacgcuccagggaucgcccugccucugucccccuuggagaugggcacaggcaggcaccgaacuuguuacauggaagcaaggaauugaacuugggcccucauguuugcuguagcacuucuuccccugccccaguguguacacacauucacacacauacauacucacaguacacacacauacaugcacucacacauacuuagacauacacuuacauucacacuuauacaugcacacauacauacacacucacauauacacacagacucacauacauauauacacauucacacauauaccacacauacacacauacacauguucagacauacucagacauacauacauauacacaugcucacacacacaaaucacauacucauacauacacucucacacacauacacauacucacacauucacacauauguucacacacauacaaaucacacacucauacauauacauacacacaugugcucucauacacaugcauauacaaucucacacaauauacauauacucacauacacucaaacacaaguuacacauauacacacacucagaaacaaaucauacauacacucucauacauucucauacacauacacacauacacacacuuacauacacauacucauacaugcacauacacacacacauacacacacacagacacacagacacucucauacacucucauacacacauagacacacucacauacacauacucauacaugcacacacauacacauacacacauacacacacacucauacacaugcacacucauacacauacucucaaacacacuuuaauuuuggcaugccuaguauauauccagaucucuguauaaagauacagaugugaauauguccauccaaaaaacaggacugcaccagagcaacacagucaccucuuaguaacucaugauucugauuuggcaauuucgugcaugugcacacugcacuuugaucauuuuuacccuccguugcgugccucaccccucucacacucaccgaauucuucuuaaaagguucugucuuugagacaguucauggcuuggucagcaagugaguuaucguuauucggaccacccccaccccaacuucuaaccuuuccaucugguuucaugacuuuucgucaacuuuuagacuggacuggaacacacagacaccugccugccgccgucaccuccuucccaggagaguuagggcuacaacccagaguugaaagaggagcugugagaggggcccucaacauggcuguccuguuucuuuuagacccacagcacucuuuagcuuuugccuguucacaaccuugauuuccucacuguguaagaaggaagccugguuaccaguggaccauucuagaaggaaacacacuuugagaggaacucaggggcagaagaugcagucccuggagacucaucugcgagucuugcaggcccaugucuugcguguguggagguuuccucugcucuguaaggcacagcccaguugccugccacaggugcaggccaggagucaucagggugggagccccggggccaagaucacaugguuucacugccccagcaacucuucuucuuguccacaggcaggcuccagcuguggccccaaacacagaguguguaucauugacgagaucgggaagauggagcucuucagccaaccuuucauccaagcgguccgccagaugcuguccacaccaggcauuaucgugguuggcacuaucccaguccccaaagggaagccacuggcccugguggaagaaaucaggaaaaggcgugacgugaagguguucaaugugaguaagcccucaggggagcuggcuuccuuggggucacaucucagccccugugucuuccucucuugccuucugcaggcaguggaauagucaggggaguguuugaggugaugacugggaaggucuguccagggaggagccauggagacaggagccuuaggucauguauucaguggcaggguuccagcccgaaccucacuugaaagaugugagcauaugguaaaauuaguugcucaagucugggccuugaauucagaguugugucaauaauaaaauaaaccuauaaaaaaaaauggccagaagguuugaauagacauuucuccaaagaguacauaggagcugccaauaagcacagagaagguaugcaccccacuagcaugggcacugugaggcgcugcaccaugcccacaaggaguccucccaugcuaugguuagaggacagagaugggaaaggccgacauagccuugggccugggccaaccucagccucccuacccugcugauaggagggaaccugagcuacuccuggaaaccacucugguuucuccaggggcugccugcuagucaccgugccagugaguccaccauccugggcauucacgcagaaaacaugaauacucugauccagagcucgaaggacucacuacagccuuguucacaguacuucccagaugguaugagccaagcagauagacagauguguuauguguggucuggccaucuagugugcugagugacacagaggggcgagacacagacacacagacacacagacacagacacacacacacacacacacacacacacacacacauucugaagcugucuccugcugagugaaagaagcugucauggaaggccccgagauccaugauuccauuccuagacuguccaguaggcacaagugugcugagacaggauagaguggugaugggcaggaaggaagagguggcugcggauggggggcccugucugugaugacauuucuaacccuuacaugccguuugaguugcacaucagugaggcaguccacacacaugcacgcacacacaagucaaagccauggcaccauucuccuuuaggacucacugacgggcccuguaaauggcgauuuccaguucccuucccgcucagaucgccacccucuuacaaaaccuccagugagggcuagccacaugacgauagagcuuuugcccagugugcacaacaucugaguugcacccccagcacccuuacgaacagguguuguggcacaugccuuguaaucccagcacucaagugguggaggcaggagggucagaaguucaagcucaccuuucacuauauaguuuucaggcccagccugggaugcuuaagacccuguuucaaaaacaacaacaaaaaaagccaccacugcuauugcaugggccugcccucaggccaccauuuccaagcaccuucuucgaguuccuuuagcauguggacuugcaggagaugaggcuccuggcacgugaacguuggguggugugaugauaccugcaguggacaggaacuuccuccuuaucuacacgcucauggaagcccccaggugcacccacuccugcuuuccuugcuccacagcucugcucccucucugaauaccacguaccgcugaccagagucucugaacaccacacaccaccagagcagauucugcccgggcucaggucccucuagacucccgucuccagccccaccgagccugcacucccuuuucaggacucugcccugcucgcuagccuucuuuauguuccucuccauugugaucugugaucuccuaacaucagaguccuuaacagcaccagacacaaggucaggaggcugagauugugcugcaacccccugucuucucuggcucccuuucaucucucagaggagcagccaucugagguccgucugcggcacucagacucuccagggucauggaaagaugguggauguuacgguccugggagugaccuggaguugugggcagcucuccuguguguugcuccucugggcccggaccaagcuccccucugcuuuuuuuccaaucaggcuacagcugcugagucccacccucucccaucuccauccugugccugcagugcuuugagacaugcaugccccaugggacuuggugauccugaagagcuggcuccuaccgccuuucccugcucucuaggaaguguuggcuuggaggagcagaggggaggaggugcucucuaagcuugcugucuugccuugccccacaggucaccagggacaacagaaacagccucuugccagauauuguggccgucgugcagagcagccggacguaaagcagcgcuguuggguccagcucugccucugcucacggugggcccugagcagcacccagucaguccaccguccucugcucacggugggcccugagcagcacccagucaguccaccguguccugugugagcuccagacuuguauuuccucuuacgguugugcaugcgguuugaguaaauucuaaaacgagucugccaaacauuaggcggaauucgcucccaccggaguguauaauauguuuggggcugaggaaagacggggguucacuucuuccuugacuuugagugcuguagauauuaaacaccucuccaggugcagcuccacacuggugcagcugaaagcagaaacaacugguucucuucaauuauuuccaaaggaggaaaaaaaaaucaguucuccucucccucucuuguuuauuccucuguuucuugacuaauaaaaauggaaauaaauguggugguucagauagaca

SEQ ID NO: 4899 - RNA, 1246 nt, Mus musculus
ggcaggagggucgugaagcugugucuaggcagcuguggccacaagcuguaagacccaagugucuugggcagagcuuuggaaggcaggguuccuaaagauggggucacaucacccaugucucuguuccagaaaguccaaaaggcaacacagguggcaagguuguguccugccaccuccaccacugaauacuucauaaaacucagcccggcaaacauuucccucuauaaaguuagcccuauaccugcccuauagcaaauguaucuuguccuaucagcucacugauuuaaaacaacaacaacaacaaaaaccaaacaacaacaacuagagagagagguggcucagcugugagagcacuggcuguucguucaaagaacucaaguuugguucccagcauccacaggacagcccacgacugucuguaacuccaguuccaggggaucugaugcccuuuucuggcuuccacaguuaccaagcacuugagguacacauauaugcauacagacaagauagccacaaacacauuuuuuuaaaaaagauaacaaaagauugggagcucuuuccuccugacccucucagaccucccuucuagcccagggaucuccaguggccaccccaggccaccaucagagaagcuucuuugugcaguagaggggaacugacauagaccuacaucuggccgaugcagaggagagacgcuggagcacucuguccuaaaucaaagccuuccccucaugacucaaggaucuguaagggagacgaaaagauucuaagagccaggaaugauggaugucuccaaagaaacuggacugacagacaugugaacccagagaccugcagcguguacaaggccugcccaaguuaaagucagaccggguccuaguguugagaggggaacauagacaaaggcucucaaccccacuaagaugcuaucugauacccuugagccucagggcaggcaccaugcucaccaguaacuggccaacacaaagaccgugguaauuuuguaaacuuuuugucucauuuugcuuuuguuuagaaaccuuuuuuugucuaguugaucagucuucauuuuguguguguguguuuuccugggguguuuuauuuuguguucuucuggggguggagggguugauugcuuuuuuuuaaagagucagaggacaugaaguugggugaggagaggaucuggaagcaguuggggagggggaaagcauaaccaaaauauauuguaugaaaaaauuuucaauua

SEQ ID NO: 4900 - RNA, 5093 nt, Mus musculus
uuuuaaugcuuugucggcucauugccacuaaggugagaccaucccagcugaugaauuaucugcagcagaaaaaggcagaaggcuacacugucauuggcguggagcagacagcgcaaagcucagaucuggcccaguaccgcuucccugagaagucgcugcugcuguuggggugagcugauucucugguccaugucacuucucuaggauguuuuaugauuuacccagguuccugccacacaauuuccuaugagcuuauagcuuuuaaggggaccugcugguuuuccuuuucucaccuggcuguucuuguaaugcccuuacuuacuggaacccagguugacuuaauuuauccuucuccaauaguaacauucagagcuccuaaagaacauaacaguaaaagguucuuccuguaauacagggaaacuaacaugucuuguucaauuuucuucugcagaaacgagcgggaaggaaucccagccaaccugauccagcagcuggauguguguguggagauuccucagcagggcaucauccgcucacuaaaugugcaugugagcggggcucugcugauuugggaguacaccagacagcagcugcucgggugugcggagccaccauccugaaggcugggccucaccugcgaucucucauggugcuauggugacuuauaaccuucuggacuaacgaaauauucugagauguccugggauuuucuucgugucucuaaccuugcaccucaaugccaaaaccuuuucaugugccuuaaaguauauaucauuauauauauuguccccuuuuuagcuaaccuuuuuaaauauuuuaagcauuuaugggauuuuuaaaaaggaauuuuuaaguuauggucuuccuagaaaccgguauugucagacuggcagaacuaaaguuguuauuuaugggcaccugugcccuucuguuuugagaggcugccuccucucccugcugcuaugcaccuguguauuccugcugagagagggagcacaugugacaagacgugagucagcgccaaugauguucuuuauccucagguccugagcuucauuuccaaagccaaggauugagcccugguuguuugagcuaggguucaaugagauuuucuuuacaugguuguguccucacaucaucaccccugugccgcugagccacucccgugaaucccuacugaaagcaagaacaaaauccaucaaugcuuucuguucagauaagugcauuauucaaugguaaucauuaucauuguccagcaaggaacuugcuaacccuggaauccuuugaguaauacuuaaauaucucccgaaguuuugaucugcaacaguguuucaaacauagaccaccacaucuccacacccccacuuccuccagaugccacuccuguggucugacauaaccuacauuaucagucuggcuucuuucagguagccgagugcauucccagcucauccaggucuuugcuuguguuguugguauuccauccaucaaugggauagaguacuccuccugccauaggcaucugguuuuaaaugacuugagugaugcugcaggcuuugcuuucaguucauuugcugagguagcuaggaguggggcuuguggguuuaaaggucagcauguuugacugaaaaccucuguagagggcuuuccuaguuuacaguaucaccaagagugucuuguucugcaucccugucaucacuugguauugucagacuuuaaucgaagccauucuaacugguaucuagugacacagcaguauggcauuaauuuccauuauucuaauauuuaaugauaaggaggcuccuuuugcccacuuuuuaaaugggaucaguuaucuuaucaagaaucaugagguauuuuuuuguuuuuuaauucuggauucaaguucuuaaagaaauaugugacuugugaguauuaucuccauauuugugagcgcauccuuaggcauuuucuuaaucaucuuugaauagacccaguuuucccuucccaaucuacauaguuauuucuucuuugucuuacugaaguagguagcaacccagguauugucugaucacugaggacauuugaacaaauguuaacccauugauuaguuaacuucauccaacuucauuguguaguuuuuguauuaaagugcuaacugccagaagcacgcagaauaaccuaucuuaguuuuuauuuauuuuaugugcaacuauauuugccuaauaugcagcucuuauuccaaagggggaaaggaaaauaaacaauguauuuuuauaauaaacuuuuuauauaaugauuuuaugcuuuuucuuagaauagaucccucacuuuaauuaaggcaguccuucauaguuuggaugaugagaucuuuugcuauuccaacaauuuaguaacucuuguuuacagagaacaagugcugauacacacugugacucaagcugcuuuuguccuggaaucauuucugcaaguccagaggaguaaauuccacuugugugaaaguccagaaagagccuaggaauuuucagucgacugugaagacuggaauccuccugcuucaaauuuuuccuugaauuuuaaguagucucuucuuuugucaaaauauuuuaucuauggagauaaaaaggccugacauuagagcaaguuacacagcuuagggaaucaaaagcacagauuuaaacguagcauguuacucauuaucaaugauacugaagcaggaugguaguuuguauucuggaauccugagucaggagucuagucagcuucuaagaagccugaagaaccaggagucuauccuucaugacuaguguuucuguuuaguguccaaacgaccugggaacuuaugaaacaguuuuaugcacacuggggccuaguaggucaggaaacuuucaguuuuacagaugauugcuggcuauagguucagugugucgaauaaguuauugccccuggcauuuuucucaacucuguuuuaucuagaagcacacacaucuggggaggcagacaaaugacuaacuagucacauuaugaagauuugggguuuuuauucacagcuuccucucucuucauggggugugauacugacccagcaccuguagacaggacaaaugcaggacacccccucccccccaacaugugcacugugagacuagaaaaugcugcucuuguuaaaagccuucaguguaugcccuaauggacccccccccccccccgccuuguucacugagaaaucguguucucuugcauaacaggcagauuugaauggcgcacccucuggcccagaguaucaaagguagcccugacugccaacccagguguagguuucaaacaguuucugaacacgauguucaaucuuuaacuucaugggaaacaggaccccaguucagaguggguaaggaacuguuuguauacagcuccacuaagccugucacaacacugcuuccucugaagccucaucccuccccuuaagucccuuugguuugauggccucugucccucuguuguauuugacaugguauucauaaaucuguucagucugucugucaaucuugaacuaacugcacuagaauggguguugcauaaaggauauaagauuaaaaagcauaugauaucccucacauuuuguggcaaauuauuguaacaucugucaggaucaaugccccaagagacaauuacauuuaaagguaauuuaggcauuccaucccaacuuaaauggggugggacaagccauaccuucuacaggacugauugaucagaacgggagugacuacggagagguuugauugcugccaggucugucuuuagcucucucuacucuuaagcucucuuaaucccuugcccucuucugugacugacauaacacccuggugacaggugaaaccuucuguaauguuuuaacagaccacuggcuuccaccaaccagaaggcuuccuuugcuguaacaaacuuaccuuuuguuuccaccguuuguucuguuccauaagacugcauaaaacuucugccaaaugguaucuggggaaaaccucauacucuguuccugagccagucacucauauuuggcuacaaaacagacuagcccuugaagcgagagcaguauuuugguguugacaacagcuuguccagaacucagcaccucuuaggguguuucuccucccgaaccugugggugcaccagccacccugagcugugguucucuugucccugcauagcacaugcccacaucuuucucauaggaccgcuguagagcagaguacacguacacuucaggaucuuaguucgaauccuccacuacagaggcugcuucauccuggagaaauguuucuccucugaugcaugacucccgcggcauaaaucuggaugcaagaccucccaaggcugaauuuaaaaucccagcgaaugaauccaagugucucucucagaacacauucccaugauccuccaucuccuccccacccucucaugcacgagugucuuuggacacaccucucagucuuuauaggagucgacagaggcugggacaaggcgaagagagggaagaacuaauacugagugagccagacugcuuaauaugaccaggcucuaggggaggagcugugagaaaggcuauggacgccugcagaagucacagcgcuguaccaccaggucccuucuccagagucugguagcgcugucauuuucuccaguaauaccaacuaacuggugacuuccaacgcgugaccuugcuccucaaaacccacccuaaggugagggugcgcgcagggauguguugcaccccgcgggacuuacccacugcugggggcagcuggccucgaacgagcuccucagcuucuggcaccgggccgcguccuccgcguugucguccaggcagcgccaguacaggucgcgcgcaccccagcaugccugccuuuccuucauggaaggggcugccauuccugccugcaguggucacgcgggaagccacgcaacaugcgaccggggcucagccuacgugggagagcgguguggacugugguucccgcacggcggugucgccccgcagguccaccgacugcacagggaaacucacugcgaaaguacccgccgccgauugaccugccccggccuccguuugcaaauag

SEQ ID NO: 4901 - RNA, 21625 nt, Mus musculus
ccucucaaaacagaagggcacaggugcccauaaauaacaacuuuaguucugccagucugacaauaccgguuucuaggaagaccauaacuuaaaaauuccuuuuuaaaaaucccauaaaugcuuaaaauauuuaaaaagguuagcuaaaaaggggacaauauauauaaugauauauacuuuaaggcacaugaaaagguuuuggcauugaggugcaagguuagagacacgaagaaaaucccaggacaucucagaauauuucguuaguccagaagguuauaagucaccauagcaccaugagagaucgcaggugaggcccagccuucaggaugguggcuccgcacacccgagcagcugcugucugguguacucccaaaucagcagagccccgcucacaugcacauuuagugagcggaugaugcccugcugaggaaucuccacacacacauccagcugcuggaucagguuggcugggauuccuucccgcucguuucugcagaagaaaauugaacaagacauguuaguuucccuguauuacaggaagaaccuuuuacuguuauguucuuuaggagcucugaauguuacuauuggagaaggauaaauuaagucaaccuggguuccaguaaguaagggcauuacaagaacagccaggugagaaaaggaaaaccagcagguccccuuaaaagcuauaagcucauaggaaauuguguggcaggaaccuggguaaaucauaaaacauccuagagaagugacauggaccagagaaucagcucaccccaacagcagcagcgacuucucagggaagcgguacugggccagaucugagcuuugcgcugucugcuccacgccaaugacaguguagccuucugccuuuuucugcugcagauaauucaucagcugggauggucucaccuuaguggcaaugagccgacaaagcauuaaaacucaauggggcuuuaaagcgaaugcagaacaccagacagcaucaggaagguucccuccacaucacagccugcugagugguggcuaaggggacugccacacgaccgcaggucacagacuaaaccuggaacucaguacugaaggauuacacugagaaacuggcacaaagacacuacaugccaaaacaccuucacaaauacagaaugcaauaagcgacuucacacucaccuccaccagaggaagccacugcucugcagacacacugaggugcuggaacugucuaucgcugacacacugaaggcugccgacaacaaguacugcagccccgaacaccucacagguccugcacagcccuguacagaauggcccauuaccaagacugucuccagcaugucacaagguucacaccaccccggccuuuccucugaagccugccuagaggacuguguauggaacagacagccacaaaggguagaugacuuuaccucccagguuggucggcuugucgaugagugaggccacaacgaucagucugcuaauggacuuuccgagcuuggcagcccgauccugaaacucgagcuccaggucugauuccagagcgcuuuguccccaugggaugauuuuuuucuggacaucagcccauucugacuggcugucugcuucacccaaaguagaaccugagaagaaauaauagugccuacauguaacuuagccagagucaauccucuuugcaucuucagauguacuuuuuaaauauccuuucuucuuguuaacacuuguauacagcccaauuguauguauauguaacacauacaugcaggugcccacagggggucaaacugagggaagagccagcagaaugaggcugcccuggacacacugagccacuggcuuuacagggaagccugauugucacuggaagagggaaggcuguggggaaagugcagaaugcuugccuaaccagacccagaaggaccaggauccagagaucugcucuguuguaagcagacaauaaccugacaucauguuuagccuuauggaaagcuuaccuuucuaaaacaaaccacagacaaugaauucuacuuaaaaaggaagccaccaucguuauauaaagaugagcucucuggaaagcgagcauucagcugaaaguccuggucagagccaagccacacgugugccugacuucucuaaguagaggcagagacccaggucagugaaacaaagucaucaagaccugcucuagagcagcagccaggagccaaugaaccagggugaaaggaagcucccuuaccuugguccugcugggaccagucuccuggacucagcucaccgagugcagucccagacagguaccacugggacccugcauuggaagggaugucugugaaguuggcaaauuuauccaaggcgauccacuccucuccagugacacccgagagccgugggagcguguaaaauauggucugaaaagagaguuguaaaaucuauuauuuuccuuaaaaaauagagggggaaaaacaaagaagacaaaacaaacaaaaaaacccagguuuuauuaaugcuagugcuucucucaagccauccucaacuugcaggcucucaggccuguguaccucuguaguuaugcuucacucugcccugggacauucagagauucacuuagagacccccaagggcauguagggccucuccagcacuaacgacaugugacuacuauguucuuaucaagagcacaccaugcuucaaaggguguuguaacuaaagagaagcauauaccuaaaggcaguguccuggccaccagacacucaucccaugcccaguuacacugcagacaucccaaaccuguaacucacugugugacauggagugagcugugaaggcuuugucagcuuugguucaucauguguaugaagguggguaaaauggagccuauaaagccaccuucuguuccucccucuugaagaacucucaaccauggaaaggcaugugagagaaaaaaccccaaguaacaggcaacuuaaaagcaaaaugacacccacugcacaugcaagggugguuuuaaggcagauaugguuuguuucaugcuagccauauuugugcaaauuuaaacuggugucaugaugaacaguaaugguuaucagcugggccuccuaaguccagcugcaaacacuaaggcuuggugacagagucugauggcccaugagcucccggccuggcagucuacacacauagcucccacugcugcucgcccacucugccugguauugcugaggacaagaacagcagaaagcaaggcuggcaguggggagaggaagaagaaaggacucagagcuuggggucagccuuggaaaagguggauggggugcuagagagcccuuaggaagguagcagcagagugggcuguggagccgaggagcaccgacaaaguguucgauggugaaaaauccuacuaggucucaucuugagaagaaugauauugguagugugacagaaagcacuuguucacguguguguguguauguauuuguauguguguauauaugucuauguguguaaauguguguauauauguguguuuguguguguauguagcuaggcucccaauauaaacccccacagaggaaaagucacucgggucagguacucucccuucagaucuagguaggcagcacagugcuguaacuggagcugaaaaggguuuaagaaugccugguguucuaaauuuuaggaauuuacauucugaugucauguauuuuaacugcaauguguauguuggcaauuuuuaaaaauuuuuaaaauuacauaagcacucugcuacuuucagcaaagcgaagcaccauuugccauacauuucauuacccauaaccuaaaaggaucaacugccauuaacaagagaucuuuuguucuugcauugguaacgggcuucaguacaaaagagccucaccugcacacauguucucucacucacuuccuuucagaaaucuguucugauuuuugcuuagaguuaaauauucccuuccaagguuuacaagccagacacugccagagagacagaaagugagaaaugacuagccaguugucacugcugagggaugaaccgcaagcacguucacaacgucacagggucaaggggacagaggaugaaccucaucguagcguucaacagcuggggcaggaaagagcaucaggacugcagacagcagacagacuacaugcugcgcucucagcuuaccuccagacaguaguccuuaaggggguggaagguggagaagaagaaaugguccuggaugcgcugccaguucuuccuggcauuccugagggggaggacagggaggaaacagcucuggaggggaagucuguacaguaccuuagagaauucucuaucccggacucauaguccauacucuccaacauuaagguauguauguucuaguucugccucugccugccugccucugagguugugguuuaaugagaaacguccccacagguuauauauuugaaccccugguccucaguagguggcguuuggggaaguuuagguuuauggccucgcuggaggaagaacgucacugagggcaggcuuugagaguucacaacuccacccuauuuccaguucuguucccuguugggaucucucagcuuccuccuccugcugcuugcugucaggcguccucagcauggugaacacaucacccuagaaccauaagccaagacaaacucuuccuucuguaacuugcauauggcuguuuaucagucacuaacaaggggcuacuggggauuaaucccuggggccucguguaugccaggugaacacauugccccugagcucuguccccagcaugcaauguguauuuuaaacugccacauagauaaacugccacauagaaauguucucacguugguugugguuuuugagauagagucucagguucaugaggauagccuugaacucagauaucugaagacaaucuugaaugucucuaccuccaagugcugggauuacaaauacauucgaccguguccaguuuuuuuguuuguuugcuucuccuccuccucccuuuaaacuaggcacuguggugcucacccacaauuccaacacucaguaaacaggcaagaggauugccaggagaauaaaaccagccucaacuacauagccaagacacuguaucaaaaaucaaagaacaaaacacaguuuugcuuuguuguucuuugcagaacuggggcuugaaccccggccucaugcccuucagaauguguucuaccacucagcuacccacagaguuuuauauuuugaaauggaacucaaggaugaacagagaaacuacguaaugcuuucaaaaucauacaaaaacaaacccaaaaaccaaacaacaaaacaacgaaaggaauaaaacccaggucucugagggucaaacgcaggcauuguucaugaacaugaaggaggaggagaacacacucccacuguguagcccaggcuagccucaaacucaaucacauagcacagacucaaaacaaccaucaccucugggguuggggucccugcguuucuggcaguggacccuucucuccuagaaucugauguaggcugugguuuucacucugaagacagcacagcuaaacaguauccacccacaaaaucuaaaugcaccagcuaugagcaaggcaaacccagccaccaggugugaaaggcaaaagucacgugacaggacaagccauuuagagcugggaccaccagcaggaacugggcagcacuuucaggcuacgagacuuccuauacuuugcccuuuaaagaauuuucuacauaaguuccuuguaccucaccuuccucacugcccauguuuucgaaaaaaugaaugacaagaaguacuuuaaacauuccaagcaucuaaacacaaacauaauaaaccccagacaaccaccugcagagaggucacaggugucugccacuugugugcuauacccauugcuguccagguuccauucccauccacacugcuguacucagugcauugcucugcaaguuccaucccugcucauacugcuggugcaguccccagcuguguuguuacacugagccugucuucucucacacucuccucgcuccuguccauuuauccccucaccagcaucaggucugagugagcagcuuuccucucacuaugcaggcuacccuggacaugcuccucacccaaagccaaggccuacagguacuggucacugucauccuaacucuuuucaguucucugaauaccuagauacuugccccauguccccagaacuggccagggacccaccugcuaccaaucucuaauuccuaaagcugcuucucuuacccagaaaucucuuuucacucaccaauuccugcuuuuuuggaagucacagaugauguugguaaaaggacuucucuaagccacauguauucaccauggugcccucuguucuuaucaccuacugaaaggcacugggaugacuacuugacaguccucuuuaccugacugagccacauaaagacaggaccucugucuaccuggccugcugagguaugugccugccacagaggucucaaagaggggugugcacuuagagaacagagaaagcauaaagcucagaaugccugauucucacugacugugucccuauuugggaccaggaguuuuauuaauaauaauaauaauaauaauaauaauaauaauaauaauaauaauauaugagaucggagccaaauauuuuuagggaccagggacauuaaucuaggauccacaggcagagaaaacagcucagugcucaccaggcagccaugaccucaccacagaaagcaaugcucaacuggaagugggcagcagaggggugaggggccacucugaagucagucuggcuuccuccaggcugccugccugcuaugcaggagccaugaguauaaauccccaaucuggccaaguguugguggcucauaucuuuaauuccagcacuugggagacagaggcaggcauauugaagccagccugaucuacagaacaaauuucaggacagccaagacuacacagagaaacccugucucagaaaacaaaacaacagcaacagcagaaacccaaaacccccgaucuggacucaucaaucuaucuaucuuagcaucaucuguugcaugggacugacccaagcccucugugcucuaucacagugggacagugacagagaaaaggguaacaaggcuccucuaaggcucugcuggaaagaacaaccaugaagcguccuuacccugcuccgugcaugcuuucugcuuggcugaggcugcacucgaugacugcgguccaggcgccacacuccucaaacugcaguguuuuacacagaugccaggccuucuugagggcuaccagagcauagagccgaacacugaaauugugacucagacaccacuggagggcaacggugagagcuugcuucagaaccagcuucugcaaagauagaagaagcagcuugagggggaggugugacagcaugaggaaggcuguaaagaauggaggacugacagcucuugccagccuuucacuagccuggcugugggguuguuucuuccucccaggcaaaugagcucagaagcacucacaacugucucaaggaaaacagcauuaaguguccccauucuucuaauggcuacaauaugucccccacucuuacaaccuaaguugacaucaaucuucaugcuggugugacagggucauuauguucuagaaaugugacccccaccuuauuacuugaccuaggcugaaagguaaggaaguguccuauaggagucccacucccggagaaccugagguacccaccuuccuccaucaagugcugagcucuuaacucccuagcagccaccucgagccacucagagacagaauuaagaagcaggcaugggauacuugggaaguggcagcaggacaaccagaaguucaggguuagccugggcuaaacccauaaggacacuugacagguuaaggucaguuagagaagagggugguuugggaagauugggggagggguggauaugaucaaauggcauuguaagaaauucuuuaauaucuaauaaaauaaggaaggaacacauccuaaagacaacuaaccgugaaacaaacaacaacaaaacuguacaaacacauucuuuuuuauauuagaaugccaaguucaugaauucuucucccaaacaauucaaaacuuaccuuuucuggaauauucugaacaaugauguccaaaugugauaaaacagauaaaaauguacaaaugcuugccuuaauuuuuucuucacccugacagaagaugagauagaaaaaucguuauuuggggcuuaacugugagcagaggcuccuggaugcuggaccggcagagguaggaggcagccucugcucucuucuucccugaagcagcuugaguucgccuugugucggggccacucccugcagcccaagguaaugcaggcaacgcugagagaacagucaagacagcacugaauggccucacuguaccaagccccugggccaggccuaccggacaggaguggggacuggggugaggacauagaggaagcugguaaaaagaacaagauaaauaaagacacagggcagcggaggugagagucacacugacccuugggacuguguccugcuguugcauacacggugacagccauggggaagaaaugccaucuggagcccuagcccuugcagacacauauggcuaucaagacucucaggacguagaaccaccaagaacagaugcuguguacaugacuagguagguguugaguauccuagcaacccaaaccugggugaccuggguguuuaugcucaaucauaguaacugggaugggguccaggagggcaaagagccuacuacggccaccaacacucauaucaaaugugauuuucacacagcaugagaacaaggugagguuagcuguuuagaccuagagucacagaagggacaagacuucgggcacacaggugaggaaugaucuagguuagguuaacugaguugggggagaaaaugaacugagcaucaccauucaucccuuccugcuuccugacuacagauguaacgugaccucacacuccugccgccaugccuuacccgccaugacggucugcacccucaaacugugagccagagugaaccccuuuuuccucagguugcuuuggucaggaauuuuaucagagcuauaaggagugauguggggaggggugaggugagaguuggugccagcucacaugagacagaacagucaugagcugaugguuggccuuggcuaggugucaaguguuuccuucuguacccucuguggugauuggaauaugcuuggcccagagaguggcacuacccggagguguggccuuuuuggugucacuauggguaugagcuuuaagacccuuguccuaucugccaggaagucagucuucuccuagcggccuucagauuaagauuagaacacucagcuuauccugcaccaugccuaccuggaaacugccauguuucugccuugguaauugacugaaccucugaaccuguaagccaguccccauuuuguccuuggucauggugucuguucauagcaguaaaacccucagagacccucuauuuugguuguuugaaguuucccuucuacagcucuuuucaaagggaaagaagcaauucauuccucaccuuccuuauuucuagcaucaagccaggacauggcuugguauuacacagcguccauuugccuugcuucuuuguuuugucucagacagugccucacugcacagcccaggcuggucuggaaauucugauguccaugccucagacucccgagugcugggguaacaggugugcaacaccauacccagccucccuuacaucuuaauagcaaaagccuuucccaccuuuauuuugucaaaauuagaacaaaucccaacacacucaagacagacuuggggaauuucuguugcccaguugcacucaggaugcacauuuagaaacuacagugucaacaugacggucgcugagggacagaaacaggcacugaagugaggugcaccuccacagccacaaccuuuccuaguucagaacagcgcaagaaaaucuuuacuuacguaagaaaaacacgcccagaacuuuggaagaaacucagggaauuuaugaagaaucaauauaauaagccacucaauaaaauauuuuauggacgcuugauuguuggugaagccagcgugaaagaccuuaucaauaauuccauguaagaaguucuaaaggagaaagcauacauuaaauuguuaacacacuauuaacuuuucaauuaaaaaaaaaaaaaaaaaaaaaaaaaaaccuccucagcugaggccggagagauggcucagcaguuaaaaggcugaagaccugggugcacucccagagcgcagacuugucacgccaguuccaggagaucugacaccucuccuguggacacuguacacagacaguacacagacacaugccaaaaaaccacucacucacauaaaauagaagacugacuucgugcuagagcauuucuagugaacaccucaauucuaugaugaaggcuuugaucaucuagguuuugacagagauagauacagaagucuaauaauuuuccuaaguuauauaacucaccucauuucuguggguggugcauuguauguaaauguucacaugugcauggacucgugugcaggugugaguauggacacauacauauggaaggaggccagaggucaucagugucagguguuuuccucagucacucuccaccuuauuuucuguggcagagucucuccaauuuggauagacuggcugaucagcaagagguagggcuucucccaucuccacuuccuaagcaaugggaugacagugugcuaccaagcuuggaucuucauguggguaguggggagugaccucaaguccucccacugagccaucaucaccccagggcucagccuuguguuuaaguggcagcacucaugugcagcuuauuucacgcuuggacccagcagcucagaaacacccggauaaggagcaaagcuccagccagugaaugcauccaucaaccugugcucuggucucucagcuccauguccacccccaccccaacucccaguuguucuuuggacuagaccuugagcuccaacuucaccucucccucaccuguccucuucacaugaugcacauguaaacauugggagaaagcacuuauuugcauaaauacuuuauauaacauuuaauaggcuuacuuaaaaauaaugccuguuauacuuuuuuaucuuuuuuuuuuuuucuuuuuugggggguuuuucgagacaggguuucucuguauagcccuggcuguccuggaacucacuuuguagaccaggcuguccuugaacucaaaaauccaccugccucugccucccaagugcugggauuaaaggugugcaccaccaagcccggcuauauuuuuuuaucuuaaagaagauuuuuguagagucuuuuaguaagaauuuuuuuuggguaaauuugguaagaaaauuuugguagaaaaaugucaaaaauaagauuuuuaaacuacauuuaguuagugaguguguguauguguaugggugaauggguguguguguacauauggagaggucaggacaacuuuugggacucaguucucuucuuccaugauguaggccccaaggacugaacucagacugucugucaggcucuccaugugucugucucuuucucacauuccccuucauucucccucucucuuugucucugccucacucauacacagauuuuuuuuuuuaaaugaaagggauuuuacaucuugacacaagcuagagucauaagagagaaaggagccucaguugaggaaaugccuccaugagauccagcuguaagccauuuucuuaauuagugaucaauaggggagggcccagcccacugugggcagugccaucccuaggcuggugguccuggcucuuuaagaaaccaggcugagcaaaacaggggaagcaagccaguaagcagcacucaucuaugaccucugccucagcuccuuccuccuggucugcuguguuugagcuucuguccugacuuccuuuggugacaaacaguccaauaaacccuuuccuucccaacuugcuuuuggucaugguauuucuuugcagcagcagaaacacuaacuaagacacagaacaugagaacuaucacaccugaucaaaugcagggaagaggacaagcagagucugccacacacgguucuucacccggugcuggagggaguucucaugguaucgaguucuggaccuggaugcugacucauccugaagagacagggugggaaucggucaggguaagccuccuaccacaucugugacuaagaacaguaucagagacaacugcaaaccugaaaaguguuacaaagcagcauucuauacaccucuguuucugccccuuuauccuauuuggguuugaaucugcaguucaauuccaaugucacuaagggggcaaucauucaaugccaccucuaggcacaggguggcagcaccguguccuccugcaucccagagcuuuucuuucuggcuuucaacaaaaucagccaagcagcccaccuucccagggucugaacccaggggcuccuuuucuacuaccaagcuacagcuucagcuccucgagggagaccuuugucaccaagucacugcugacccaagaagccacugaagaauguuauacauauugucccuuuccuuuaagaugaaaagccagucaagcaucucuggggccauuuucaucaaagguggguaugucuucacuucucagagaccuuucuagauaauguucagcuccucuacuuucaggucuaaccagcuucgagguagccaaugaaacacugcuuccuccgagagagcccccacauccagcucccacaaggaaggacaggacauuuuuguucuccaugaaaaauccuuccuagguuuucuauaccaaagcuggccuucuccauucagaaaacaaaguuugugaacaguccuguuuuaaguaagacccgugacuaagguucuauauuagcucaagcacccacgaggucagacagcaggauagaacucuguccacuugaggaauaaaagaaccaggacacagcucuuugguagagcaaucgccugguacauacaaggccccagguuccacuuucauacugacuacacucaaugccauccuuucugauuucucccagauuucuggaacccauccuucagaaccuguaagggucauaggugacuuggcagaugaucuggcagacacagaaaagcuggucauuuuuaccuccaugaguaagaaauuuucaucaauuccacagaaacaucaggaaccugaucugagccugacagcgaugagucuuaagacagguaacuguguugguuaacacuguacagcaaugagucuuaagacagguaacuguguuaguuaacacugcagcuggacaccauguagagucacugaagagagaagaugcugaguacgucugugagagaggcuuuagguuagguugaggugggaagacccacucuaaaugugggcugugugauuugaugagcuggguccuagacuaaccagaggaggcagugagcugaacacagacguucaccucucucugcuuccuugaucaugggcucauaguggcuaccucagccuuccuggucaugguggacugcacuuugcaaaacaguagccaacauaaacccauccuuccuuaagguguguuuguccugucuuuuuucaugacaaaaaaaaaguaaugaacacagcaguguuugagggauucucagauccccucagguugccccuuccuggaugucuacauaaucucauacauagugugugcauguaacaugggaaaugcaacaugucuggaauggcaaccaaagauacacaggugaaggcuaccggggcaagggaaccaaaccugggaggcuuagguagauagguacuaacuaacgaagccuuaaucaaaaccacagagcaucaccaucaggcuuucugugguaaaagguguuuagaaauacuccaugucuccacauguucgggucaaauaaagggcaaguucuagaccauggccugcugagagcagaauuaauucgaagcaggauaaaggcuccuccuuaccuuauccaagagcuugauggcaagagcuucuaagaacaacuugugggacacaucggagccaucuagcagacacaagaauuugauggcacagauucucacguaauaaucuucucucuuagcacuuaaaauacaaagugauaaacuauguuaauauguuuuagaaguaaaaaaauguguccacauuuuguaccaaaagccauugcaaguaccaagcccuccucugaaacacguugagauuacauaggucgagauuuaaugaacgucuuauugaauugggagacagcagacaacaacagaguacuccacagaaaaagcacagaaugggcacagauccaccuagaccucaaggaucuacgcgugcacacacacacagacacagacacacacacacagacacacacacacaccuauccccagacccuagugugagaaagaggaacaaaaacaagaguaugggcucacaacuccauggccugucucugccucccacuauacgguauuucucaugugcucugaaugucugcccaucugcaucaaagugaaacuguuggcauuuuccauaccucaggugaacucuuccaauguuaauagauaucacuuuaauguaacaauaagcacuuagcaagacccacuugaaagugacgcucuacuauguuaaaccagccgagcaaaugaaaaaaugaaaaaccuuaacugggcuggagagauguacuagcugccugcaggaccugaguucaguuuccagcacccacaucaagacgcucacaaccuccuggaacuccaacuccagggaucuaacacccucacacccuccucuggguucuguaggugucuguacgcacaugcacauguacaaaugcacauagagacacauaaguaaaagucuuugaagcaauuauaacugcucacauuuagggaagcauggcagaugauuuaaaguacagcuagcccuggagugaacacuugcuauaaacacucacaucaaucaccuguuggcuuuaacucuaaaaucacaauaaaaugauuucauaaucuuuucauauuucaaacagacauguggguuuaugagagaagaugagaaaauaagacuugaauaaaaagucuuuugaauaagcuccaaaaaauucaauuuagggcugguaagauggcucaugggaagaaugcuuuugacaagcaagccuggcuacccaaaguuccacacucaaaacccacauagagguggagggacagaacuguacagagucguccucugacaucuauaaaugugccauggcacaagccccacccccccaacacauaauaauaaauguauuuaagcucaauuagauaagaaccaucuuucuagaaauacacccucauggcuaucccacgcucaccagcuacacacacugacuagguaugaacuuuucuauguuaauuauucaaugaaaaggcuucaaaacaacccaaaacaaagaaacucagggccuuucauuuacucuauuuuucuauauaacauuuacuuguuaaaaugguaacacugaauucuauaaauuuuacaacccacuaaagguuuaaagaauaaaguauacauguuguuccaccucuccucccaaagcccaaccccuaaggaggaggaggggccuauauuauuugaaggcaugucuuuacaugaacuaggcuacauuacaucuuugaaagcguagcaacuuagcaaauagugaaacuauaaauaaaauauaugagcaagaggcuggaaagauggcuggggcuagagagaugacucagagguuaagagcacuggcuguucuuccaaagguccugaguucuauuccuagcaaccacaugguggcucacaaccaucuguaauggaauuugaugcccucuucucuugugucugacgagaguaacagcauacucauauacacuaauaauauauuuuuuaaaauauaugaacaaaggauauuauuuuuaacucauuuuuaauuuuuauuucaugugcauuguuauuuuugccugcauuuaggucugugugaggguguugguuccucuggaacuagaguuacagauaguugugagcugcuaugugggugcugggaauuuaaaccugaguccucuggaagaaugaccagugcucuuaaccacugagccaucucuccagcaccaaaauuuuauuuuauauuuuaaauuuuuauuuauuuucuguauaaaaguacucuaucugcauguauagcuggaugccagaaaagggcaucagaucccauuguggaugguugugagcuaccaacugaacucaggaccucuggaagagcugccagugcuauuaacugcggagccaucucucuagcauccuuuaaacacaguuuugaaggucugugcuaugguuuggaugggaaauucccucucagguucauauguugaagcuauguuugcaagggguggcuccauuauggaguucauggaaccuugggagguggggucuagcugaaggaagugagucacugggggagggccuuaagguccugcuucccuucccauuucuguuugcuauccagcucuggaugccacagccauaagccaauccugaagucacuaugggcuguauuuccccagacuucucuuaaguugcuugucaaacaguuagucguaguaguaguaguagcaauaguaguaauacagauaauucauuaagcuagauauaaugagaaaacuuucauuuaugaauaacagagcuagaaugauagauagcucagcaguuaagagaacuagcuacacuuucagaggacccagguucaauucccaggacccacauggugggccacaaccuucuuuaacuccauuuccagggaauccugacgcucacuuccaagcucuaagggcaucagguaaacaugcacugauauccauguaggcaaaaaacucacacacauaaaauaaaaauaaaaauaaaugaaucuuuuuuuuuccauuuuuuauuagguauuuagcucauuuacauuuccaaugcuauaccaaaagucccccauacccacccacccccacuccccuacccacccacucccccuuuuuggcccuggcguuccccuguacuggggcauaugaaucuuuuaaaaauguuaugaaucaagaccgucacagagguuaaaucaaguggaaugucucaccugcaucaagacacaaaaacaggcugcacuuacuucucaaugaugacguuugcugcacagccuuguccaagguuuucuaugaagguuuggacauccugaauaagucuuuaaaaugugaggagaaaaagaaaacaggcucaacaaauuaaauccccaaaguuaaugcuacagccugguugaaugcucaacacacauguaaccucacccaugcauggcaagcagacuguggcauuuuuaccucugaucgcgccuaaacacuguuccaaacacgcaagccuccaggacaaguucacuguaauccuuagcacuggagaaugaccccugggacacgccggaagcagccacuagccaugacuggcagcagugacguaucagaauauugaagacaccugauuuuauggaggacauuucaaucaucuugcacauaaucugaaacgagacacaacacucagguuaaccuuugaccaggucaguuauaaagaacuuaacagcauaaugauaauuaaaaucagcaguaaaugacuaaaauuagugccaggcagugguggcgcacaccuuuaaucccagcacuugggaggcagaggcaggcagauuuaugaguuugaggccagccuggucuacaaagugaguuccaggacagccagggcuacacagagaaacccugucucgaaaaacaaaacaaaacaaacaaacaaacaaacaaaaagacuaaaauuaacagcauaauaguuuugcuacaaaguagcgcuuucagaugauggauccuggauccuaaagauucccagccugggaugauugaucuugacagauuuuugaaucaaugaggagacaggugucucuaagugccuacggggguguuuccagauauccauucugaaugugauggcgcauucugcagccuggggccugcacugaauagaaagaagacagugagcugagcaccagcauccaucuucguuuccugacuguagaugcacugugacagaugccccgugcuccugcugcccccgauagacuguguccccaaaccaaaaacccucuccuuccuucucauaggacugagaggaguaacucacagccugcccccaaacccugugcaucaaaugcaaaauacaucagcucuccaugucagucuacaaaagguccagcauuccuggcugauucauucauccagaacucuccaggagagacaucugccagagacucaggaggaggaggcagccccucccugcaaaacuaggacuucagugcuccaggaguggacagaagggcgggaggggcaucaaggaccacaaacaggaaccagaagcaagcagaaacuccagcaggacagaauuccauuggggcauccucccuucugaaggaauggcuacaaauauaaguucagcaucucucauagcccuggggacccuggggacaucucuagaaugucccuggagagcaaaaucuacagaggcuucaagcccuguucauauaaaacaacguagagccuccacguaggaacaucauagcuacuuuagauaagacugcaacccaggcucauggcugcagcugaccuaggacagcuacccauaucucaacaugucuacagacaaugaugucauguuguaguaaccaaaggcugucagucugcuccuaguaauuucuggauugcugacaacaucuaauacaguagaaauaguuguuauauuuuuauaaauagcaaaaagucuguauuuguucaguacugaugcaaauuuuuuuucaaauauucuuuuuuaaaauguuaucuaaaaaauccucacauccauuuauuuugggaggagcauacaaacggcacagcgcacauauggggagcagaggauaacauuugggagcugcucucgacuuugaccacaggaggggaauccaacucugguuuuuacgcucaguggcaacugucuuuacacacucagccaucucucuggccaucuggccuucaaauaucccuaauuauuggcugaaucuguaaaugguaaagugugaagccucaaauucagugggcuguccauacgcccagaaaagaguuuaaaauccuauauuucucuacauaagaauuuuaaaaaugauaguucaaggauaaaaggugccagccaugugccugcugucucugucagugucaaagcauucccucagcucagcaccaagcucaugccacccugcaggagggacaguguuuccaggccacccaauucuuagagauggagagcuaggccuccugagucccaccccacaccccuuuuuaaagauuuauuuguuauaucuaaguacaccguagcugucuucagacacaccagaagagggugucagaucuuauuaugggugguugugagccacaaugugguggcugggauuugaacucaggaccuuugggagaacagucagugcucuuaaccgcugagccaucucucuaguccccaaguucccaaacaacucgccaaaugagucggguuuuuuuguuguuguuguuguuuuguuuuguuuuguuguuuauuguuuugagaugaggucucacuauguguagcucuggccuagaacucacuauguagaagacaagacuggccuggaacucagagauccacagccucugccuccugaguguuaaaauuaaaggcaugugccuccacaccuguuugugacuaaagaucuuaaauacuguuugaaaaugauggaaagccgagaucuggguguucaguguccccacagcucagauguucugacuccuuugcccaucugguggugauauuuugagagguggcaccucugacgaguacaaagugguccugcuuuggucugcucucuuccuccugaugcaccagcgugucaggagccacugcuucccucuccguccacuacagauggggcagccacacugcuucccugucaugauagacucuaaacucuaaaacugugagccaaagccaaucucuacucugguccuauuggccuucuugucacagcagcaggggagguggccccaucugagccuccugucccuaucaccagaguuccucaccucaugcaaacacacgucugggaacaaaggcagcagcccuaguacuugguuacagacgcacuucuucuuuuguccuacugaccacacaaaccucaaagagaaaaguuaccucuuuuauuuugaaguacaccuggcccuugaguuuugcagcaaugguaagaaucucauggucgaaaacaaagugaacaaaagccuuuaaauuaggccagaacgucagcuguguguugcucaaggaagauauaauuuuccaagccacgucaaaggacucuaugcagagggucuccucggaggucaggagcugguagcaggggguagaaacacagugucaaucuccaccgcaacacuguugccuuaucguugcccaucucacccuuccuuccuccaucucaccuugggaacuagcaccuccaugcagcggaacacaggcaagaugcggccagcagggaggacggugaggacguccagcgcugccugcagggccugcacaggugucucagcaguagggagaaagcccuccagcacgucacuuuccgugcuuggaaugaggugguggugcuuucucagcaggaaggagaggcagacccacugaucauguagauacugugcaacuacuuucccccauccuuuggaagacaaugauucuucaaagacacugaaaagaucaaaacacaagauacuaaggcucaguuucccaacuugacuucacuucuuuggcauauggggcugguucuuuaugagcaaauggacgggugguuugaaagaggucaggcucuugcaaauccacggacagaggcugggaggugggcggggggugggggggucuuccagcuuuucagucaggaguaaagcaccgcagagccucuccaggaccaggguagaugcugguaccacauucaucagcuuuucagucuccaaaaccguuaagugucucuuuauaagcugcuuggccucagauaaacuguuacaacagagaacugauugagacaaggcauacacccaucaccaucaagcggcgcagccacuaaauucugaagcaaucccacagaauuaauuuuugcaagguaguuccacaaccuugagagacuggcugaaaauuaagucagaaaggucggcagguuucugacaagggagacggacagccuuaauggugcccuuuccuccaaaacggggccucaucuccccaccuccacugcaccacaagcaccaucaggcaucuccaacaaccacgaugcagcaaacacuggauuguuguuaacccuuaacaaagacauuccucauucaccugccauucuccaggggacacacaccgaugcucugcuccucugaucggggcuucugcagcacg

SEQ ID NO: 4902 - RNA, 1989 nt, Mus musculus
gaagagccagcagaaugaggcugcccuggacacacugagccacuggcuuuacagggaagccugauugucacuggaagagggaaggcuguggggaaagugcagaaugcuugccuaaccagacccagaaggaccaggauccagagaucugcucuguuguaagcagacaauaaccugacaucauguuuagccuuauggaaagcuuaccuuucuaaaacaaaccacagacaaugaauucuacuuaaaaaggaagccaccaucguuauauaaagaugagcucucuggaaagcgagcauucagcugaaaguccuggucagagccaagccacacgugugccugacuucucuaaguagaggcagagacccaggucagugaaacaaagucaucaagaccugcucuagagcagcagccaggagccaaugaaccagggugaaaggaagcucccuuaccuugguccugcugggaccagucuccuggacucagcucaccgagugcagucccagacagguaccacugggacccugcauuggaagggaugucugugaaguuggcaaauuuauccaaggcgauccacuccucuccagugacacccgagagccgugggagcguguaaaauauggucugaaaagagaguuguaaaaucuauuauuuuccuuaaaaaauagagggggaaaaacaaagaagacaaaacaaacaaaaaaacccagguuuuauuaaugcuagugcuucucucaagccauccucaacuugcaggcucucaggccuguguaccucuguaguuaugcuucacucugcccugggacauucagagauucacuuagagacccccaagggcauguagggccucuccagcacuaacgacaugugacuacuauguucuuaucaagagcacaccaugcuucaaaggguguuguaacuaaagagaagcauauaccuaaaggcaguguccuggccaccagacacucaucccaugcccaguuacacugcagacaucccaaaccuguaacucacugugugacauggagugagcugugaaggcuuugucagcuuugguucaucauguguaugaagguggguaaaauggagccuauaaagccaccuucuguuccucccucuugaagaacucucaaccauggaaaggcaugugagagaaaaaaccccaaguaacaggcaacuuaaaagcaaaaugacacccacugcacaugcaagggugguuuuaaggcagauaugguuuguuucaugcuagccauauuugugcaaauuuaaacuggugucaugaugaacaguaaugguuaucagcugggccuccuaaguccagcugcaaacacuaaggcuuggugacagagucugauggcccaugagcucccggccuggcagucuacacacauagcucccacugcugcucgcccacucugccugguauugcugaggacaagaacagcagaaagcaaggcuggcaguggggagaggaagaagaaaggacucagagcuuggggucagccuuggaaaagguggauggggugcuagagagcccuuaggaagguagcagcagagugggcuguggagccgaggagcaccgacaaaguguucgauggugaaaaauccuacuaggucucaucuugagaagaaugauauugguagugugacagaaagcacuuguucacguguguguguguauguauuuguauguguguauauaugucuauguguguaaauguguguauauauguguguuuguguguguauguagcuaggcucccaauauaaacccccacagaggaaaagucacucgggucagguacucucccuucagaucuagguaggcagcacagugcuguaacuggagcugaaaaggguuuaagaaugccugguguucuaaauuuuaggaauuuacauucugaugucauguauuuuaacugcaauguguauguuggcaauuuuuaaaaauuuuuaaaauuacauaagcacucugcuacuuucagcaaagcgaag

SEQ ID NO: 4903 - RNA, 13274 nt, Mus musculus
agcuacaguguccucacaagcagggacugaauuaugacucguggaaauccccucuguaccaaggaaucagguagcuuucaaacucccaacaauuaauggcucuuuuggucaaaggagaacaugaggcagggaggcguuggaggaggggagagcagcaagcagcgcucugggucuccgaacaggcuguucaguuucuaguaaauuagaagggguggaugguggagguaccaguaauguuacccuguagaaugcggucuccuuugacgucagugagaugcuucucucccuuucuccuuuugcccuccuuccucucuccuuucccuuccugugucccucccuccucccaacaucuuuacacgucacagagucaugcugaaaacagcucugaguuuuacaacacagcuuccagacgcagaagauccccccacccccaccccccaccccacccugacaacacugcagggcagaaugcaggcuguagugggaggcagacaaaaaauaaaaauguucaugugacucaaagcaggaagcaggacacauugcugggaggaggcgucaccaccacaggcugugcauuccugccuugccuggccagguuagccauccccuccaagggagcauuccucuguggcaagaacacacacuggucucagacaauccugaaauagaaucuugacgagcaugcgcccugcucugaggccacucagccugguguccuggcucccccugucucuucccaggagauguguucuccacacaucaaacaguagcagcugcccccuugucagaacggagcuagugaaaauagcauugcaaggcuggccaagcacucuagauccagaccagaaaugcugcuguuuuuauuuaaauugcaccugcauauacccacacacauacauaaugcaugugugcauacacagguucaugcacauaugcacaugcacgauuacacaugcacucacauggacacacaugcaugacugcuuccacagagcaugcuguggguauuagaggggguugcuuucuggguggcuagucucaaaaagucuacuuguuucuggaguaaaaggacucuaguuuucugggguuuuuguuuuuuguuucccucaggcagcuuuuuuugcagcugguuuguauaugcauuugguuuguauaugcauuauauauaugaauaugaugugacucuuugaagaaagaaucauauauaauaugaagguagaacugggucuauaugggaaaggagaacuuaaaggagguggggggagaggaggugggggagaggagauggggagggaagucaggaaagggaagggagugggagaggggugagggaggggaaugagggaagaaagauaaaaugucauaugucuucucucauguauggaacuagauuuagcuauauucacauauauaaauggcauaaaagcggcaagucuuagaggaaagggagagggggacaaugagugaguaguggaggaaggaugggggaggauaauaaggaaacaaauacaaaguauauggaugaaaaugucaucaugugaaauccauuauuuuauauacuaaaaaaauacuucaaugaauuaaaaauaaauaaauaguuuuuaugggauaagaccuugaccccaaggcuuuguccuaauaggcaccaaugaggccccagaugggguuggguguaaaagcagagagcaagcgugaauauccugcuggccccaccauccucugcucuagaaagcaaggguaucaggaggcuucagaacagggagcauuuuguaagccagugucccaaacagucuuacaggcaugaggucaugggggaaaacacauacacagaaagaagagaaauuuuggaaucuauuccaaaauuagagggggaagauaaugaaaugugugugcaugcacccucagucuggggaaccagagacuguaugaaauugccaugagcagauaaagccauucaguaagagacggaguccaacucaccgcaaagauauauuuaacaugcguagauggauggaugggcagcugaacaaagagaaugaauuguuuuagaaaacaaagaugguaaacaggacucaaagcuuuugggaggggcugggcagguuugggaaauaacagugugugaguuaacaaugaagaacauucuaaccccauacccggggguggauggaagugggugugucuaaccaaaggcaaauccgugugccuuccaugggaacagugggccuuuaugugguccuguguaccggaguccugccucuccugucaugacacccauuggcuauuguugagagggggugacuacccuucugcuuaccuacaaugcaaacguuccaagaggccuguaggaggcugaacucugacacagggaguuaaagccagcuuccucacucuucuucucucuuccucaccuggaaaaugaaggcacagaaggaaguuaggauggaaagaaaugguggccaccugcauguaaccuuccaguacugcuugagagcucugagucccgggggcacacacuaagggcuggacugacagcaagggaguaggcaucuuggcugggaacagccugcuaaaggcucucacuucuucacuguauccucacggggacuucuuccucacaggagaccuaccuaacuguuuuggggucacugcagaggugcuucacacaguggggcuccuuuauguccuuucaaaugcaucuauuguauggcaguuuucucuaaaccaagccacucuaucucagaggagaguuaagauuccgaaaguaaaaugaagcuuucaaggcuccagaaaaaaaaaaaaaaaaaaaaaaacaagaaaaagacaacaacaacaacucacaaaucucaugaaguuccuaagacuuacaagauacacaaugcuucucccaaaggcuauaugagcagaaacauuuacuggggagaagagacuuucccaccagucaagcugccuucaagugguaugggaagcuccagagauagagcuucugggaaucauugcacauacuggaaugggacuucuagugcuacagcuuccuuugagucauccaggagccuagaaguaacacuuccaucacccuugcucauugauugcuucaucgaguuggacuucaggggaauuguuacucuggucugucacugguacucuaccaaggaugaauuuuuuucauaucuuauuagcauaacauguuaaugucuugauccacagaugugcacaaggcagcauguuccugccauggcacaugcucucaacucaagucucauguuagacauuuuccugagaaagguagugauugagaugagggcccagugagggacccaagcggagauccugcauggacagcauuuuccucagaucacaaggaaagaaggagccugauccuucccccauccuaugccgcucaacagacugacucuaccaaccuaccugucccaauaagaacauugacucuuagcaggaauuccaccaugagcuucauggguaugcuauuucccgaauaaggggauggacacauagcugcuggcagguguucaaguaaaggcuucacaaagaugucagauaacagcacaggggccagucuguguauuugugguaugaguaaaggugauaagcagauguuguccugguuaccugaccuggcuugucccacucaugcaggaccacggcuuccagugucccugcaaagcaggaccaauggcagcccacacaugcagagcuauauggugaugauccuggauggauagacuuaggaugcuaagcuuguccucuguccacugagggugaucacagcucauguaacacauggagagcucuuggagccuuugcaauguagggcuuggagaagacccuaaauaacuggaguccauuuuuauugcuauuacugaggucccugugguuuggccuugaguaacuaaugauauucgcugagaagauuuuuaugagccaagcauacuacauaugugcugucuaccuacguugaccugaaagguggguauugaguucuccauuucgcaaacggagaaucugaagcucgaagcagguaaauggcaugcccuacgucacacagacagcuagugaugaagggacagcucauauuaagguuaagacaaguuuucuuccuaagaaggcaggccaacaaaggcagaggaaggcauguauuucaggaaagcacagagugacuaugccaaaggcuauccuucccuccucucgacucguguuuguguguguguguguguguguguguguguucaccuucagccuggaacagcacuuuuggcaggcucacucaucuaccacauucaacguccacauucaaaacugaucuaccaaaaugcucuuuucucaaaggaugugaugauacaucauuaccacccagcacucaagagauagaaguaaauggaucucuauaaguucaagggcaacguggucuacauagagaguuccaggccaggauaggacauaaaccagggucagucuggucaugagcacggugauuaaugugguaagucacuucaaaaaaauaauaaaauaauaaaauuaaauuaaauuaaaaaaaaaaaagcucaacaaccaaccaaguccauuggaaagaagcaucggauaucugggugaugacaaauuaguuuuggaucaucaccaagagaaaucaaggggcuagggaggguauucaacugauaaaguaacugccuugcauauuuaaggaucugaguuugacucccagagucuucauuugaaaagccaaguguggcaugcuugcauucccaaugcuaaggaggcagauacuggcuaggccaucuugccuauuugaugaguuccaaaccaaugagggaugcuaucuuaacaacaacaacaacaacaacaacaacaacaacaaagugggggaggggaaagguagagagaaccugaagaaaucagccaaaguuguccucugcccuguguaugcacaccaacauacgaaugcacacaugcacaugaagaagaaagcaaggagggaggagggagaaagagagagaagaaggaaagaagaaaggagggagugaagggagacaggaaaucaggaagugacaugcuucccugaagcaggauucgugucucuccuuuaucugaggaaaagcugacaagcccaaagucuccacugaacagaaagaagucagcccagauggaccuccagcaaccacaauugaacugcaauaaaaauggccuucagggaguggggugaccaauggugcuuccaauggagacuccuuguugcuuucccuucuuggcaaagucgugucuguggaagccagugucuuagaacccaaacaccaucauuacagcagaccaaacuucccaucagaaaaucagcugugaaucacacauaagcaacuaagccaccggagggaagcgagagcaugaggguuguguuuacugguaguugaaaccuagcaaacggggaacauuuucugauuacugcucauguucccaaacaucaccucccagaccauugcuagggcucucucucaggaaggcuccugcacuuuaguguuuacaggaaccuggcacuuagcaacuggcaaguggguugucuuuaaggcugagucaugucaaacaaagccuuucagcuaagggucacuuaccugagcccucaucggcuagaguggaagucaacgucucuauugccucaguggcuggagcagaauaaucauugacucacuggagagugugcucaugguguggguucccuucagucauccaacggaccaguuucccaagucaagccuagaaacaaagaggaggggaucugaaagcauguggugcuaaguugugucucucucggccucuagaaagugcagcuacagaacuagaggaggccagugaagaggugaaaccaggagccaaguaugcccuaccugggaagauccuaacaagauagcuugccuugacuaaagcaggugcuggcaucacaccaggccugcucaacaggugucuaaauaucagacacacaccaaagggguacccagaaccagacagcuaacauagccuaucaucuggauuaaguggcaaagacccagcugccaaccaguagaggugggguuccugagcucugagcauaaggaagacuugccgagaaucuugaagcuuaggguauuugggagucucugauacuaauguauuuauucucaggaaaagggcaggagagagugggaggaagaggcaagagcaaaggcuacaguagaggcagccagagaaagauacuggcagagcccaugugccgaaguacguggugaugucgugacauuagcugggugggcuacagagcaugcccagaguauguauauuuauucaaauacagcaaagacaggggaagcucggugacaccaaugguaaaugaagaagugguaccaggaccugaagaacaucaugcuuaguuggagggaaagggaucauaugcaccccuaucaugcacacugaggcugcuuagagcccagcuggcaggccugccccuuuagggacacagaacuacacgagacagaauuucuuagucaacagagcacccaggaucucaguucccuuuaaaaaucaaugagcuaagcuagugucguagaagaagcggcugaggagauaacaucaugacugaggggugugaugaaacugucugggguccaggguuguagagagugcagucaggauacccguagucuuaaguuguguucgcagagauggcccugagaugacgugaguucagguucccauacagagacuggagucaaacaggaaagggcaaacucauggcccaaggaguugucugguuauggccuuuccgugcacacugugccagacgcagcacggugcagccuuccagggaacauaacacucggccacuccaagggccgugcauaucgucugugcacauguaccuguguguaugcaagcuaaggagcuugaggggagaagacggcaaagcuuccaacuguguuaaagaguucccaucuuauuccagagcuucuguggggugccuucuguggagagcccuggguuucauuucccacccauccccuaguuucugcuuccugucggggguagagugagaagcagcuaacaaagaaggggcuccagaggagagaucagaaaagggaaggcagguuccuguuccucuuuccuugugcuccuuugcuuuugucuccgaaugcucugcaacaccugacaccugguaugugaugaacaacccguugagauauggugccuugaacuccucucucucucucucucucucucucucucucucucucucucucucucucucuaaguauugauuguaucuguguguguguguguguguguguguguguguguauggauauguuuucgguuagugugguguggugugguguggugugguguggugugguguggguaggucuguguauguguguauaugugugguguguguaugaugugucugucuaugucuguacuauauguguguguaugaauguauguguaugaguguguguauggauguguuuguaguuaaugugguguggugugguguguauguguguguguguguuugcaugugugugguaugugcaugugucuaucuguauauauuuguaucuguaugugugugugugaaguguguauauacuuguguguauauauuuguguauguguguguguauguguguauaugugugugagagugguugguauggugugggugugucucuguguguacauaugugugaugugugcauguguaugucucuguguguguauguguguguguguguaucuguguguguacauaaguguagguucccaaaaaagugucagacccuccaaagcugaaguuacaggcuacugugagcaaccugucauuggugcugagaacugaacuuggauccucugcaagaggcuucauugcccuuagcugccaagccauguuugcaacccgaccugcucagccucuucucacaaagcagcagauggauuucgugaggucucccugcaacaagcuuuuaccucgaucuccuucuaagacccagugaggccacaccaugaggucagagcucucacccucacaaaaggaaaguaggaagacaaauucucagucaagggcaaucgagacaaaaggagcggcagcaaggagagaaaugacagcuagagaaggagucaaucaaugacaagcuggaugggucaguccugaaaggcucagagcugccuccagggcagagagcucagcaaacagcacacagaagcuggguauagcagugcacacuugugaucucagcacugagcugaaggucagccagccuuggcuacuuaguguguuugaggccagccugagcuaugugagcucuuguucacauaccccaauaaagacacacacacacacacacacacaccauggcuucccugcugcucaaagccacagagcagaaccgaaaucucccacaagccucauggcagguacccauguaggccgagcugccagccacaggccacacgcagcugcugugguugacagcacagcuccaucccuggcauguugucaccuccugaaacaagagugaaagucaccgcauccucagcuccauccuugaagcagccucugaaccacgcccccaaacuguggccccucgugcagaaggcccaugagggaacagaaagucugaugccugucagucacuccagcacccaggugcagcucuucaagcuacagauaaccgugugacaucacccagcuguuauuaucagcacugugaguguuuacuucaucuucaaagagaguuccagacugguaucuagugacuaaguggaggucagagauccucugacaucagucaugcccagaagggacaagcccaguugccagcucucggugaccaugugcaaacuuugagcuccuuccugcccagugccucucccaggcuccauacaugcccuggccaugaggcugucccugauggcugccagucacauagacacgugggugucaccuucuauuguuuuccagagcauucucucuggaguccaaacauugccacauugccacuguugacaccaccucuuagagagccugcccuuuaugacccaacacaagacacaaaaggcaucagacugguauuuccuuuaccccauagggauuuuuuaugggguuuuuauuugguuucguuuuuggugugcuucugagaauuguccuuuuguucuuccguuugguugcaaagagcacucuccaaggaauucugcucaaaaaaaaaaaaaaaaaaaaaaaaucacacagcuuuuuaccugaagcuuguaucuccagaaggagaccuucacccaccaccacauccucccaggaaauaacagcuuaaaggacagaugaacccgccauggggcccuacuccucgcugcuaggcucuggguaaggugagcaggggcagaaaggcugcaucuucaugcugggacucaggaagagccucauugucugucuuaggcaaggaccugcucaucacacagcccagaugugagcaguuauuagaucaacacuccccauaccaccaccauggaggaaccacugacauuuaccuggcccuagcaaaggccaccaaggccaugucugggacuuugaacuuucagucacucccuagugaggccgugcguaguaucgaaagccaccaucuuuuacguugucuaccgagguagaggaaguuucucaaagacaagcgauuggaaucagaguucagaggaagcuggcgugagagcaaggggagccccuggccugccuaucgcuguaccagaagcuccaacugccucaacucacagcauucuuacuugcagcuacauagccccaccaacauugcuaggcugagcaggaccaaccgaccaucugccuggucaugcaaugugcaagaaaaaauaagaagaaugugcuggaaggucagagcgcuaaccaucuaaggcgaugauggguaggcgccaaggcccagggacauagaaguguucuguaaaggagucccaagucuccauugggugaguaaucucaucucugagcacaaggaaugcucuuagaacagguuguaccugacccgccacagucagcucugcacuguccguggaaauuccugguaugaccauccuaaccauguguucgucuuccuaguacugcaucaccaaccuaaggauugacugaagcccagggagaugaccucacuacccaucaccagaagagacucucaaacccagcugccccuucagagcugacuccuggcauaaggaugcccugaucugggcacagccccagaaaccuaucccuggacucuguccguugaccacaggaagagcuccaguugagucaaaggggagucuggcuagugguagggcugcaggauccagcuuaauccccuuacucaucuaaaaggucacugaaggggcagcggccuuaaggggcagaucaucaguguugacuacaaguucaaagaauccacagaaagccacacagugcccccuggcuccaaccucagaaauggagccgacccugacucagagaggaaacaaaggcugacucacucacccuccacuuccuccuuuugcccagcucagccaagaccagcacuggcuuccagcgacagacaggugaccacuacuugcaaaccugcaagggggagcacaggcucacucugccaaggaccaccagaccucgauuuacuacugcccucacccucuguaucuuccacacagugcauggcugguaauggcgcuguccugucuuguccugccuugaccuuggcuguguuauucuucacuucccuguucagcgcacagccacacuuuccaaacaucaugaaucaucaguacagagcaacggccacuuaguaaagcaggaaaccacugcacgccaggccuggacagagcaguucccugcucuggccucuccuguccccugaucacugugacacaaagccacaguggaggucccagggacuauugcaccacuggguauucaaccccuacaccaucagcccuuauacugggcaggaucuuccuagcugagccuucccugccugagcuggcuaaagugaagcugguaucuuccagucucagagggagggaaagaggucaggucauucaaaacccuggcuguuagaaagacuguauccgguagacagcagagccaucaaacagacauggggcuuccucuugcagccuugcaguuaugaacaaagguugccucugucaucaaagccccugcagacuagacccccucugaauaacaugcagcaaguucccaaagaauggacaccaaugaagcccauacaucaaucaacaacagggacugaugaaauggcuuaguguuaacaaacuuggggauccaaguucuaauccccagagcccacauaagaaguaagugaagcacagcucccgguucuggggagacacacugggagagucugugcuugcugacaucugcucucuccaaucugugagcucaagugcagugagagacccugucucaaaagguaagguggagaggugacugaagacaccacccauguggagccaugucuucccuguauguaugcacacauaaucauguuaaaaaaugaagacagcaugaacaugaaguuucucugacaggucaugucuauccaagaugaccucuugugcucucugucccauggucuagacuuugauuauuuuucugaguuccauggaggaaucacacauggcuacauucucuuaaggagccuccauucggugacagcuggauggaucaggacagaugaccagggucaaggguagagacaggcauggcagaccuuccuccucaaauaccaaauauccaauauaguaaucaaaucccagaucgcagacauuauggaauuaacuaaauuagccgcugcagaccaugguucuggauagccaaacagauccaagugucuuaaaaauauauaaaucacaauguucuagcccuucacauccggaaacacauuuuagacccuuggagauaauagaaguaucgccugaaaacaaaacaaaacaaccuguuucuagagcuggagaaagaguucaguggcuaagaguacuggcugcucauagaagacccaaaucugguucucaagaccuacagagaggcucacaagcaucuacaaccccgguuccacggagucuucuucucaccuccacaggugcccagcaugcacauggugcacauacacauauguagacaaaaaacucauacacauaagcuaaaaauaaauuuuuuaaaaauccugauaucucaucagacaucugggagaaccaagguccagaugacuucccgaaggucacacaagguaaagcagagccaagagagcucacagccucuggcugguaacuuaagguuguuuuuauuuaucauaacugucauugcagugggugaauaaucuaggagccaaaucagauguccuucacacccucugaagcuacucuuaggaugagccagaauguucugcaucaacccacgcaugugagaggaucuaccaaguuaccugauaucagguauaguuaccugauaccuuagucagaaggucaucaacuucuucaacagaaguuaugcauuuaggugccaccauauuuucaaaggaguccuuuacacagaaaaaaaaaaaaagacucaaugaauuagaaaauggcugucacauuucuuuuuaagaucuagagagcaaauuuggaagaggguuaauuuugugugccuagucugugccagcuacucgauuucauccuuguacuguaaaaacaguauugaauguacaccagcagacacaguguguaccaauaaaacuuuaucaacaacguauuauaaacacucagucuagcucaggcaauguuugggccugaaccuaaaucucugauuggcuuccuucccaucaccucagauucugcagauaucagggaaugaaccaucaccgugucccugcugcuguagauccagcccucaacugagaacaaccaaggacaagaagcacaagaaagaauuuguuucacuuuuccauuaaacaugaugaguucuuugaauuucuaauuggaaacuuucacacaucgcuugagguugcugcaacucacuuccugccacccuuugacuguguaucuugagcaaaacugugguaaaggccaaggcugcccuuuggccucuggugguugucuggagugcacugcccugacucacggguacucagacagcuacugcaacauucuucacccccuucucauaaagcucugacugcuuucauagccggggccuaaacuaagaacucaaaaccaaacgg

SEQ ID NO: 4904 - RNA, 15260 nt, Mus musculus
ucccgcgcaggcaccgccgcggacagcccgccgcggaccuucccccgggguccucgcgcgccggaaguccucgcgcucggccuuuuccgucuggacuggaggcaggcggcugcgagcggccggcgugcuccgaucggucggagcuaaccgcugccaggcgggcugccgcggcccggcguacgccccagucgagcgaagauggugggccggaacagcgccaucgccgcgggcgugugcggugcccucuucaucggguacugcaucuacuucgaccgcaaaaggcggagugaccccaacuucaagaacaggcuucgagaacgugagugggccccgcgcgcccccgagugcuccccggcgucgcgcucuugcggccagggucccgccugugcccgcgggccuccaucuuggaggcgaccuggcuccaucuugcuggcgguggaaugcaugcugauucgggggagggguagcacuuuuuugccuuuccccagcucuguaauucugggggauggggggugggagacaggucuuuagcucagguuaaggugguuauccuccaguuucaaggucucaccacgcccagcuccauucccccccacucaacuuguguugaagacaggguccuccuguguagcucaggcuguaacccgcgcuagccucgaccucguggcagccagcaccaccaccaccuccccagccccccgcuucaaccuagugcugugauaacaggcacgagccuuucucuauaacagucaccguugaaaacaaucauucuuuauguguguuuacgacaggggacugcugcaguugguaggucggcuucgaacucuuggugccucucauugcuagcuuuucagacgggugccuaccccgaaggcgguggugcucuauucagcaaacccgucgacggugcugccccagcacuagcacaguggggugucguccuugcauucuuaaacccucuuggcagcuuugcucuggugcuuccaagauaugagugaaugcuagacaaagugcgggggaguccaaagggcugcgcuccucacguggcucagucuuauuucauaccugcgacaucuucaaagaguuuuaccggagggaaaucuuggcacgccuugggaagucauggacaugugauccacccaugaauuuacagagacucuuuauuuuucaauauauagucugaaagcacauuuguuggaauaaucuggccuuuuuuguuucgcuuucuugggggcugcagucagucaguuacuccauucucucgaauuucuaaaugaguuuuuuaauuuuucguaguuauauauggucggagacuaaugaauuagacguacauccuuuaauacucauuauaggacuuccaggacuuuuugagcccguaggccccaaguagccucaucguuuucuucacguggggagauaaggagaguguguuuuuguccgauggcuagguagaguaaugcgaagaaugcaucuuggauuuauagacugcguuuuggggaccagauugcguacugaccagcagcauucacuaaaaaucuccuuaacuguaaaguacggugguacaagcugccucuuguugguuaggugggauaaguacuugaccuacggaaggcuccauaaaugcggacuguuaagugugacuuuuggguccacaagucuacucagugucuuggggcugugggucuacacauugggagacagcuaagcaggcugauugauuccuuuggaaagccuugguggaaaucuugagaaagugguuuugguugaagaaauaaguuguuucaggaaaauuaugguuguuuaaaacuuuugaagccgggcguguuggugcacgccuuuaaucucagcacucgggaggcagaggcaggcagauuucugaguuugaggccagccugggcuacaaauugaguuccaggacagacagggcuacccugucuccaaaacaaaaacuuuugaggcaagcucacucugcagaccugucuagccuggaacucagagauaaaccugcuucagccucccaaaugguaggauuaaaggcgcggcaauaacgcccugcaaggguguucuuuucaaaaucaucuuugcaguauuaacuuuuuugcccuucccgugauugaauccauggccuucugcagccuaggccuuccgccucugcuccucccuguggcuuucugugcuagacugcuuguuuucuccgcuugccuuuagucagaaccaguugauuucagugacuuacugacugcagcagugacaagaaggcagagggaagccacacuucagaaguccuugguacuguugcugaucgguaauuagugaaugcuacaagguugguuuguuuuggcaaauuuuugcuaccaaguagcaguaaauucacaagucucuaaacuauguaguugggugauucuuaagaauuugaauaauaugaauuuaauuuuuuugauguacauguacaucugcaaugaaaggaugguguucuaagucgguuugccuuuuaaugaaaagggacuuaaauuuaggauuugaaauuagaugucuuuuuuuuuuuuuuaaagauuuauuuauuauauguaaguacacuguagcugucuucagacacuccagaagagggagucagaucucguuacggaugguugugagccaccaugugguugcugggauuugaacucuggaccuucagaagagcagucgggugcucuuacccacugagccaucucaccagcccgaaauuagaugucuuaauucagauugacuucauuacccccaccccaccuccguugguguuaaggcuugaucugagguuucuaaauacuguucccacccuaggugcgccucauuuauacugcacacugugaaggauacuucacuuaggaauucacuaaauaugugauuuguuuuaaauaauggcuugcuuggauuuggagugguucugaauuuaggcuuugcaugcuuuuguuuugagacaccaucucuaauccuggcuguucuugaacucagagauuccccuuguccugugcugagauuaaaggcauucaccuggcuuacaguuuggcuuuguuuuuuguuuaaugaauauaguuguuuaaacuugguagauuuacaagugucucaggcuuauaucaacacauaacuauccuugcuaauugaaugugugacucuuucagccuguuuaccauugugacuuuauuacagagguagucuuaugaaacugaaggcagaacucuagucauccuguuaaaaaugaaacacauuaaggaucuuaucuuuaucuucuauguccauguccugcauuggguagaugguuguggaaauaaaguucauugccuuuuuauuauuuucucaaaauucugguuuagcauauuguauuuuucauuccuuauuacccaguuuugcuuugugaggugguuuucauccgcaugcugugucuuuggugauacagguaaaggaagacaagguggucuggagucaagcgcuugaguaacugcucaucacuuacguuuuaggucuuagccaacagguccuucaguuccaguugacucagauucauagacuacuuuaagguuuucagagauguuuugcuugguugauggcuuuugcuuuucuuggcaagacugaucuuggagaguuaaguucucuugcuuacaauuugccuaucuagugcauagagaaaaugccugucacuuguaccaccuggcuguugucuaggucauuguauugaguaauuguuacucucuagguauuggguauuuaacgauaggaugccagaauggcaggauaugagccuagguucucguaccacauguuuuacaucuguuaauuccaaggcugcuggaagccucauaauuacagauacuagaugaguuacuggaugaguuuuauugaguaccagguucacucugguguaaguguaaggcacugaauauaaaccuggcagugauccccauaagcuaacaauucuuucuuagggcauacuguugcagagcaccgaagccauuguuaacuaaccagcccguaguuaacaauuucgggauggggcucaaccucuugcccuucucuuuuggucaaauguguaaauacuguugggacuaguagccugccuguaacccugcacuugggagcugaagcuguaggagccucaguguuguaagccugagugugucacagagcuugucaaucaaaugucuuacuuuuacugaaccauuuggcuuaagaagggauagauugccgggcagugguggcgcacgccuuuaaucccagcacuugggaggcagaggcaggcggauuucugaggccagccuggucuacaaagugaguuacaggacagccagggcuacagagaaacccugucucgaaaaaccaaaaaaaaaggggggggauaguuuuuuuguuuuguuuuguuuuuuuuuaauaguaaagcuggaaucuguauauuucaguaauaauggcuuaauuauuuuauuuagaaagggggcuuuguucugcugcugcacagcuguugggacagucucugucuucugaauuguuggaccuggggaugcagaagaaaagagaaagauccuaccuagaaacaccaguucacucgccagggaggcagggauucuggaggcaggaacguuuuguagaauuaaugaugguugcagcaauuagaugucuugauccuuaaugaugauagccaaguuuuuaauuuauuuuucuuguaggaagaaagaaacagaagcuugcuaaggagagagcugggcuuuccaagguaaugaaaauagucuuguguuuuugcguguagauugcaugcucucuaagccuccuguguuuuccuuugguggugguaagagcaaauauguuaauuggguaagcagcaagaugagagucuccagagauggacaugaagaguuaaaguucucggcuacuuaaaaaugguuuuaaaaaauacagcauuugauuggauuuuccuuucuuccuuccgacaguaaccuuuaauccuaguuugagaagcucuguuagaggcagccugggcagcacaguagcaaaagaaccacguguguuagucccacagaucuuuaagguuuuuacaccuauggaucagaauuauaucagguucugacauuuaaaaaaacaaauuguaauuuguagaauauaaauuuucauuuuuuucuuuucauagguccuuaguuuacaauuuuuaaugacuguagguuuuuaucuacuuaauuaaaaauauucaacuuucucucuugcugacacucuggauuuauagaugaaguauuggaucacuaauaguucuuuuagaagcacacucaggcaagcaaaaaugguguugauaaaugcuacacuuuuuugauauuuugagccaguugagugaugagcauagcuggcgggauacgugugguucuagugaacugaagcugggaccacuuguuuuuuccaguguguccagacugccuuuccaccaugugggauaugaugaggagacaacuuaggaucucuguaugugugagucugacaggaaguguguauuauuuagaauuuuagagguagaaagggaguuugugugugcuaggcaaacuuuguaccucuaagcuguacccaggccagccuauaagaucccugcaaaaagaggacuggugaucuagcuuagugguagagcgcuuuucuaguaugcaaggggcccuagguucaaucccaagcaccacccauaaaaguuuuacaucugugugaaauauuguuaaaagagugaauggaugauaguuuaauaguuuauaauggcaacaaaauagcauuguauagaugauagagagguauagguaauauuauaaaggccuguauagauguauaaacuacagauauuuguaugcuuuagcuuucucuagguuuucuugauuuaggagguuugcuccuagaaugaacucauuuuauuuuuagugguuuucuguacgcugcuguauccucagcuuaauuucuguauguuucguuuccaguuaccugauuuaaaagaugcugaagcaguucagaaauucuuccuugaagagauacagcuuggugaagaguuacuagcacaagguaauugucauuucaggauaaacacucaagguggguuuuggguucuuuaggcugaggcuggcuccagaaggaaacuggguugcuguugccaggcugugugauugaagugaguuuuacuuguucugacaucggauguggaggauagguaacauuugagugaaaucagaagaggacuuuauuuuugcagagaugacucucaagucagucaggguguuugggugucuccauagugcagaauaaauaguaacugaauacggcugagccugccagcccucaccuaguccagguuguuccaagguuguaggaaggaguggcuaauaagccuaaaaacaacguugauuugccuaaucagagucacaguauauuaggguucucuaaggaacaaaauucacagaacgaauucauagaacguuuguguaucugaaggauuuauuacaguagcuuuuuagugucugacuagucccaacaguggcuaucuccuaacugcuccuagagaucucgccuugacacuucccguugagcauugaaaucguaaagaagaauguuuuaauaccaucaaagggguggcuugggauagaugagcuugucagugagagugagggcaagcaagcagaaaagcacaacucucuucuuuuuguucuggguggccuccagaagguaaggccugaacuuggcucugaccuaaccaguccaaccaagaaaaauaccucacugauggacucagcugcuuggguguucaguuacuuuccaauguaaucaggguuacaaccaggauuaaccaccacaccagguauugauagcucuucagaucugguuuuuguuuuuguuuuuuggguuuuuuuuuuuuuuuuuuuuuuguuuuguuuguuuguuuuuuuuugguuuuucgagacaggguuucucuguguagcccuggcuguccugcaacucacucuagaccaggcuggccucgaacucagaaauccgccugccucugccucccgagugcugggauuaaaggcgugcgccaccacgcccggccuuguuuguuuuuuucaagacaggguuucucugugcagcccugccuguccuggaacucacucuguagaccaggcuggccucgaacucagaaaucgccugccucugccucccaaaugccgggauuaaaggugugcgccaccacgccuggcuagcucuucagaucugaucaguuaugugauccagauuuuagauaauuacuuugggccucauuuacuuguauugaaaggugauuuuguuuuauuuuuuguucuagaauugggcagcauuuuguuccauacaauagaauggucccauuguuuaguaguuuuuaaucucaaaaguaguuuugaaguuguugcuaucauuaauaaaauuggaauugugucucuggacagugguagcacauaccuuuaagcccagcacuugagggagaagcagguggauuucugaguucgaggccagcuagggcuacauagagaaacccuguuuggagaaacaaaacaaaaauuggcauuguguuauucuuggguuuuuuuccccucaguagauucagauggaguugaacuugauguauaauguguauuuauuuguguucuguuuguuuuaugaggaaaguuuauggucaacuuuacccuuuuaaaaauuaauuuugugggcuggaaaggugguucaaugguuggagcacuggcugcucuugaaaaggacccagggucaauucccagcagccaccugguggcucucagcugucuguaacuuuaguuauagggcauucagcauccuuacacagacaugaaugcaggcaaaacaucaaagcacauaaacuuuaaaaauuguaugugugaauugcuuaaguggagguuagagggaagucuugcaaauguuucucuuccaccuuuaugugagucuggggauugaaguaagguagccauccaccuugacuugcugagccaccucacugaugucccccccccccccauuuauuuuuauguuucuuuccgaagagaaaguuucucauugaguuuguucaguugauuucaucaagaguuggagguaguucuuauauucaaauaacuagcaaacuuuuaauuuccacgcuuuuccuagauuaagagcaauugagaagaacuaaucagaaaguguuaagugcuggaaauagauaccaucaggaagcuuuuccaagaugcccugcagagggccagccaggcauuguguguucucagaaccaguucaucagcacuguugguucagcagaaaagauggcuguugccagugcagguucagcagagaccuggcgucuucugcaucagugccuggcccucagggguugguucuucuguggccauccuaucuccuccguaccccaggaaaggagcuaggcauguaugucacaguaagggcugcccaaaaccagaugacagucagguggugucugauuuguauaaugggauuagacguaauucccacagugacagcagagauuuggcuauuucugaccaagcuugccaggcugugaaagcuguggaugcuggugccugucuuugcacagcugucaguugaagugugcucauuuccaugggugcaaagaaauucuguaccaaguuuuuacuuucuagugauuuggacuaggaccaauuacuuggugacaaaaucuugauggcuucagauaacaugcaguugugugugucugcaggugacuacgagaaggguguggaccaccugacaaaugccauugcuguguguggacagccucagcagcugcugcaaguguuacagcagacucuuccgccaccaguguuccagaugcuucugaccaagcuuccgaccauuagucagguaaggaggcgaagugcuucagggugacacgcgaguugauuacgaacuccaugcuuaggggcagguuugccgagcauggaguuggauaugccagucguguacuagccuaaggugagugcuugucagaugugagucagaaguguaggugcucuugucaacuuuacguuugaguccccaaauucggccugcucaggugcuuagguggccuggcagaggauacagaagucaagacugcacagccuggacuauccugagucagacucugucaggcuugguguugucugccauuuuuuccugcugugggcuuugaauuuugugcuguuugacuguaucaccauauuucuacuugaaaguucaaggugcauguuucaaaugaugaguguaguugagugugauagcccaugccuguaauuccaucacuccaggggcagagagaggacggugggucacuaagccagggcugcuuaaugaguucuugucucaaaacauaagguacaaauugacuaaacauucacuagagugaauucuuucugaggaguccaaaaugaaucucaagggcuacugcaucauauauaguuaagaauuagcaaagugaugguagcaaguaaguuuucauaaaacuuuuuaguaacuuguuaguuuuuuucucucaugguauucugucuuccuuguguuaggcuuuaccacugagccauguuccuagcuccguuauacucagcuagaaugcaagaggccuggggaaaaauuaaauuccccccaaagauuugaggaagacuuagaaaaacaagaauuugaaugaaauuuuuuuuuuuaagauuuauauauuauauacaggguguucugccugcauauaugcuugcaugccagaagagggcaccagaucuccuuacagaugguugugagccaccaugugguuucugggaguugaacucaaccucuggaagaacaaucagugcuuuaaccucugagcuaucucuccagcccaaacuaaaucuuucaaaguuagauuaaaaugguucaguucuguucaugccucaguugaugcuaugugcuguuaaagggauagcugacucugccuguacuguguugcuauaaucaaaauuccaggaaugaauaagaacagauuauuugccugcugugucuauaugugacuaggagucaccuggcugugugacaaaaucagaaaaagaaccagcaaugugcaaucaagagcugguaguuaguuguucagaaacugauccaguuggagaguggugcugucuuaggguuuuauugcugugaacagacaccauggccaaggcaacucuuaaauauuuaauuuggccuagcuuauagguucaguuauuauuaucaagaugggaacauggaaggacccaggcagacaugggcuggcuuucaggcagcuagcaugagggucuuaaaguccacacaguccgugacacacuuacuccaacaaggccacaccuccuaauagugccacucccugggccaagcacauacaaaccaucacuggcaccugagcuuccaguacagggaagcuuuguugagaacaaagcauguaagcuacacacagauuuugcuggauguuaauuuuggcaugccguauucccucugaugguugcaggcuggaaaggaaaauuaugaaguauagacagcuuuguaagggcucucauagaugaacagcauugugucauguguuugaauuuucauguggaacuaaacuuuguauggucauaccccucccucaccaccaccaccaaucugacccccucuccuuaugcucagcgucucuagugcugagguuugagguaugugucaccaugcccaccugaucucugucuucugagauaguaauaugaaguaugggaucuaugucaaaaugggggaauuuuauuuagcaagaauuguuucuuugaauaugaagagcaauuuaaguuaaaauuaagacacuucucaaaauuaauuuucuuuuucuuucagagaauuguaagugcucagagcuuggcugaagaugauguggaaugagccagauaccaacaagauaaaaucucaguaaaauaauuuaacaguuagcuuggaagcuggucagcucugggggauuaagggcaaauuaugcugucaugaacugucccacacugacgucugccaaagcgaauaugaacuuugguagauccauugucuguucuauuuauuuuuccagugaaaaguauuuugauagagcuuuucauuuuauaaauacacugaguuaaccaaauaucauggauuuccguuuguucuuaagacaugcaauucaaauguaaauacaguagaguauuacuuagguagaaacucguggugauuuuaagauuggaaaagaaucugaggaagaguugaauaacacacauucuaaagacuagaacauuuuauuguauguuguaaaauuggguagaaauuuguguuugugaaaacugagcauuaaaaccuuacagagaccguuucucguuuacuuaagaaaaugugcgguguguugucuguuguuaauuccauucccuccguguguuuccuuaaaagcuucugucuauuaguggcuuccugugcucugggcacuuaacuccuaaucuuucaaacaccgggaugcaaacagcacagggauuagaccugugugcacccugaccuggagggugagcuuugccugcugucugcucgcuuggcucuuuauacagacugaggcucagucugccugcccgucucugggguguuccaucucagcauuaggucaguugguucuguugagugucuucagguccaccuccagcuggugauuauuucagaauaaccagaccuuguacuuguuuauauucugaauuugcauguuugccugacuuaguauuucucaauuaaaaccucuuaaguggaguaauuucuuugucaguugcuacugaugugaagugauucuguuacuguuguguaaauuaaccagaaacucauccuuaaggaagcugggguggucuucuugugcaaguguuuuugcuuuuaacagaauuaucucuucaguucuacuauggauugauuaauuuaucuuacacagugacagcggcgugccaucuugacgggagaucuuguggucugcuacuaucuguucaccaagcagcauucucacaggacagcucacuugcaucagugcuguagacuuguuugcuuggcuguccucaccuuugccugggucaguguagugggaagaaucuggaaauggagguuuaguuagcuucuuucugccuguuugguguuuggauaacagcuuuggacaacuccauucacucaagagccuuucucuaauguuugcugguggaaugccagacguggagaggcacacauuugagaccucuuccaugaguccuucuaggccuuuugaucccaaguccuuaaacacuacguucuugguagguaaugcauguuuuggggaaugaugcuacaaauaugccaguugcauuuugcugguagaaucuuuagucccaagcaucauaauggugacuugucugagauugacaucacuguagaguccuaugcagcccagacguggagaagaccacagggcacugcuuacagagguacucugcagugugcacuggaugcccuggcccuggaaguugcagagguggagaugcuguuuuacuuugaggcugauuaagccaaguuuguuugcacgaaggacagauguggggcuuuggcacugucacuugugaacacuagaugcuuguuuugguugcgacaacuacuuuccuucauagaaacaaauguugcaccccagcucaccugaaguuaaauagauggaagcagaacacuagaugcuuguuuugguugcgacaacuacuuuccuucauagaaacaaauguugcaccccagcucaccugaaguuaaauagauggaagcagaaagcguuggugcuggucagcaaggccagaaggcaagauuaacacccaacugagauaaaagcaguuuuaaguguugccaugggaagucuggagagggaauacauguuagggcauguuggcaugcugccuugggugccacugucuuaacugaaaacauuuuagccagcugccuggaaagauguaaacagccccaguagugcacacugaggccaaguccaggugcuguguuccugcaucucuguccagcagguuaggugugcauaccaccaugcaccugugaccuugaaccagccugcaaaccagagugcugauguacugucauggaagugguguggcuggugccagacaaauccauucuucucacgucagaaaaugaaguguucauugccugugccucagcuguauuaaagggauuggagaacaucuggcuugguguguauuugcagaacugaaugcuguugauuuuggugacuacuuagaaaggacaccgcauuuuagguuaacacccuaaggcccucucccaucucaccccuuuaguaaacaaaagccuguuuacugcccaguauggaaaguauuuuagguucuaaguuaggcccuucuuccuugaucccaggaggugagagaauagcagugucugcuguggguuuggugucugggaugugaauucuaagugggugaaguggccaccaauaggaaagggagaaacuugaugacagugacucagcacuuuugaaauguucaagauuuuaaauuuguuacaauccacaguuacacuaagcaguuuccauguuuugggaguaagguaauuuuacccuuacccaaucaauacaggacagguuacccucucccugguguguguaagacacaacuaaagcuacaauugaaggcuuuggagaauuaaccauuuaacgugcuuacuacuuuagucuacccacaggaugaggcuacaugcaaaaacugcccaagucaaauaguuuugucaaguuaaguaaggggcuggaaggugaaaaguugacccuagagaaugcuucagcuacccuuuggggcagguagcccuggccccugugugcaggugugcuguaggcauuguggagacagggguugggggggggggugugccugcuguacuugacugaaguguaaagcuuugguaaggauuuggccucuagcagucuuagguuucugcauuuaccacggugacacagccccuacagggcugacuaggaacagcacauccugugcuguugaagcuguccacaucucauuccuaaagguccucucucucuugucaaucagggcuccacggacagcaaaacauucccucaccccuuuucaguuuccuugaugugacuuaccucuuuuuguuuauuucuuuugagacaggguuuuucuguguauuuauagcuguccuggaauuguucuguagaccaggcuggccugaaaguugccuccugccucuguccgccccccaaacccuggguuuaaagguauacaccacuacuaacuguugaggcucagucuccuaagagcugggauuucuggaauguaucaguaugcccauuuuaggacccaccuuuuggauuaaggaauaucgcaggaauuagaacauagucuuaguagaacagcucccuucugacucugcuuaucacugauaaggaagacgucaaggcuggguugugaguuugaggccagucuugggcacacaguucuaagccaucuuuggaccccguggagacuggaagguucaggauuugaauuaggaaggguaaacugacaagauuaaaaucauggagggugggggcugggaaguuuuuuguuugaugcuuuucauauaucuuaagcuggccuugaacucuugaucuucaugucuuaauccauggaguacuggauuuacaggucugcuaugccuagcuacuuauuuauuuaggacagggucucacuauguagcuuuagcuggcccagaacucaaagauccagcugccuucguuuuccagcccucacaggaccaaacaggaacucaguuguucccaccuucauuccucaguaguguuaguaucaggauuagauccuaucagggugaugauggaugcucuaauucccaaguacugggaccacaggcauuugccuccauguuuguuuuucaagaguuuuuauuuauguuucugacuugaauuucauaggaaacuguuggaaaguuuuagcuugguguuaaggcagaguuuccagcacuuucugaaaugacccuaaacacugcuuccauguuauacuguguuuauguaaagcaguguucucugcaucaacuaugaaguugaaauaucagccagcucuaaauaaugcugauggcgcucugcagcuuacaggaucaaaugcucacccaaaauuguuauguaaaaagcacacccauuucuucuuccauaugcaccuuggcauuucaaauaaacaccuucaugauuuauuacugauaau

SEQ ID NO: 4905 - RNA, 23950 nt, Mus musculus
cggaaccagagggaacgcaugacuagucggaucccagaagcgcggaccuaggacuuccaucccggaagcucaguuuucagcauggcucugggaggggaggaacgcaagagaaggaagggcucggagcggaggugaguggcggcgggcguugguguggauggguuggcggugaguggcgcggcguggcugaagagugcucuuguguuugcagacagagcucuggagacggcgugagcugugcggccagcgacuaccuggugggacaggucgccgacagcuugcggggcggcccgcggccuccuggaggcgggacggggcggcuggccgcucucuucagcaccgcggagccaucggcuccuccuguauuugugccugugccccaggugagucgccgggcugcacccugaguaucccgguagagagagauguagagggucacucuccugacagcagugacugucugguccuuugagcagggcuagcgcuucacccucagccuauuugauuggcagggucaccuguagaccguguaagccucaaauuucaguuauguauccgaggaugaacuaaacuccugauccuucuccagccuugaguucugagauuacagagucgcucccaccauguccgacuugacuuuuuuauuuugagacaggaucacacuaguugcgcacgcuuagaauacacgguaacccagauucuauauuccugccucaccuuuccacugaauggcuggugcugcaagaauauucugcuucucuccguaacccgugaagaaguauccauguagaaaggcacaucggaguacugcucagggacuuggagacggagggacuuugcuauguagcucuggcuggccuggcacaguuccuccugccucuauuccugaauacuggaauuacagauauaagccacaacacacagcuuuagggucaggauuuuuuuuuuuuuuaaaguuugagguuuuaaauaugacuucaaacuuuugaaaggaaacaucuaaaaaaagaaaacuugaugaugaugaugaugaugaagaagagagugugucccaaacuaaaaagccaguuuugcaagagccuucgagaaaagugaaagugaagaaacucucugaugcagacaaaagacuggcaaacagguugguagaaaucuccuuuuugcuauauuaaauaccucaggcaguuuuuuuuuuuuuuuuuuuaauguucaucuuaauuuuuuucacugcauauucugaaauuuaaaaaauacauuauacaaagucucauacaggguuaaaagauacaagaaagccauuuauccuaagcgaacagauacugguagaucagcuuuuuaggucuuuguguccaucacugcuucuugauucugagccagccuuguuaggacuuuaaccccuucucuguuuucugaguugggauuucugaguuagugugucugucaaaugugaauuugguuuucauaggaaccaaauuucccuuacuaacuuaaaauuccuuuuacauaauauuugaguuaguauccaaacagauacacuacuuuucuauugaguguuccucauucuuucuuggagacuucuugcaucccagguggaccuuaaacucacucugcaaccuaagcuguacuucagcuuccacaaacccuuggcucucaauuccuucucgcugcuucaagccuauuuucuuuucccauuuuuacacucuccucuuucaguaaaaccuucaguaguuauuacguuuguugucugcaugugugucagugcauuccugucaagguggccuguggaaggaccagcuccuaggaguccauucgcugucuggcugcaggacaggugccuuugccugcugagccacuacacuaguuccccaccacccucacacccucugaggacugugcgcugcuuccacucggugacugcuuucucgaagcuuuacauuccaagcuuucuguucccuucucuguuuugucucugaauuaagaugaacaccuuuccugagcuugcaauuaggaaacggcuucuucuuggaguucuugucagucaccucgcagcaguucuucaugggcacugcugugugucggcccugagcauuagaccuguuccgucuuuuugauugccuguaucugcaccuguacauuucuuguuuaccuuaagauagugcuccuugaggcuagaggugugccucacuugguggaguguuccuugucuaaaccgugcaugguaacauauacuugcagucucccagcacuuggaagguggugguucuuggaucggacacucagaguuauccuacaccauauauagugaguuugaagccagccuagguugcaugccaccuuccuuaaaucaaaacccaaaaagcaaaauaaaaugcuucaaacugaaacccuccuguguuaaugguacuucacgucuagauaagugccuaagccagugcugcagggguuacccugugcucucaccucuucacacacagcuacucagcugcuaaguccugaagcugucgucuuuuuuuuucuuucuuuuuuaaugaaaagacagucuaacuguauuucucuauugccgcagacccucugggucccuuugucuucguggaugggucucugggugcagaugggcaaggaguuggcgaaugacagacagacgcagacaggagguuguguagaaucugaauguauugucaggucgagcaucaaacuuuuuauacagcagaauagcaaggaaccagacaagauacaauccaccaaguuacugugacgcaauacaaaaggaauguauacaucaaaagaaggcgggaacuaggccacugccacucagaagggagccagguguaaagcuagucuauuguuaagaccaccaccagggguuuagcagaccuucucaugaauacugcaauaccucaacccuccuauuuccugggcucugauaauuucuaguaacuuuuaaguaucuguggagaaucuccauucgucagaagaauucaacagcuugcuucuaauaugcaauguagccuguacugaagauuucuaucucagugggauucccuggcucuuuuuugguaaacacucuguagaccagcacugagcuacuggauccaucuuuuguaaugcuuaauuaguuacugaauagguaacuuccuuacugcauuucuaccggauuccaagcucucguuggcuucuggcauguuggaacacaggugggagacuuaauuauaucagaauucaaucuuaaaagguacuuauaauaaaauaauacuaaaagggagcacauggauccgaacaccagauuaacgcgggaauaggguaugaguauacagguuaaugagaacgccaaaacuccaggaggugaguuuccgugaaacucugccucaugagugcuuccaggccucucggccugccaagcaaacuucacuggagugugcguagcacucuaugccagucugaacuuaagauccuccugccuuaccuucucaaguccagucacuauucuuuaauucuguuaaucugccuucguuccaucuccauccuuguucuggccugcuauuuuuguguguguugucaugacaauaucuuuguucauguuuauacaucuuguucauuucuuaucuucuccauugcaugauugacuugggucugugugugugccugccugcccuccuuccucuccgcccuuuuuucucccuccuucuccccuugccuucccucuucuuuccucccucuuucccucccucccuucccccuuucuucccuuccuucuguggugcuagauauugaacaaacaaagauacaugcuaggcugagugccuugcugagcuaugucucuggacucaaauuaauuuuugaaguacagccuguccgugugguccagguuggcuucuagugcccaagugauuuuuguagguagucagucuugugguuuccugucucccaaaggaaaugcuuuugcauaacuggucgcucucagcugggccccaccauucccuuuuuccuugccagcuacguuagauguugaaaugaacagaucauuguacuugggcucuugguggaggagcaauagugguauuuauuuaagacugcgacacauacugcuaccuucuuuaaaaagccuuucuuggcugggcugugguggcacacaccuuuaaucccaacacuugggaggcagaggcaggcggauuucugaguucaaggccagccugguuuacaaagugaguuccaggacagccagggcuauacagagaaacccugucucgaaaaacaacaacaacaacaaaaaaggaagacuuucuuggucuucaugguucuuuucggguguccuagccauugccacgcuagcuguugccacgugaucacugccugccucuguagugcacugcugaaaggcuugaagaagcauagugggaacccagugagucauugcauggcuccugcagcccuccuuucucucaccuuaagaccccuaucuaguucucuugucaguguggcgucagacuugaguaucccugugcaacagaaccaucuguuuguauuuaccuuuucagagcuucugaagggacagcaucaacacaagacaccucaagaccaaguuccuaguacaaaggauauuuauuugcccuggagggaugggggggggagauaagagacaaagauaggaaauagaggaugagggagaaggggagggcaacaagggagaucgggagggggagggauguuuggcccuaggggguagggaauagggaauggcaaugaccacaaaguacugccucuagauaaagaggagacacaaguggcccauaggcaaauggcaguuuaaaaagguaaaaggggaagaaacccuguguuaggguuagguguuuaauuuuuauugggcuuguuaauuagggcaaccaaagggggcuuuugauugcuagaccuuauuaggagaaggaaguggccaaauaagggaauaaaacuaaccuuagugguuagcuuuaggaauguaaucuauuguuuuuuagcaagggguuggggcaaggccucuuuauauauccguauuugccgugcucggugggccagagacccuucacuuacuuuaguuagcuguccuucaacuagauagaccucuccuaaguaaggacccauguuuucucaaucaacagauucuguuuucagacuguuuggugggcacagaaaccucuguaggucguagagaguguugaguguccagggccuagggcagagaaugacaauaacgggcacccacagaguguaaaguagacaugaagagcuuauguggcuuuccuuuaguacuccugugcccugugcugcugccgccgcugccuggcuuuaguaugucagaaaauauuccuuaaacucuuugauauagacuuuguuuucuaaagguagcgcacagcagaagccagcagaaggugucugcagucaggaggcaggacugagugucacaugcugguuuuuuuguuuguuuuguuuuugacuccuccuuucuuugguuguuccuuaaaaacuagggaaagugcucuagcaagugcugaucuagaagaagagcuucaucaggaccaagggcagggaagaaggagaaggucucagucucgggguaaaguggcagauggagaagcacuggacguugcccucagccuugcuaaggaugggggccaaagaacaaaaaucccagucaaccccgaagaggagcgguuaaaaaacgagaggacuguguuuguuggcaauuugccugucacauguaauaaaaaggugaguggaaggggguagaaugaaccuagagaagcuauugacuaagguuacguuuaaugagcucauaguugauaacuaacucauugcugcaucuuugugcuuccuaaucagcacaccauagauggguucugggauguguguguguguguguguguguguguguguguguguugcuuggcucucagcccuaauuuaggcuugugaaggucauguuugaaauaguaguggccuauuucuguuuuuuuuccccccucuucaccuuucuuccuguuaaugccacuagaauguaaaccaauacacauaacucucccucccucccucccucccucccucccuccuuuacuguucugucuugcacacaugagaggaugccuaacacaguaaagguucaaagaauauuugcuauguggaagaaugaguuuugccuucuauguggguguaguugguagucuaugcaaaccucaggcucaaauccuguucaucuuuggaaggauggguuuauauuuuuauucuuagaaaacacagugacuuuuauucccuagucuuucauuuguaaagauaucauguacuacccuuuaauuaaauaaaccuacuuuuuagauuuguuuuaugugggugaauauuuucuccacacguaugugcacugcauauauaacuggugccuauggaggucagaaggcaucagauccucuggaagugaaguaguggaugauugugagccaucauuugggugcugaugguggacaccaugcaagaagaccggcaaugggcaagugagcucccuagagacagccauccacuugcuuggcugcagugagugagcucuggugaggcagggccccagagacuuagucccaggguugcuucuuucgacugauguccuuucucaugcuugucauugccacacuucucauuuaucucacuuggugugaauggacaccaggagacccgcacugccuauagccuggugugacuacuucaugagugguagcuacccuacugggcacauuuucugcagaucaacaugaaaaugaacuuucaugaauuaauuagaugaacuaaugacuauggaauuccugaucugauucaaauaauuuuaggaagaaaguuuaaggggagaaaguuuuaguuguuuuaccaaaaagauaaaauaaaguuagaaucaagaauagaauguguuggccgggcagugguggugcacgccuguaauccuagcacuugggaggcagaggcagguggauuucugaguucaagaccaccuggucuacagagugaguuccaggacagccagggcuacacagagaaacccugucucaaacaaacaaacaaacaaacaaacgaauagaauguguccccuucucauagaauagcaaguaaaggcugcauaauaaggaguacaaugagcuuucauaaguuacacuuagaagagaaauaggcuuggaaaaaaaauuaugaucaagaaaaaacauucuagggggugguuggguaugggggacuuuugguauagcauuggaaauguaaaugagcuaaauaccuaauaaaaaauggaaaaaaaaaaaaaaaagaaaaaacauucuaggucagguccaaagaugaagccccaaguguacacuaugauaaaguaaggccacaugaaacuguugcuuugaacuuacaaugagcuuauagaaugaaccacugcuuugaauuuacuuacuuuuuuuuugguuuuucgagacaggguuucucuguguagcucuggcuguccuggaacucauuuguagaccaggcuggccucgaacucagaaauccgccugccucugccucccaagagcuaggacuagaggcgugcgccaccauacccggcugaauuuacuuacuauugacauccuucuguaacucugcuuuuguguggcauuuuauaaggaacuuuugucuaagaaguauaaaaagacugagagaaaaaaauaaagugugacuguuugggcucuguuccauccaccaguauaaauguauauaugucuguuuguauguacauacauacauauguagguauauguguauaaguaugcauguacaauugugaaauugaugagacagguggucaggccuggccugagugguguguguguaugugugugugugugugugugugugugugugugcacaagugugcaugcacacaauugacuuuguuucuuucuuacguacuuuuuucccuuucucugugaaauugccaaaaaucacuagcuuuuggccccagaauagcaagagagaguuaaauugccagaagccaucagcuucuggcccucagaacaguaagaggggguuaaaggccaaaagucaccagccucuguccuuguccuacucagcacucuucuacccccauucugagauccaagcucagguccuguugaagagugaaaagugcucuuagcugcugagccuuuucuccagcccuccuuuguauuuuugaguguuuacucuggucuuuaacucaugguaauucuucuuccucuaccuccuuaagagcuaggauuagagacuaugcccaggugguuuuugucaguuuugugucaucucccuaugaaucucauguaccccaggccagaggagagaagugugauguuauguuguucuguaaaaauauucuuucaguaaauggcuuuuaaauuagaauuaguuguacaaauuacuguuguaaccuguaaauacauguauguucuucacaucuugcgauaguccaagaauuugucccaaaaugacuaacaaggauucuccacucggguagucagagucaaagagcuggagauuuucucuguggaacaguauucuuaaaggcacugugguuuaagccagugugaaaagaucagagauuaugugcaaaauacaagucuaacuaaccuccauuuaagugucaaauaaguuauaaacauugaaacauacagcuaucauauaggucaugcauggaugauaaugugaaccugaauaguauuuuucuucuaaccaaguuucuguaaaaucuuuucgucuguccagcucaagucauguguuuuucugacguguucuuugguuuuuagacacuggauguuaacaccucaucuugaguccgcuuuguguuucuagugcugggauacuacucacacuugauucuggaauggccuuaaaauaaauucacaucauuuccuuuuuuguuuguuuguuuuuguuuguuuguuuuguuuuuugagacaggguuucacuguguagcccuggcuguccuggaacucacuuuguagaacaggcuggccucgaacucagaaauccgccugccucugccucccgagugcugggauuaaaggcgugcgccaccacgcccgucacaucauuucuuuugugacacagauguucaggguguuggcuaacauguacguguauauuguuuauuuuagaagcugaagucauuuuuuaaagaguauggacaaguagaauccguacgauuucguucugugguaagcgucuucucccacugaaaacugcauaauggcauggcauagauaacugcaugaguucauacaguacagugacaucugucaccaaggcuggccaugggauuugaugggcaggugggugacugucucugcugucagaguaggcaggggacuguuucucaccaugccgcaggcagccugacuagugcgugggcagagaggagugggacugcagcagugugugcuugggaucugauuccacucccaagcaguuaugcuaauguucagagaaugaagugccaggaauguguaugcuucuguucuuguuuguuuugagacagaaucucacuauguagccccagcuguccuggaacucacuuaauagaccaggcuggucuagaauucacagaaauccauugcuucugcuucugcuuccugggugcuagaacuaaaggugugcgccaucacacccagcagcguguuuuucaaaauucuuuucaguguaaugugcaguauuucagcaugcacaggaagggcuuaccuuguuugauugcucuuccuuucaugauucucuaagggcuucucagggcugagagcauaggucagcaguuggaugcuugccuaggguuugcacuuucucagucuccacacuguugaggcgugggcuggauggcucuguuguugcugcugccuugagccucccuggaauuauccacuaacuccugcagacucucccugaacaaaagugucccauggaaaaacagacugcuucuuuaaaaguagacauuuucugagaucuugacaguucuaauuauuucugucagcaugcuuguuccccaccauuaccaccaacuugccugcuccuuugagcuucacuucccaaugugaagcucuuaccugaacuaacuggggcgucuuggcacacacccuaggugcaggaugccugcaggaugugacuuucugcuguuaacuccuugguguaccuggccuguuacuugcucugcucgcuuuucacauagaggccuuacccaauuaagucacuucuuuccuuucuccuuggccuauauuuauucauggcuucuuuuaaaaaguuuuguuuuuauugcgaaucucuuuaagauuuaauuuuuauguguaugguuggaugguuugccuggaugugcguggagugcuccuggaggucagaagagggcauuagauccccuggaaucaguuggaguuaaaagucagcugugggagaccagccugggugggucuucuagaaaagcaguugucuuuacugcugagccaucucuccagccauuucauuaccucuuguuagaagagcugaccauaccaugguuccagguguguguggcccucugggugcuugagccucaucgugcagcacagcauuuacuacccugaacugaagccauguguuuuguuggcuguguggcucuucccacagcugcugcuuugucacuuuggcuuuucucugcugauaguaaagcgugcccuugguucuccuggaguguguuccauagguccuaggucaagauuguccucagcuauaugcugaggccaugucuagucugggcugcaaaggcccugucucaaacaaagaaagacaccacuaauuuuaggacccaugggauauaaucucuuagaugcaaaggaaauguuuccuuauuaccaguuuagacauuuucgguuuauacaugauccucccccccacacauuuacuuuauaaaacuguucucaugauucuucauugucaugaaucauccuguagccugagccucuugucuguacuugugccuuuguuguuugagagaggcuguugagugugauguuguuguuguugucuauacuugugccuuuguuguuagagagguuguugagugugauguugucuguggaauuccuuguaucuuaauucucaugucccccuccccauuucuguuuugugguagggcuuccuguagccuugaacucaaacucacuuacaacugagggugacuuuccauuuccucauccuccuguuucaagugcgggauucuaggauuauaggugugugccaccacuccuggcucagaauccucuucacaagcacugugauagcagcagcuucugauuugauuguccuacaguguauugaguuacaugaguuacaugugcuuagaauguuuuggcuccuaaaauguaauguaugugucugggaguguggcagagauagaccacguuggcauucuuggaggccugcgaucagucuccagcacugaaaaaggggaagaaugaaaaugcuaaccaauuuggaaaaauaucucaaguucaaaguuuuaauguuucuuuuucuucuuaaaagaugccagcagaggggacacuaaccaagaaguuggcugcaauaaaguaagcucauaauaagauuccuuucucuuuauuuuagaccauccuagaguucuguaaggucugccccauuuauuuaacuauaccugcagaugucuuguggucaugaagagcacugggaaguacuuugcacuuaaaauggcugcugucucacagaacuguucaucugguuauagugcagguuuuauuuuauaaaaguuguuauuuauaaacaagagcagccuggcaggugacaguggucuuuguggcuccaccucugcagcaggccuguuacuuugcucuagauuguuuuuggcuauugaguuguuggguuuuuauuugcuugacagggaagaaguuagauauuugugauggaagauagaaauauuuguuucccuauuagucuuuuccucuugugugugugugugugugugugugugugugugugugcaugcauguggaaucucuccauggaaacuagguguuuuauuguguaauuaccuuaaguaauuaaaaguauuuaaaaguguaauuuaccuuaaguaaaauugcacaauugagauguguaacuuuaguugucucuucucuuuugcuauuuuggggauugauuuuuguauauaccaggugacuacacccagucccaucccccaccuuuuuuuuuuuuuuuuuuuuugagacauggucuuauguagcccuacuagcuggcuggucuggaacacacagagaucugccuaucuguaccuuccaagugcugagauugaagguguacacuaccaugcccagccaacccuuagauuuuuuagacagucuugcuauguagcaaguucuguggaacuccugauuuuucugcuuuguuuccugagugcuggguauauacaggacaccacugccucuggccaccuuuaggaugggcugugugugcccuggugcagacauugccauagucuacauucugaguguccccuuuagcccagucuccugcugugcccuugcaguugccccuccuccucuguccauaggagccacucacccgcuuugugccucugggggacaugugcugcuguguccccacccuucucgugucuugcaaucuugauucugggaugggauaugaggacugcuucaugcuaagcacacacugccucugacuuugcucagcaugauucugagaccuauccugugugcaccaguauccuguucuuugucggcacuguugcuuuguguggaguuagcaaaccuuaguuguucaccuuaguuguugcucuugauauucaggugguuucaguuuuuaccugucaugcauaauggacuaaaaacaucuguaccuaguuuaugucugggaaaguaccugagguagaauugcugcaccuuauaguagguauguuuucuaaaauauagccacccagcaccccuuucuuuuugcaugguuuuccauuccaucagcaguaggugagaacaccacauguucacguucucaccagcacuggaugcugccagucauuucgggcuagucuucucaaggcuucuccacacgcucugugugguucucauacuuuaaaauggccaacauugauuaugugcuuacuggguauuugcauguuuggauguuuggucaaguauuuguaagagcuucaccuguucuacugucuuuuucuuguuucugagagagaggggguggggcgagaggagagacagacagcagguuagggaaaacuacauauucugcauacaaaagcuuuggaugccuuuuuuuuggauuuauuuauuuuuauuuuauguucuuuagcguuuugcccacaugcaugucugugacggugccagacaucauggaauuggauucacggacaguugugagcuccuguagggguguugggaauugacuccaaguccucuaaaagaacagccaaugcucuuaaacacugagccauguggccagucccugcuuuggugucagaaucaaaaacguggaaucccacaauuuauuagggauccaauguagaguucuccagcuguuggugagccuguaguauaguaggaauacaagcacaaggcacuuuguuguccuggccuagacucagagccggcaggcucaggaucugucaagaucuauggucagcucuuucucgcuguggcagccaggccccccauccccacccugcuuuaauguuuguaugcaugagugugggccugcaugugcuacagugugcuuguggaaguuguuucucuaccaccuuguggguacuaaaggaucaaacucagguugucagucauguuugcaggcauuuucacucaucgagccaucuuguagacuaggcucagccuuuuugucuuuaaugggucuuaaaguuccauaccagcuugcugacaagagguuccccuuuccuuuucuucuagcccuggagucuugucucugccuuaagugacaggcugacuguccuccacagcaucuucacuuuccucuucaucuggaggagaauccagguggggcuugggcacucuacuccagucuguuguuaccauaguugugcucuggggcuccugcccacuccaucuucccaugggugguagcucagaucagaaaauacccugugcaugguccccccuccagcaucaguaccucuaggguucuggcugagauucacccaugcuguuaucguuucucucuggaguucguggagccugaccuuaguguccaggcugcuuuccuccaagacuccugcucugauggcuucugccaaaguuuugaugcuguagauuagcugagagacaggagagaugcucuuucuggcuucuguguugcaggggaaggagagcacugucauuagugguucaugaugacgcauugaggcugaugcaaggccagcucugcagugaggcagacccaccugcuugccacugguguucaugugacaaagaucuuugcagacagagaaacagagccacauucuguucccauguucuugggauguugacagcuuuggguuugucaacagcugcgcguuguggagaaagaguuaggugcuggagucugccagacugaguuucuauccuuggcuagcuuguuaccuuuugaucacuaucacacacgucuucaaacuucaguuuuuucauucguaaaucagaauccauguuaggugugagguuaaugucuggcucagugcuuggcagcauuccucaucuaauaaaucacagcuuucuucucaauagaaaacagccagauuguacagaguaagucacagagacuuuggcagcaugugcagguccaagcuauacagacucagugcugagaguggaagugaacaugagccccaucccuaacccagaagcugucuacaagugucagcugcucacacaggaaaaguuaguuuucuccgauggagucucacuggguauaaaaggcccucugcccaggaguagauggccaacacaaaacacacacucuguauuuuugaagguuuuuuuuuuuucuuugucucauauuguuguuugggcauuuuuuaccguguuggucuuuugcuuauauauuauagcuccugauuuuguguuuuuauggguauguguguaugugugcaauuucucaagcuuuuuuucucuugugauuguuuuuuuuauuugccuguuuucuaaagagagagaaggaugugggagaagguaagggagggaaaacgaaucagaauauauuguaugaaaacaguauuuuuucagucuuuugugacaggguuuucucuguguagcccuggcuguccugaaacucacuuuauacccaggcuggccuccagcucacagagauccaccugccucugcuucccagugcugggauuaaaggugugcaccaccacaccuggcuugaaaaguuuuguuuugauuuguuuuucaacaaaaaaggaaaggcuguuaguguagugugcuacagcgugccaugugccgggccuggcacucuuuacuuguucacuuuguaguggugcucauuuguguguuggcauuuuuauuacuucagcagcagguuaacaucuuuagccaaggaccacugaacacuacuaaguccauucugcugucuucuuuaugauuuauuuauuuuuauuuuucauguauaugguuuuaucugcauguauauguccaccauguguguguuugguguuugaggaggccagaaaaggaugucacauuccuggaacuggaauuaacagaugguugugaacugcccuaagggugcugggauguggcccaagccuucuuugggaggaacaacugccuuuaacccgugagccaucucuccagucccuagucuauuuaucuuuaauauuacuauuuucugcugaaucacauccauauugcauugcccuugggcagcagcauuguccauaaucacuagaggugaaaagcuagccuuguuuuuuuuuuuuuuuuuuuuuaaagcuggcgcuggacaguggcagcccacgccuuuaaucccagcacuugggaggcagaggcagacggauuucugaguuugaggccagccuggucugcagagugaguuccaggacagccagggcuauacagaaaacccugucucaaaaaccaaccaaacaaacaaacaaacaaaaagcugacauagugcuugucauaauuguaguaccuagagcccugguaccuaguagccagccagucuagccuauauggugagacccaggccaaugagaaacaccaucucaaaaacauagguaguaccugcaggauggcccugcaaagaaaauugccugcugccaagcgagauuacuuuggaucaaucccuggaaccccagucguggaaggacaggacuaauucccaugaguuguccucucccuacacaugcgugugcaugccacccuuaccuacaaccacacaagugucuuaaaaauauacacagaaauaguagacagcacuugagggaugagagaugagauuggucccuggccuguacacacaccuguauuuauguguaaacacgcucauacacaagugugccuugcugagaaggaacauaacugugguucugacaaaggggccaugucugaaucagaucaaacuuuuggauccaguagucaguuuucaaggcacagaagacagaggugcaugucaaacugcuuuuucacagccagcaaaucuuaaaaauauacacaaaaugcuagaccagcaaaguccaggcugugagaaauaaugaaggacagagauaggaggaaaauggacaacuaagaguguaauuuguaagaguaggugaggcugcauugggagaaggcuguccacgaggaaguagggauggugcuggccaucagaaggaaggaugggcuccuaggugggauggcugugugcugagcuguuugugcaugugcacuuuuaauguauguaucuugcagugaaaggacucugcuaggugcagaguuggagccagggugacgucucgaauccuucuauuuuucuggguuggcacaugugggagucugcuauuagcacgcccucacagugaugaugccagagagugugugggcuuccuauucuuuuugcugucuuuauaugucuguguucuuuuucaaauuacuggaucuuuacuuaacuguggaacuuccacucuacaaguccugucuuacauugauuguagaaaacaguacaaguuuuuuuuuuucccuugaguuugagguuagcaacuuuuuaaaaaagauauuuucuuguuuuaaaaauauauuuuuauuuuauguacauugguguuuuuuuucuuuuuaaagauuuauuuauugauuuuauguauauaagugcucuaucugcauguacuccugugugucagaagaggguauuagaucccauuauagaugguuuugagccaccauggaauuguugggaauugaacucaggaccucugggagaauggccuaugcucuuaacaucugagucaucucuccagccccuacauugguguuuugacuauauauauaccuaacugugugaggauguuggaucuccuggaauaagaguuacagacagaugugagcuacuauguggguauugggaauugaacucaguacucuggaagagcagucagugcucuuaaccacugagagcuuuuacaugauccuuuuuuuucuuauguuuuuuucuguagacguaaauuucauccugaccagaaaagcaucaaugcauauguaguguucaaggaugagagcgccgcugcaaaagcucugcaaagguaaucguguuugggauggagcacgucgcuggccucugaccuauagagauggguucauuauuuggcuucacuacagcaaauguuuccauggcuaagugcccauuuucaacagcugugucuucuugucuuuauaacuagaaauggggcccagauugcagaaggauuucguauucgaguugaucuggcaucugaaacggccucuguaaguagauuguuauuuguuuaaagauguuaauaagacagccagauaugguaggucaugccuguaauccaugcaucaggagggugagacagaagaagcaacuggaauuacaggcccaccuggaugacuugugagacaauuucucaaagaaaacaggccaacaacaaaaagaucuuauuagcaagagccuguggaaaggaacuaaggauaugagcaggagagcgagagcgagccuuugcucuaaggccgcaguguuggcuccaucguaaacaggucgcuuucuaucugaugauuccuuuccccaucauguugcagaaaguaagaaaucgucaggucuagcgccucguaugccuacaggccggaagauuauuauaguuguuacuacagaucucauuauagaugguuaugagccaccauauugaacucagaaccucuggaaaaauagccaguacucuuaaccucugagccaucucuccagccucuagcacuuucuuuucauagacugaagucaggaaaguuauuacucaaguuauggugguagcgcguaccugugucagugcuggggaagcagaggcaggagaaucacacguuuugggacacugggcuauacaaugagagccuguuuagaaaccaaacguugucauuuguuagagguaaggagcacaguacugaagacucucuguacuugggaggggacgugcaaagguucagccuguggcucuguuuuauggucaaugcugucgugagcacgggaugcuucacccauucaggaauggggcaccuggggacaggccaacaagaaagaacaaggaugguuuccaggagaacaaauuuucugagucuugaaagguuuaucuggacaggaagauauuuucccagguaguaucugugagguuuaugcacugaggacagaaaccugacuuccugaggaaugucaagagcuugguacgguaaugguguacgagggcacagcaugcuguugcuagguuagcaggcaaaucauaaaaccagcuuugccucacuuugugcagucugaacuuuguccaggagcagaucauaguuucagugcugcagcagugugaccagauugcacaugacagcugugucuucagacaacaaaggauugugggcucagucugcagacgugugcuucuaagugucagaguuacucaguugaaagagaacagcagucggagcagacccuaccacagagggucaguaggcuaccugccaccugucugucacuaaaguuagcugcacacaaccacauguuucuuaagcaguucuuacagcaggauaagaaguugcuauggaguccacguggcccuuagaccaagucucagugacucuuggacuuccuaauacugcgacccuuuaauacaguucauuauguuguggugacccccagaguuaaaguuauuuucccugcuacuucauaacuguaauuuuucuacuguuaugaaugguaaauaucuguuuuccaauguucucuggcaaacccugugacacggucauuugauuccccccacuaucaacagguugagagcccugccuuagagccucaggguuugcugguuagcuccucacaggcaccgcuucccagcagcaggccuucccuaggaacugcccugagugccacugugaacaagucucuccucugcucucuacugugcagagggaagacacgaaacagacuugggcagguguaugaucaagucuggagguggauggcuacaggcaggggaggaaugcagagggcaggguagcguuguaagagaguuucuguuuuuaauacgcugacugguuuuuacucuuauuucagagggacaagagaucaguauuuguggggaaucuuccuuacaguaaguuuguuuaaacaaaucaaaauauaacuauuguuacaacuuuagcugccucagagaaaaauuuagaaagagcugggaguuguugcucaguagcagagcuccucucugguauuugugauguuuuaaguuccgugcccuuagcaccagaacccacacaaacaaaacaaguagucuaaugauuagcuuaugacuaguuuuaagaggcauguuguaagauggagggugguggcgcaugccuuuaaucucggcacuugggaggcaaaggcaggcaaaucugaguucgaggccagccuggucuacagagugaguucuaguauagccagagcaacacauaaacccugauugggggauguaaaaaaaaaaaagcagccuauuguacuguugugugcauggggcuuugcuuaucucagcauuaucaaacugcuccagcugaaggugaguccacaugcuuaccucgguuguacuuggauuuguuuguagaaauugaagacucugcuuuggaggaacacuuucuggacuguggaagcaucguggcagugaggaucgugagaaacccacuuacaggagucggcagaggauuuggcuaugugcucuuugagguaugggagacuagugcggggaugcucuuugaaaugcuggggcgagguugucacugcugugccaucuuuguggugaugcugucauuuaaauccccgauuucugacuuagggaagcuaaauccauaggcacacauugccguggcuauggcuccuuguuuguacaugcugacaguacuaagucauagcccagguguuggguaugagaggaacuaaaucuuuggaauuuuaccuucugugagauggagcagacaccugaguguucacucaguguucccuaacagcaguaaagaacauagcauacuacuuaauggcacuuagauucauuuuuauuauuuuuaacauggaugcauauggucuguguggauacaugcaugugagauucauuuuuauuauuuuuaacauggaugcauauggucuguguggauacaugcaugugaauguccaugcaccugccagaguugugggauuccucccugagcuggggguaggugccuggaacuccaauucuccaaaagaaccaaauguacucuuaacuacugagugagacaucguccagcacccagggucuuugacucuugauaaguauugccagggaacuuuuaacacucuuaaaugugugagguuuguguugcucuauuacacugaucuuauuuguuacugugucuagauguuacuugccucuuugagacccuuguagaguucuuucaauaucuccuuaacauugaaaauaguauuaaugguucuguguuggaauagaauaggauuuuggacucaaguagaacccucuagugucuagucccacaucucugacuguagaggacuuuccugccuucugcuuacaacaggaauuuuaagaaaguuguguuuugagcugauuacuguuuuaaagagacaucauaugaugaacagugaaccugugguggugauuaugagcauuuagugaagcagcuugagcgccaccuguagccgugaguggaacaugagcaacaagggguucaagcaaggcugaccaaacccuuggaucugaccucuagggcauagacuagaaggacuuguguguacaagcuugaagacugacauagaccacugaauucugaccuacuagucucauugcauaucacuuucugguggaaauuaauguuucuccuuauugcagaacacagaugcuguucaucuugcuuugaaguuaaauaauucugagcuaaugggaagaaaacugagagucaugcguucuguuaauaaagaaaaacuaaaacaacagaauucaaauccaagcuugaagaaggaugucauuaaaccuaagcaaagacuuaauuuuacuuccaaagaaggaaaauuccauuccaaagaaggaaaauuccauuccaagaaugcauuuauuggagaaaaggcaguucucaugaaaaagaaaaagaaaggacaaaagaaaaaaguacaaaugaagaaaccaagaaaacagcaguaauaacugagguugccuccuuucuguggugaaaccuugcaaugagugucuggguuuuuuauggauuauguagaaaauguggaggcauccacggugucugguuuuuguuuuuguuuuuuuuuuaauucaugcuauauguaaggcuucuuugaagccuuguucuuagaaauguauuuaaagaaaaauaauaaacauuaauacucuguguuuaggauaaguguucaaauggucacugugagaauacugauuccagguauagucacagucccuaagaaagacuugugagcuguguaaaacacacacgcacauucuucacuucucauuuuucuuucucuugcaauuguaguauagaucuacauuucuuaucccauauaucuaauaauugcuaaccaauaagacugauaggauaagagugacuaucuucuaauucguugccagugacuacaguggucaaugauguccuuggcuauuagguguguguguguguggaggggggggugcucauaagaaaaauacucuuccaggaaaaugugaugcuuaaauuaguaucacucagaaugaaacagcugucccagaaaguuuaaagacagcaucuaauaaaugauguuaauuaaacugcagucuuuaaaguugaaugacaugacaacauggugcugcauucccuaaguuccagacacaucuuaccaagcuggggcuggauccaggaugaagugggggaagcaggaagccaaggcugauucaggcaggcagaguccaguaggcaagaggguaggauaaguuuucacucuuuuaguuguaaaaguucugucuuugggaaaugccauguagaaaaccuaaugaggucuuuaaaacauagcucuaggggcuggagagauggcucagcaguuaagaauacugacugcucuuccaaagguccugaguucaaaucucagcaaccacauaguagcucgcaaccauccguaaugagaucugaugcccucuucuguuguuuguuuguuugagacaggguuucucuguauagccuuggcuguccuggaacucacuuugcagaccaggcugaccuugaacucagaaauccgccugccucugccccccaagugcugggauuaaaggcgugcgccaccaugccuggcugaugcucucuucuggaaugucuggauacaacuacaguguacuuacacauaaauaaaucuuaaacaaaaaacaaacaaaccccauagcucuagaggcuggagaguugguuucuugguuaagagcaugcacugcucuucagaguaccuaaguucaauuccuaguacccacgucaagcaguucacaacugucuguaacuugagcuccuagguccaacuccucuagucuccccagacuuugugcacuuuuucacuaacauaaccuacacacacauauauacaaguaaaaaauaaaaguguggggcuggagagauggcucagugguuaagagcacugacuguucuucuagagguccugaguucaauucccagcaaccacaugguggcucacaaccaucuguccgaugcacucuucugcugugugucugaagucagcuaccguguacucacauuaaauaaauauuaaaaaauaaauaaaaguguguagcuuuuacagcagagaaagcucuauuuccuguauccaagacuggauaauuuaugguugguuuuccuuacaguauuuagaaccuuuucaguuaaauuucagcaauuuuaccugaucacucuggagcauuuuugcauaaacuauauaaagauguaacauuagauugugcgugcauauauaaucuauguacaacuuacagcuccugugagugagcagguuauauacaugcauagauguaacuuuauuuaauauguguaugaugugaauguggaggccagaagaaaacucuggaguuuucuccuuccaaagcauggacucacucagccaucucacuggcccuagauacuuuggaauucgguacuguguaacuguugaaauuccuccuuuagaaugugugugcuacuaugauuguguaaaucauuaaaaaauguauuuuguaggaaauuuucuaaag

SEQ ID NO: 4906 - RNA, 1086 nt, Mus musculus
acagagccauugcaguacauugagcuccguagagacagugcugaggcaaacacgagccggaugggcacugggcgacucugugccucgcggaggaaaaucaacuaaacaugggcaaagaagauccuaagaagccgagaggcaaaauguccucauaugcauucuuugugcaaacuugccgggaggagcacaagaagaagcacccggaugcuucugucaacuucuccgaguucuccaagaagugcucagagagguggaagaccaugucugcuaaagaaaaggggaaaugugaagaucuggcaaaggcugacaaggcucguuauguaagagaaaugaaaaccuacaucccccuccccaaaggggagaccaaaaagaaguucaaggaccccaaugcacccgagaggccuccuucggccuucuucuuguucuguucugaguaccgccccaaaaucaaaggcgagcauccuggcuuauccauuggugauguugcaaagaaacuaggagagauguggaccaacacugcagcagaugacaagcagcccuaugagaagaaagcugccaagcugaaggagaaguacgagaaggauauugcugccuacagagcuaaaggaaaaucugauacagcgaaaaaaggggguggucaaagcugaaaagagcaagaaaaagaaggaagaggaagaugaugggaaggaugaagaggaugaggaagaggaggaagacgaagaugaagaagaagaugaugaugaugaauaaguugguucuagcgcaguuuuuuucuugucuauaaagcauuuaaccccccuguacacaacucacuccuuuuaaagaaaaaaauugaaauguaaggcuguguaagauuuguuuuuaaacuguacagugucuuuuuuuguauaguuaacacacuaccgaaugugucuuuagauagcccuguccuggugguauuuucaauagccacuaaccuugccuggcacagucuggggguuguaaauuggcauggaaauuuaaagcagguucuuguuggugcacagcacaaauuaguuauauauggggacaguaguuugguuuuuuuuuucuuuugguuuuauuuuu

SEQ ID NO: 4907 - RNA, 6346 nt, Mus musculus
auuuuucauucuugucuuuuuauugcucauuuguuuuuaucguccccaugacagagaauaaccugcuuucauaauugcccaaaccugauagguuuugucaaacuaaguucugaaucugcaaaucccaagggcaauguaguauguauaugccgcuuuuaauucaauccagaguaggguuuucuguuucuuaacccuggaaacucaguaucagauugaccuguuagcaauggugacugaucuguauuuuccaaguguccuucuuauuagaacauugaaauggaguccucuaacacccauggggcagauggcuccacagcugccugcauguagaggugaggugauccggagcuggcagccacuguccuaugcagaccuacaguguggggugaauauaaauguccacgugaggaagacgacaccugcuuuguccucucuauaaagcaaaccaguuuuuaaaaggauuuuuuuuuugacaguuccgagcugcuaagucaauuucuauccuagacucuguagaaaauggaaucuuuucccugcaauugacgugaaaauugaaggcuagugacuauucacuuucuaauaaugcaggguaaauaaaugcuaucacaccgcugaaagauguacuagagacaggcucugcagcuuccccaucaguguggcgcuuuuaucugugccauuggaggcucuguaucuuuuacauuuaaugugauagaucaagcagaccuuauuccaaaauguguuuuuaucuaucaagccacagauuaauauacaaaguaauuguuuagucuucucaagggacuuuuaaggaagugucuggaagccccgauguccuacauaacuggguagcuuauggcuuucuucugguguauguuuaauaauugcuuauuuagaaacagaagguugaguuuccccucguaguugaacagcugugagaccugcucuuggccuucacgcuugaguuuugugguguucugggguccugcacaugcuuucagugguguggaggguuuuggagccacucaggcccuugauggccuccuccaggcccuguaacuaauguuuccuucuucacccugcaucuuccccggcugauuacccacacuguccuguauccuacgaccauccucuaucauggagaagaaucccucagcucuaccuccccuccaacgccuucuuuuuccuucucgucacagcaaacucuuugcugucuccauuuucauacacgccccugccggucuuauguagaucaggcuagacucuaacuuccuuccuguguagucaacaagagugaccuugaauaucugaucuuccugcagcaccuccugagugcuggggugauggguguguaccaccacaccccguuuauguggugcugggagcugagccagagccuugugcaugucaggcauccuccugaaugaaccauauuuugaaccauuccccuuuucccuugaacccuuucacuaagucucccucugguccugcucugcaaagcucuccagcagucuccauucugaugcuuucacucuuccaagccuaugcugggcccaugggcuugcugucugcucuguucgcuuuacugccuaauccugugccaucuaguccucuagugcugggguucugcaggaccuguccucucuccccuucucuuacauuuuugguuuugagacucgccuuuaagggcugagccaucucuccagccccuuucuucccuucucuauucuguuuucuuccucauuuucaguagcauagagaguagauguuaucuggaacagagccuucagguucccaggcuaaggagaggacucccaaguuuauaccuuuaauugaggcaccugcuuugagcucuggaugggcaguacucucuuugacauuuaugcuuggguaugggcugguggcugcaagacucuggucucuguuugcccccagagcuguauaucugccucuucccuuugcauggcucucuucuucucuugauuagcuccaaagcguugggacaacucuuaauagcaguccuuauaucaaacaguaggcuugugaauauguagaaccuuguucuagccccagucuauuaaccugaggauucacaucuugugugggucccacuguggccacagaaggcagcuugucaaugacuagagucaaaaauggaggcugcaagaagguaucuauggggcaacuuuuggaguugacuggggaguggaaguagaaggccugaguauuuuugaucuuuuggcccaugccugcagcauguacccuugcugguuugaacaaugcccauuacagguggaagcuagaaacuguaguaaguccaucagcaaacacucuggcuuuccacaucacccuguuccccacccccaaccccagagcaucaccugaucugugaugcuaaucuuuccucuucuacaucccugaaggccaucuauuacuggccucuuccucucugacaucaccuagcaccagaaccucuucuuucuaucuuucuaacccccuaccugaauauccuucccaccuacacacacacacacacacacacacacacacacacacacacacagauggcuucacuguuaaaucugugguauuuuugcuuuacagggugguggaucuaaaacugcaaacugcacucagcuacauugacacuuccugccacacuucuuguuacagugucucuuuucuccuuuccacuggcuggugccuaugaguaacugcuuccuuggguuaaaguugacaauggcagagaauguuagauucuucaccugccuugaggaaggacaagggugaagccuuggccgacugguacacaguacccaggaauucuaacagaaguuaacugagcauaacuccuuucucgacuuccaccuuugugcuuacgguuucuucuacagccuuuggggcagcucuacccaguucucugggacuguucagagugccugaccucugaacagccucuccucagagcagccaucaaacauucccccagaagccaguauaaacauaccccugguuccuggaucauuaacuguaaguggaguuuuacacccuaagccauaaaggguagccuucuaagcaggacuuugcagauccaggugcuggcagaauucagucacuagcaucagaaccacacuaagcaagauggcacucccuacugcauuccugagcugaucuguaucaccuggcacuccuugaccucaggaugauggccuugggagcaccuuccuuuagcuggcuuuccaaaauucccuuuuucauguaucucguucucuggccaguguuccuagcuacuuccuagaaaccuacacccuuguccuuucucauacgggucaacuucuuuuaaaccuagacaguggcagcaaguauugagcaacccagaccaguguaguaagcaguagacggguaaucgagacacucuugucugaaggaaccaugcauuuguggcaaugccagugccaccuuuggaagagcaucccauuguucacaucugccuugcacauguguguccuggcacuaagcagauauccuacaggguauuuccacuuuauguaacauguugcaugucuguuacauguuaugauagauguuuucuucuguguccagccuugcacagaagguaucuaagccaugugcauucccacauguugggcuauucauagcacccaggucuuaggcuguaugcuccaguggugauggauucaagcaugauguaaugcuacaguugccacaugaggguguugcuaagauucaaagcaucagauucagaaaaugagguaggauccuucccucaagccaagcacccucaaagggugugagcagccacugcggcuuaugucagcaucagguauuuuucucccuggauggcaauucacacaugcaggcacacaugugccuugacaacagggggugcucuggagcuguuacagucuccugcagggcaaccuguaaugcacaugcugccgcugugugaacucagcugggaccuaacccacuccugcagcucagaaucuucaggcacuccuaaaugaggugugguuugacagggcgaugacagccacaccuccuuacccucucuuuccauaauauuuauaauauuuauauugugauuaacugcuccccacccccaggcucucuaucucuccuuauguaacuauuuucugucuuugcaaaagaaaacuaaggggauccagggauguggcucugugggcccacacuguaucgauugagcauacauguagaccuauuacugggaguggagggcgggggugggguggggaugaaggcugaaggauaggaaggucaaagucacccuacacuacaggacccccccuuaucucaggaagagaaagaugacaucauauucuuggucuccauaguaacagaugggcugggcugaguggacugcgaacaccuguccuccugucauuccuucuacucauugcucguuucuguuuggugacagcacugcuccuggguccuguuucuggcuuuguagggcacaugcaggccaugacuucuuuacgggaagaacuuuccuugggcagccugcugcagcuggcauuuagcggccauugccugcugaaacugguguacaucugcugagaacauuauuuucccuaacccauguaauccucgccauaauccuagaaggugcuauuuuuagcugcauuuuauggguagagagacuaacaacaccggggcucaauaagugacuuaacuugccaaaucacucugugaaguggggguggugcacacugaaauccagccaggugccaagcuggccagccauuuugucucuuuuggggaccaugcugccggaccugugcaugggccacagcugcggugaaauccaccccaacgcuauugugugugcugccaaagcaaguguuccuguucuagcucugagcuacaggaguuugugcccuuugguccugaccaguuucguuucugccugauuuccucacuguuuucucucuaugccuccgagcucuuuuguuauccccaaguuauucuuuucuuuccucccccacccagcccuuuucugggauagaacccaaggcuuccugcucgcuaggcaagcacucugcuguuugcuuacacuuccccagcccauccuccaaaacugagcauaaggcucuuguuacugaaucaaacauaccuccucuccuaagugacuguccuucaugugaugacagaaucccuucaccaacacugacgguaagcacagccugcucauucucuuccuacuguucaggauagucccacagagcucuggugccagucacaaugcuaccagccauuuaccccauuccuuacgugcacuuuccugcaccucagaccguucuccaccucuucuguucuucgcucucgaaacaaguauacagucauccuugccugcugcucagaaccugucugcacuccuucccccagggauaauucuaccuuggcugucucugccugcccaccugaugcugacugugcagaagagcauguugcuccucucaggcuccgcccacgacaagcugcuguacucagcacgucuccugcugagguucucucuggaaucuucaagccucaccuuuaggguccagggagguggcuaagugcuggagcauuuuuuucuaccauguaugagguccugguucugugucuagccacugucuguuuauucggcaacucuuagccauucccuauccucauaacuggugggaaccacaucucaaggugaacuuuuaaaccucaagaauuucacuuuuuuuuuuuuuuaauuccagaggguggggaguaguuuuuaugcuuaguucuggaauagcccugagucuggcaggcaccuucuccaccacuggacuacaugcuccaaagccuuuuuccuguuuugcaauuacagaugaugucaucuuucucucucggaggguugauucugauauaguuacuuauaagaaaacaaucaugggugcuaguagacugaaauuguccucguuuuguuguuguuuguuagucuaaggcagggcuucuauagcccagcugucuugaaacuuacuauguaaccacuauguaaccuaggacuuugaccuucagagccugcugcuuccaucugggaguacuaagagacaggcaugucccaaccaacaaaccagguucucuucagggcugacgauaagccccugggcuuggcccugcuaggaaagccccucccagcagagacacauccccacccguucaccugugaagcguucccugggcaauacagcagcuccuggacauugauuggagugugguggcaaaguagaaguugucacgucugcaauccugccacugagccgcccuggcuguaaugaaggaagguugauca

SEQ ID NO: 4908 - RNA, 1423 nt, Mus musculus
cacacuccacgaggccccgggugggcaccgccucgcggaccacgggcgcugcggccugguucccagggucccgcgccgcgcuggggaaaggcgcccgcugggcaccgacggaccgaaccccucuaaggucagcggcacccagaucccugucguacccacccuugaaccccgccacgccccggugugacagacugggcucgcgacccucccuuaggacaaggccgggcggggcggggagcugcagccgaacgaggccgagcgccgcggucccuaaaaccggacuccacccggcccaggccgcagagacacgccugguuagcccgaguugcccggagcccacgcccgcacguccacacgcccgcggccuuaccuuuucgcagcguccgcccgacacgcgggcggcccgggcuccgccgcguuccgccucucggagggucucgggucggugucggcggaccucggccuuucggagggucucgggccggcgucggcgggccucggcuucucgguuggucucggguggcgucggcgggccucggccgcuccgcgggucuggcggcucuucagcgagugggcggagacucggcccgccugucccucaggaagccgccccgccccgcccccgccgcgaagcucuuucucccgggcugcccggcuuuucucucccuccggaaacgcauuccuccgcgccgcgucagccgcgccugaaaaggagggggaggcggcaggaagaaggaagguggggcagggugcagacaaaggagcucggucguucggcccuuucugccugggguaccgcgcugaaccaccgagggcgccggccgcccggcuggaaagcccagccgcagucuguguccggucccugggaucccgagccagaccucucugugggcugaggggacaagaaggaucggguguucugcaggcagcccucggacccgccccgucacccuaagauugcagacucccgcuccacccuugcugugccacccugcgcuccuuggcgccgcauuugcucaauuuucuaucuggguggccaagcacaaaaaggaaaaauguuauguuugcgcacuugcuuucucuuuucuggaaaaagaauugaaaaguagccagucucaaaaucuaaaugagaagcuugaaacuuggacuugccucgucauacugaaagcugugggacagcaggugccaucagcuuacccgaagagugugggcugccaggaggagcagggcacccagccguaaagacagcuuucauugccggguuuaugaacccaagaaauaguguuucuguucuggaagaguaaaacugggaugccaaaaaaaaaaaaaaagauuaaucacuauggaaaaguuauauguugcccaugagcaaaucaaauguauuguuuaacuaaaauuuuaauaaaugagcaucguuuuucua

SEQ ID NO: 4909 - RNA, 47928 nt, Mus musculus
cguuuccggagggagagaaaagccgggcagcccgggagaaagagcuucgcggcgggggcggggcggggcggcuuccugagggacaggcgggccgagucuccgcccacucgcugaagagccgccagacccgcggagcggccgaggcccgccgacgccacccgagaccaaccgagaagccgaggcccgccgacgccggcccgagacccuccgaaaggccgagguccgccgacaccgacccgagacccuccgagaggcggaacgcggcggagcccgggccgcccgcgugucgggcggacgcugcgaaaagguaaggccgcgggcguguggacgugcgggcgugggcuccgggcaacucgggcuaaccaggcgugucucugcggccugggccggguggaguccgguuuuagggaccgcggcgcucggccucguucggcugcagcuccccgccccgcccggccuuguccuaagggagggucgcgagcccagucugucacaccggggcguggcgggguucaaggguggguacgacagggaucugggugccgcugaccuuagagggguucgguccgucggugcccagcgggcgccuuuccccagcgcggcgcgggacccugggaaccaggccgcagcgcccgugguccgcgaggcggugcccacccggggccucguggaguguggcugccuacccuuucucgugccuccuagugacaggcuggguuaaugaccgcgcugaucccgaaugccacagugaauuugaacuuuuaauuugaaaccuaguaauaacuaguaauaaauuauccuauuuccguuuccucaucuuuaaaagagaaaaggaguuccuacacuaauuauaguaauucuugugacacgagggucagacccagcucccagcauguaaacucccagcauguacugaccucacugcagaacccugauccugauccauggugguauugggacugccuaucucauuuuacaaaggaagaaacugaggugcaggaguuuuaaguaauuuggagaguucaugggcucaccuccagagccuauauuugaacuuuaaguaaccuaacuaauguaaaauaaagaaggcauuuuguguguguguguguauguauauguauggcaagaggaauccagggcaaugccucaaaaaaaaaaaaaaaaaaaaaaaaaaagaaaagaaaaaaaaagaaaagaaaaaaaagaaaaggacacaguagguagugaaauguaaaaccacaacuuagacaacaaugcuucauauacauuaauuacuuuucauugcuuuugcuauguuaaaaaaaaucuacaaacuucucagaauguuuugguaguauuaggaaagucuccuggauaugccauuccacuuggguaugaagaggauaguaugacuuaagguuuuuauuuuuuaauggugguuguugcuugcauaggacagaaauaaauguuagaugaauucugauuagauuucuuuuuuaaaucgcacacagccauuacaguaggucauauccuagauaaccuguagaauggacuaagaaauuuuaguuuagaguuaccucuugcauacugauggacaucaaggcccgaagggaaggacugacaucagaaucuuaauauaugauaugauauccaaguuuaugaggaauuuugauucauucaaccaugguuaaugaucagaaaugauagaaugacaaauagaaaacggaugaaacacuggcauguuguauauaggcacuuggggagaguagaagauacuagaacucuaguuuuuaugugaguagaaagcaguuucuagcuuaucuguugaauuuacaggccugcaguugaagaaucuguuguugaggauaugaaguucaguauuaagaugguuucuuuaauuuuaauuuauaauuauuugcaugugggaauguaugccgagcauagguggagguuagaggauacauuugugagguuucuucuuuucuuccacuaucauguggauuucagggauugaauucagguugcccagcuuggguaagcauuuucauguguugagccaucucacuguuugagguuguuuccuuuuuuuaaggcuuugauuuguuuauuuuaugugggugcguauuugccugcuuguaaguuugcccuguguguaugccgcuccaguggaggccagaagagaggggucaaaucuccuggaacaguacccacaaguggcugucagcugguaugugggcacuagcaauagaacucagguccucuggaagagcaugucuuccccuacccccucccaccagguuguuuguaaucuucaguauuguacaugaaaauuacagaaucaacaaaguugaaaaguaaucaguugucuuuaauuuucuggucagccuaauuugaaucuguucugaaucaacaucaaugaaaugaaaauauaguucuguauugauuaacuccaugaacacugcucaccucuccucacucuuuauuacuaggaaaauuaauuagcuugacggauguuuguccagaaugcuuucugccuaauguaguuccuuuacucucugguguuuuucuaacagagccccacccccugguuuacauguagagagggagguguauaucauaguuuguugucuggagaaaauaauuuuauuaguguuccgugaguguaugaguacuaguauucuuaccuguguuaccagagugaugagauaaacauguugacacuaguaaaaguuucagaggauuguuuuuuuuuuccucagaauuuaaauguaaaaguuuuugaaguguaauaagcccagcugacuugaagauucauuauggggugaauaugauaaaauaagcuuuuaccauuuguuugcaaauuagugaguuucagaguugauuaguguuuucuauuauaguacuguuuauugggacuuugguuauagguuuucagacuuuuuuguuuaucauaugucaaauaguuggcaaucaggaaugugaggauaaagggggaaaagauaguaauugagucuucuggaucagaucuaaaguaguagcaguauacagucucagaaaucagaaguguacugagguuaaaggacaguccacacaauucugacugcuuagaaauugacguagauaggugagggcaguguaucucacuuucaggagcugugugauaaagaauaaacuacuucguuaauuuucacaguuugaaaacuuuauuuuucuguguguggcuuuagaagauaaagauaauuaucuuuaccaaugugucuagcaugcauauuguaaauuucucaggguuugaaaacuuuauuuuugguguguggcuuucagaagauaagaauaauuaucuuuacaaauaugucuagcauguauauuguaaauuuuucagaguuugaaaacuuuauuuuugguguguggcuuuagaagauaagaauaauuaucuuuacccguaugucuagcauauaugucaucauaaaauguauacgugagaaaagaggcuccuucaaauauauaucauauuagagcagacauacaugcccauauauaucuguaugcacgcaaaugcauguacauauuaaauauuacaaauauaaauuuauauaaacaagcauauauauauauauauauauauauauauauauaugcauacauacauaucucuuacuuguaggagcauuuuaccaaggcuucaaaauaacagguuucuaaccccaggguuauguaaaauaacuuaauagucuguaaggaguauaagcauuuuauucuacuuauuuuuuuuuuuuuuuuuuuuguuuuuucgagacaggguuucucuguguagcccuggcuguccuggaacucacucuguagaacaggcuggccucgaacucagaaauccaccugccucuaccucccgagugcugggauuaaagugugccaccaugcccggcuuuugaguauaagcauuuuauaagagcauucucuguuuauagcuuuuaaaaguucaacguauuuaucauguauaauguuauugcauugcuauaaaauauauguuuuaauuuauaaauaaugggugcauggccaauuuuuuuucuagugauagagaugaaacucaaaaagcuuauagaucccaagugguagccaguagggaaacaagaauuauguuguguaggaaggggaauuggugaccugggguucauguugagggaaauggaaaggugaauggccagguggugcauuuacccagggaggcagugcuacuacaagagcguaggaucuaccaugcugaguucuuuaaggugaccauggggccuagaguuugggaauuuuccaucuaucaaugcugguugauaguauaggcugcaaaauaaaagcaccggaguguagaguagagaaggcucuugagaguagggaaagucguucacuuucccauuuucuuugaacuuuuggauccuuugccggccauuuuagagaguguaggaauuuguggggguuuccagcaauuagcauguuuaaauuaaagacuaguuuauuuuucacacccauucccccagagcagugaucagagcugcaguuugauugaggagaggcuucacaugggaaaccuggcuuucagugcaggugcugaaccuggauuacuguaugacauuggugcaccacucccuagggcuuugguuucacaucugcacuguugcucucacuuugagauaagagggagugacugccugaucuaaguacugaagaguacaauuuuuguuuuuucaugagaaaccauuuucuuuaaauuaaaaaaaauacuuuaaauuauguguagguauguaugucuucauaugacuuugcacacaugagugcaaguuccuucagaggccagaggcuuuagauuuccuagagcuggugcuauagaagguugugagccaccuaauaggagcuaugggaagucugggaauugaacuuggguugucuggaagagcagcaaaugcucuugacuguugagcccucuuuugccugagcaaccguuuugugucauuaugagaaaguauagaugcugugcaauuaacacugguugugccagggcugauuugucacgucuguaacuggcugcucuuugucagggugucuuuaguagugcauugcauuguagcucgucaguguacugagucauugccacugcaaagacaugugcucaaagaguguaauucaggggucggcaugucuuugauuuugaguaaauucccuagaugguucaauuguguuccacucaggaaaacaugacaaagaauaguuuauacagugugccaucccagaugauacucucaguuuuuuuugaagaaaaggucagugguggcuuaagugguuuuggaaggcuugauggagaagaugaggucugagugaggaaugggcugaugggugauaugaaagauguauuuaaaaaagagcaaaagaaaagaaacaaguaaaagucauaaagguagaagaauuugcauugcauuuugcuuaaggaauguaguuucaaguggaagggugaaaauauuuacaugcaaauucugguaaaugucauuagaagcacagaacauauucagucuauaugcuuauugaauguuuaauuucauacucugaaauuaggaugcaaauagcuuucuaaugccuccaguauuuuauagacuauauaugauuuauuuuauuauuauuuuuuacccuucuuagaggucaauuguggaauauuauacuauuugauaauuaagauauugaaguuuguuggacaucagugggaggagaggcccuugggccugaggguguucagugccccaguuuaggggaaugccagggugggaggaugggagugggugggugggggagcacccucauagagcagggggauggguuagggguuucugaaggggagaccuggaaagaggaaaacauuugacauguaaauaaagaaaauauccaaucggaaaaaaaaaaaaagauauugaaguuugaaacuacauuuaguggccuaauucuacauuuggaaaauguaauaaaauaaaauaggcaugaguuauccugauuaaagaaguauggaagcaugacuuuaaaagaauuggaggugucucuuguguucauacuugagaggcccuggguucaaucucuagcacagaacaacaacaacaacaacaaaguugagaaacacauauuaaggaguuauucagaucccgcccccaguguuaagaaaaucaguauagaaauauuuguugcuaaaacuuuuccaucagggucauauuuuauccuuucccaaauucugaaauaugcgucacuccuagccuagucuugagucaaaugagaaaugaaguaacuuaucuguagcuuuuuuuuuuuaaacauucuuuauuuuauguaugaguacacuguugcugucuugagacacagcagaagagaacaucugauccuguuagagaugguugugagccaccauguaguuguugggaauugaacucaggaucuauggaagagcagucagugcuuuuagccacugagccaucucuccagcccuauaguuugauuuuuaaacauuuguuguauaaaguaugccuggauugugcuuauuccauccacaccaggugagagaaggaagauaggauaaaaggugguggucaaagugaacuuuuauccagaaaaauuuuuuggaaaccaguagauaagauuaugcaauauagaaauguaacucaaaauuccuccuaauugaaauuauguauagggaaaaugcuuuugauaccauuaacagauaguuaacuuucuuuuuuaaagauuuaucuauuuuuauguuuaugugccugcaugugugcaugugaaccgugugaaccgugugaaccguguguguguguguguguguguguguguguguguguguguguguguguguuuugcucccagcagaggcuagaagaggguguugugauuuucuggaccuggaauuacagaugguuguaagcugccaggugugaaugcuugggaucaggaccuaguugcucugcaagaguagcaaguacuuuuaagcacugacccuucuuucgcucuagugcccagauaguuaacuuuugcaagaccucuuacacuuacauuugugaaauauaaguuuugucaacugaaacauuugauaauuuuccucauucauagggaaaaacaaaaaacaggaaagaaaggauaaaauuugcauauguagaaaguauaaagggaucgcuagcuuagggaccgcuagguuaguucguaaagucucauuugcuagguaauaaggaugauagcagauggugcugggcagcaguuuuucuucucucacuguagacuggcuguuuauguuuucguuuuauagcuuuucuuaaaauguuuuauuuucaaaauucaucuguagccauacuuuuggggcuacuuuauuggguucuuauauuuaccacacuccucuacccuaguuccuuccaaccccccuaauacuaacuagguaguugagaagaagguuagaggggaaagggagcauagaccuaguuagacuuccugcugauuaggggcuucgagguucuuggacaaguccaaucuucaugguuagaauaucucuagccagcaaccagcaacucaggauucaggaaccagcaguucagcaauagcuaaagcagcagcagaaccagcagcugccaccacaggcucuuggggcacucacacuuacacucucucaagaguccccaaaauuccaaauguagacuauuugcagcuggcaaaaucacacuucugcagcaagagagaaaucauagugguuguggacaaucugaaguggucccauaucccacaccuggggauuaaaacaaaaacauauucacauaucaauacuggguuuuuuaagaaaccaaaauucucacuccuuccaucauuuggcagucauuagauuaacuuuguagugacugauuugaauucgacacuugcccuuggggcugcucuucuuucaggugaggguaguggagguagaugucaguugucugucaccacacauucugucuuguuggcucuuccuuuccuuugguaguuuguacuuugugugacaccucagguuugaucuuguuuuguugauuauauuccuggagcuuaugaguuuugaagaggacauugauacucucauuuuccuugggauaguggaaucaucaguagucgugaauuguauuuuuaaauuuuuuuuuguguauuuguguugcgagugaacuguuuuuagagaucagauuuuuuuuugugagcuuuggaucaaacuuauuaauuuauuauuauuauuacuguuguuguuauuuuacuguagcauaaccaaccuagaacucacuguaugaaacaggcuagccucaaacuucuagaaauucucuuacuuuagccucaaaguacugggauuacauacagcaugaaccauuguacuuagcuucaaacaaaaaccuucauuguaggaguuuauuaggcucagacaaauguuuuauugguuagaaaggauuuucauugaguucuucaaaagucuuuuguuugcagucaggguagaguuuuggcuggcauuuaagaagcugucuagggagacuguuguguacuuauaggaugguaggcugcagugaggugcuacuaacauucccaacuuagccgggcagugguggcucacgccuuuaauuccaucacucgggaggcagaggcaggcggauuucugaguuugaggccauccugaucuacagagugaguuccaggacagccagggcuacacagagaaccccugucucgaaaaacaacaacaacaaaaaccccaaaacaaaaaaccauucccaucuuagguuaccuagccucuuuuucugacucuacuggcuguuuuuuuuuuguuuguuuguuucaauuugacauaaguuaaaguuaucagagaguaaggagccucagcugagaaaauggcuggugguccuagguucuauaagaaaguaggccaaacaagccaugggaaguaagccaguaagcagaaccacaccaugaccucugcaucagcuccugccuccagguucugcuuaaauuccuguccucacuuccuccaaugauggacuaugaucugaaaguguaagcugaauaaccaacccuuuucucccuaguuugcuuuuuggucaggguguuuuuugugguaguaauagaaacucugacuaaggcacuguccuuguuuucuucuuccuuguguguaagcauaauguuuuuguguaguguguaaagauuauccuuguauuauucaaaugcugauuucucuaucccauuaucuguuuucaauccagacacagcauuggggaguguuuaauacagggucuugcacacaccaagcuaguguuuuaucacugagcuucaucuccagcuguuaaguacuucauuuugugugaacuggcuuauacauuccuuguagaggccagaaguugacagaggauguguucuccaauuguucucuuaacuuauucuuuggagaucucucacugaauuggagaugagauuuggcuguuugaauggaauugaggauguguuccucccucaucugccuauaugagcagaaacugaguagcaaccccuugguguccccuugccuuugccugcccacuccccauguuaggauuacggacacacaccauugacacucagcuuuuaacacaggugcuagggauuugaauugagauucuaacuuugcagacugagauaucucccuaauuuuaaagucauuuuccuuuuaagaguaagugauuucuacaaaaauaguauagguugagcuuccuuuaucugaaaaauuuaaaugguucagauguaaaucucugaaugucaacaugguacaaaaaauucugcaccuaguugucccuucaggaucagugguaugcagguauuauccaguugaauacuuaauacucaauacaggcauguauguaaguuacauaaggggauuuuacauuuagacccaggucuaaguuucacuacauguagcuauuucaaaaucugaaaguccuguacuuuuggcccuaugcaguuugaauaagggauacuuaaucuguauauaucaagcuuuaaaagauaucauuuguaaagggagugcacaucuuuaaccccagcacuugggaggcagaggaaagcagaucuuugugagucugaggccagccugaucuacuccaggucagucagggcuuuguaaugagacccugucuuaguaaaaggaaauaccagauguuauuuauauuuuauuaaaaaaauuaaguguuuaaaaguucagaagggcuuguuuacuuugaagauuaagauaguuguauaaauguggggcuguuucuuacuuaagcuauccuuaagaauauuuugcucagggaugaauuaugccaccuuagauaaaaauugaauaugcuuuaaaaaaucuuaaugagaugcuuuugugggaacaagacacaaaaccagcaucuauuuagaaauuaagauaacuuguuggccuccauucacuuugaauguuuauuaaauaaacucauaaaacauuauaagcuuuuuuuuuucauuucuguggucugagucaauucuaacucuagauccgucuaaaauaguggcuaaauaggccuucaaaaaauauacuuaaugaagcucaaaaucaggcuauagcuucugaguucagaagcucaggugacaauuucaucuguaaagcagagaugucuccuuucugagcuccugaguaaugucagaagacaaggucguauaauuuaauauauuccagcauaacauuuugaguguuaucuuuuucucuuuccuuuccugccuccaaaccuuccuauauacucuucugcucuccuuuaaauucauagccucuuuuuaaaaacugauucuuguugcaugcauauaugugcaguauauauauauauauauauauauauauauauuccuaaauauaacuugaguuuguauaauguuacauguguguauauuuucagggcuuauuguuuggcacuggacagccaauggguguguucaucucuggggagaggacuaacuuuccccacaacagcuuuccuuaguugccuauaguucugugcuuuucucaguccauuggugucauccuuguucagcucauguucgggcauucauguuggagaggcuucauggauguagcuucagauguuacuagaagacacaagcuaacagcaaauguucugaucaucuggcucuuacugucuuucugcugccucuuccucaauguucccugaccuuuagguguuuuuguagauguaucuauugggacugggcuccacaacucuguauuuugaguuuuugugguuuucuguaguggucuugguugcaaagggaaguuuccuuggugaaggaugaaggcugcacuuaucuguguguauaaggacagacauuuauagauuagugauuauggugguuugguaaacuagagauaguagauucuccuccaauaacuaugacuucacaacaacugaguaguuagcuagauuuccaguagcaagcaugguuucucucuuguugagauggugucaauuagacuuaauaauugccaauuagacaauaaccaaccagguuaucuccauggugccaugcuguuuguugugguuuguagauaucacagcuggguagaauucuuguuuucuucccucuuucugaagcuuacauggugcuuuuugguaccaugaaagcuaguccucagggaggggacauucagguugaguauuaucuuugagccaaguacuuguugcuauauuugugacuaagacacuaagaucuuguucucuugccccacucccaccccaccugauccguugggggaaagaccaauauuaaaaguaguuacagaugaguaaaauauuaggaugcaccucuauaaauuagugcguacaguggcugcugggcccacaucucuucuccauaguacuauugcccauuuuccauguccucaguuaucuugguuuccaacuugaggaggaauugauaggggaguggcuuuguuguggugaaaauuagugugccuaauucagagugauacauucccaguagucugagugacugcucugcuccaggguggacugucuuuaucauuugucuuuuucuuuuccauguuuugacuuuuaguauccucucagccuucuuuucuuccugaguuuucauuucuucauaacaccaugcaugcucacuugaauaaugaucucuucugugcauaucucuaacuccagccuaucucccgagauccacaucuguguccccacuuuccuuaauuaaacaaauaucauaaccuauaaguaauuaccuuaaccaccuaacuguagacuuguuugcauuuccucauugcuauugugguguacauuuugacacaauggcuuuuuuuuuuuuuuuuuuuuuuuuaagauacagucuuaucauuacaccauguuauuucaugcuggccuuugauucucauucuucuugcuuuaauuuuucuugaguguuuguauuauagacaugaggcaacacaugccugugacaugugugauaaacucugccugccuguaaggcgucgucccuauccuggucuccccuaauuuccugcugcuguguuuauauaaucauguucuaucuugccacaggcuuuucugcuucucaauuaugacaauaaacaaaauuuaaccucuuguaaucuggcuccugcugcguguuugcucuuacucagcuccugcuauuuucagugcauaaugcaaaucucagaacuacuuuuaagauuuuaaaaauauaauguguauuuaugauagagacaugguuguuugaaugaaaauggcccccauaggcucauaggaaguggcacuauggaguugugcccuuguuggaguagguguggccuuggagaaauugugucacuuggggugggcuuugagguuucaagugcucaagccaggcccagugucauccucucuuccugcugcuuucugauccugauguaaaauucucagcuaccucuccauacucuacagguaccauuuguaccugcgcuaccaugcuucuaucuugccaucuuccuguaguuagacaguuaggugucuuuacacuauguccuguguugauguaaaacacaguuuacaccucaaaagaucccuuuguccauuguauucuagagccaaauaugacugaccaugaccuggaaacacagauuuagguuacccuagauuccauguuccaguuugauauguaguuuuauguaacagaacaaagaaaaccauaaaucaaguuacuucuaaguacagugguggaaggaaacguuagagagauggguuagaacaaaguagggaaaucuggcuucagaugcuagcugguggaagcugaucaucuucuaaguuaauacauuccaaaggauaacuagugcuauguuucuacauuccaagugacuuaucuaauggagggcuguauugguuacuuugcuguuuuggugauaaaaugccaugaccaagauaauuuaaggaagaguuuguuuuggcuuaugguuucagaagaguaagaguccuucaugcuggaguggcauggcagcuuuaauaagaaauugagaaaucacaucuuuagccacagacaugaagcugagagcaaacuggaaaugguacaagucuuaauuucaaagccuguucccagugauauauuuucucuagccauacuaaauuuucuuaauagggaucccacauagagaucaaguguucagaugcuugagccuauggggaacauuucuaaugcaaaccaccauaagggcaauagauggcuauuaagaggguaaagauggcacaaguuuuuagcucugaacuugcaacauuccaaauucuccagucauugaagaucuaaucagucugucagccucauagaugguucaauucaaaaugcagcuucuuuuggagauuuucacuuacaguuucuacucuugagcauaucucacauuuuauauaugugguagccacauuuuacuuauuaaauaucauucauaucuccuuuuuaaggaaaggcucauuaagaucugauguagaucaaauugauuaguaggcaggugagcagucuuuaaggggagaagaauaccugguaucauagcuucagcugucaaccuaacacaaaccuagagucaucuagaaagagggaacuucaguggaagaguauucuucuucuggauuggcuugugggcauguuucuggggcauuuuuuugauugcuaauugacguaguuuggcccguuccauuaccagcugugcugucccuaggcugguagaccugggcugauaccugagcaaaccagaggaagcagcccagcaaacaguguuccucugugagugagugaguucgugcuugugcugacuuccuucagugauggaccuggaaguauaaaaccuuuuacacuuccuuuccucccaaguugguuuuggucaguguuuuaucacagcaacauaaagcaaacuagaacauaugguaaaagccauuaaagggagaaaaaaaaaccuucuagauuauaucauuaaaaucuaauagccauuaugguucagaucugauuuuuuaauuuauuuuuuauuaaauuaauuuauuuuuuaaacuccauauuccauuccccaccacaucccucaucuacccucugacagcuccucaucucacaccucccuccucccuccauguggaugaccucaccccccaccccacuugaccuuuaaacucccugggaccuccagucucuugaggguuaggugcaucaucucugaaugaacacagaccgggaaguccuuuacuguguguguguuggggaccucauaucagcugguguaugcugucuguuuugugguccaguguuugagugaucuuggagguccagauuaauugagacugcugguccuccuacaggaucguccuucuccucagcuucuuucagccuucccuaauucaacaauagaagucaggugcuucuguccauuaguugggugcaaauaucugcaucugacucuuucagcugcuuauugggucuuucggagggcagucaugauaggucucuuuuuuugugagcgcuccauagccucaguaauagugucagguuuuggaccuccccuugagcugaaucccacuuugggccugucacuagaccuucuuuaccucaggcuccucuccauuuccaucccuguaauucuuuuagacaggaacaacuauaggucagagaugacugggauggcaaccccauucucacuugaugcccugucuuccuacuggaggugggcucuguaaguucccucucccuacugucaguuauuucaucuaaggucccucccuuugauuccugagaguauuuuaccuccuaggucucuggugcauucugggggaucccuccaaccuccuauuuccugagguugccuguuuccauucuuuucugcuggcccucagggcuucaguccuuuucccucacccaauaccagauaggucucccucucccccuccacuuucccucccaggucccuccuuccccccccccccccccccccacuugugauugguuucuucucucucccaagugggacugagucauccucacugggcacuucagcuuguugaccuuuugaccuuugaguucuguggacuguauuuuggauauucuguuuuuuuuuuuuuuuuuuuuuuugcuaauauccacuuacuagugaguauauaccaugcauguccuuuugggucagaguuaccucacuuggaugauauuuucuaguuccauccauuugucugcaaaacucaggauauagcugaguagaauauuccauugguaaaugaaccacauuuucuguaucuauucuucugccgugggacaucuagguuguuuccagcuucuggcuaucauaaauaaggccgcuaugaacuuaguggaacacaugccccuguggcauggugggacaucuuuuuuuuuuuuaagguuuauacuuuuuauguuuaugcguacauuuguagcugucuucagacauaucagaagagggcauugaaucccauuacagaugguugugagccaccauguggaugcuggaaauugaacucaggaccucuggaagaguagccagugcucuuaacugcugagccaucucuccagccccagaucugauuuucaacugucuauauuugauauaacaugggaucuauauuagaguaauauaugaaauuuaaaauaaucaagaauauugucuggacuaaugaaguuaacagcaacaacaacaacaacaacccugaaguagucuaauugguuguauuuuuuggcaguaauaauuuggauuuaaaauacacuacuuccaaacuggagaguggguuuuugguuuuuguuguuguugaaauguuuuuaucaguugaaaaacuagauuucuuuaacccagauaaaagcgaauaaugaguuuuuuccuuaaaaaacacaaaaauauuugugaauguucuaaacaugaaaacaagauuuaaauaagguagauguuuaggauaaguaaaaagucauaacaaaaaagaugauuaugaaaggaaggauauuggggcuggugagauggcucagcaguuaagagcacugacugcucuuccggaagucaugaguucaaauaccagaaucuacaugguggcuaacaaccauccuuaaugagaaacaaauaaaaaaccuaugggcuggaucgagugggagggauggggggaaagaaaggaaaaauaucaugaauucaauaaaaacaagauuagcauuaauuuaucacuuaugaguauaccaagugaaauacuaaauacacaaagauaucgaauucuaaaaggauuuuaagaaacaaaaaaguuagagaaauguuuacauuauauuacauggggcacuugaguaucagccagaauuuucuaaaugagauuaugcuuauacucucagaugaagguauuguguauuuaauguaagaaacgugaaucagaaagcugauuucauuuguaaucuaggaguagguaagauauaucuggauagaaucuuguuguccagucagaauggaguuguuuaugaaauaaauaucugguuuuucuuacucuugaaaaagacuguaacuaguucugcauuuuaguugucacaauuaaaaguauuuguuuuuuuaagcgaucacuuguuaacauuuuaaagagcauaucagaauagaucaauauuuaaggaaaccuuauuguuauaaacagaaucaagcccugauuuuaucugagguuauuuaguuuugacuuuaaaaauuugaugacacacacaaaaccauagucacuuucuauaaguuucauuuugacuguuucuacaacauacuuuaaucuuuagaaauaauccucauagaugaugaagaguugucuucagugagaugccauugcuagggaaccucuaagccccauuucucuguauagagucauuuguugacaggccucgcauagcccaagguuauauguuauagcuuuaugucugagaaggacauccacgugaacugugauguagucuuucucaagccuucccccauucugccucgggcaggcacuuugguccagauuccaguugugccgccucccuaagggccacucucaaguauggucucagucucaugcucccagcucuugcuuucucauuacugucauuguccuuagaguccugcugaauucuuacuucuuccugucccuaaaacccagcauuuaugaaagccaccaagcaauagcuccucuguuuccugcuggcuuacagauccuuacagaagaguugaugacuaucuccaagauguuuggagacaguccuaguucucucagcaguucuugaacacuagaacuuuguuuugucuucuucugagcgugguggcacacuuccagagguaugagggcuuuaguaaguagguucuuuggccuaucaggauacaaagaagcagaggucuguggcacuuacaguaaugguuuaaaguaauguauuucagaauauuggggaacauuaucuuuuucauucuaucauaguuugucucucugacuuguaugguauuuuggaagauuucucaaggcugaucagcaaguauuaagguagccugaaggaguauauccauccucauacugugaucauccacuuccacuggagugacacguucucuguccuuagucaucaguggcucuauugaaauuguugagaauuucaaccuguaaugauuuacaacauuguaacccuaacccuuagaacaucauacauuugugacacucagguuuuauucacuucuuggaugcagucccaagcuaucugcaucaaccugucagccccaggagagacucauuuccuggaggaagccugauugcggguggaugacucccagagcuaccucucuugucucugggaagucuaggugagcaguggagcagaaguguuuaucuuaagauuaggaccaugucucaaugcacaguagcaugucugccuuuacuucucauaugaaagggaccugagaccagagcaaaguuuucugugcuuugggaagagcuguucuuuaaaagaaauacucaggguuaaaauagaacuaaagaaccuuuccuuuccuucccuucccuucccuucccuucccuucccuucccuucccuucccuucccuucccuucccuucccuucccuucccuucccuucccuucccuucccuucccuucccuucccuucccuucccuucccuucccuucccuucccuucccuucccuucccguuccuuuccuuuccuuuccuuuucuuuucuuuucuuuucuuucuuuuuuuuuaaagauaggucuugaacuuaccaucuagggaaggaugaugaacuuauacgucugauucuccugccuccacuuucccaauguucuuucuuuuccuggguuucaagacagaauuuuucuguguagaucagacuggccuuaaacuuaugguaauucuccugccucugccucuuaaauucugggauuaugcccaugccagcauuccuuacucugcuuucauucugugggugagucagauguguaugcaugugcacuagacuggacaugccuaugaacagaaggcaguuaacauguuagcugaguagucugcagucucagcugucuuugaacacauuugguuaggaaugaaaacauugguugaauagaaauagagagaaugaauagaaguugccuguuuaauacauagaauauuaucugaucucuuuccuccucaccuccuaacccugagauucuaaaggacaauacagauucuugguuuaauaaggcauuuugcuguagaaaguugagggaaucaagcugaguauuuuaccaaucccaugcauaguuaauuuucuuacaaaagaaaaaaaauaacagcaaagcacacagaaaaaaugagucagaaccuugaauaugaauucauguuuuagccugaggagaaauaaaaacucuuugcguugucagcaugggaugaaugauucagugcuggaaaguacucuugguucugagguaacugggccucuggaugugccuauuagguugagagccccaggagacuguguagauggacauucuacaggacaagccgccacagcuuucugcuguaggaauacuaacuuugguuucuuuagaauguauguaauuuuguaauguuuaauugaaugcuaagacauuucauuuagagacgacagaaacacauucugcaaguguggugugaaguaggugaaagguaaccaucuggaagaaaggcagauggcaguguagagauguuuggagagaaauagauugagaagaaaaagaagggaagguggaauguaauauuuucucuaucaauaauaauauacauuuucuguuauagaugaauuugcaacugguuuccuggauuggauugaucaguuugauuuguucuguauuuggccaaacagguaaaaaaaaagguucuugguuuuuuguuguuguuguuguuguuguuaucuuuuuauuucagcaucuuguaucaauagucauuggucaguuagauucuagagggaagggcaacccuccaucagaucacaacacuccugaaaauuugcagcaucgucucacugugaaugaaaaacagguuuccaaggagccugcaggggucuucauuaucaguuaaucaucccugacuucagugugaggauugugagagcucacaugacaguaugucauagaccacacaaaaauaauuggagaaugugagagugcuggagagggaccagaacaaaggcagagacauguaauauauuuagaagcaaauaaaauaaauauccacuuugguggauuacaacgaaaguguguccauuagcaucuaaaaagggaaaguaggcuggacaugguggcacaugccuguaauccuagcacuuggaaggcagaaauagucaggagaaucaugaguuuuaggcuagccugugcuagauacaacccccccuucuccaucccccaaauuaaaaaaauccuagaggguuggaauauaguucagucaaagcucuauguuuggaguggcaaaaagaaaaaaaacaaaaccaaaaaacuagagagagagagagaaggaagaaggaggaggaagaagaagaagaggaagaaaacucagaaguuuacuuucuagaagaaauucuuguucugugaucaagaagucuuguauuagcauaucuauaagagcagguaacaagcugaagauaguuuaaauuucucugacaaccauaaccaucccuuguucuacugucuaugucuuaaaaaagcauaguauauaaaauaauuagaauuaucucaucucaagauggacaugugaaaaugaugaaagauacugaguaggaaaugauacauaaaaucuacagcccccagaaacuguauccugaggacacaccuaaaauugguagggugguuaucuuaaauuuuucacuucaagcauaguuuauauucuaaucagaaaacuggagacagucuuucuaguauuuacuacaaguaaaaaugugccagucuagauugagucaaagaaaugaaagcucaauugguuaugaguuggaugaauaugggcuuggcaguuauuuaacauacuaaaaguggaguggaagcccugaagacauuuaugugguaugggcaugagauugucagucauaaggaaaaggcaauaccugaccuagguauaagaguaccaggacauuuauaacccgcagaacaauaggugcugaaauuacagugucaacaguauggucuaaugguguguagcuaggcuaaugguauuaguacuagugugucaugcaaaaagacaagaugauugccguuugugguucucagugucaaggggaccccaggucauuagguuuucuuuggaguagccugguauagcuuaguaacugggcugcauuuguucauuuuuaacauguauguuuauuugcauauuccuggucucuguuuuucuugugaucuuuucauuuuuuucccuuugaaacuuuaaagauacugaaaaguacaguguuuuuguuucuuuucuaacagauaaaaauagauguuuaaaagcaaaugccaaaucuugcggagaauguauacaagcagggccaaauugugggugguguacaaauacgguaagauuucugauacuguucuauuuauucucugauuuuuagacuuauucagagccuuguccuugggaagugucagauaagauauaccauuuuaauuaauguuuauugaauaguguauaguagucagaauuaugcuguuugacaaaauacuugucuuaguuaauuuuauuuguugugacaaaaaaccauucuuaagguaacuuauaaaacaaacaaacaaaacauuuaauuugcggcucaaagcagagugucaguccauggccgucauggcuuugagcauugccccagacagacagacauggagcuggggcaguaguuaaaagcuuacauccugauugacacuaugagguagagagagcuaacugggaaaguugugggaauuugaaagcucaaagccuaacuaacuucagugaaaggaaauauaugcaaauuugaguucagaguuugcuuaaagauuaauguacuuugucccuucuauaaugcuuacuaaaauuguauugaauuaauuugagguuauguuaggucaaagguucuuuguauaugucuucacucagcuguuuggacuuguaagaucaacucugacuagguaaguuucaacuauagauucaaacaaugaucccauaaaaaugaaugcuguuggugccagcagcugccagauaaauagaaccucugaaguaaaccugucauaacaugaucugacaaagugaaauauaaaaugagaaguuuuugucuuauuucagauuuuuuuauacuacaaauggugcacuggggugaaacuggggauauuuaggaaaguccaauggaagcucuugccuuccuucuuuggaaaaugaggaauaagcucaugcuuuaccaguuguuacaguuagaaaugcuggauuaaagagagggguucauuucagaaguucuguuuaucuggaagcugcugacacagcguucauuuuauggguccauaguuuaucuauaguugagacuuagcuagucaaaguugaauacuauagcuucugaaaucuagggcauaacuucucaauuacuaaaggaucuuguggaauauguucaguggaauuuuauuuagguguuaugaggcuccuugauuggucaaauauuugggaaugggccaggcaucguggcucaugucuuuagucccaguacucaggaggcagaagcaggcgauaucugugaguucagugccauccuagucgacaaagcgaguuccaagacagccaaggcuacacagagaaacccugucuugaaacaacaacaacaaacaacaaacaacaaaaacaacaacagcaacaacacccaaacccaaacagaaggaaaaggauucccucagaucuugugcuuuguuggauuuugagauuuaaaaauaaacaaacagauuucaguuuugaccuuucauccuggucauucuuuccaggugucucuuuguguggauacucuugcuauguuacuuuugccuaaaaauauacuuuuaccagccauuaucuguucuuagucuugugcuguauauguacauucauauguguccauugaaagugagcaacaacagguuaucuucuccuauugcuuuuuaacuuauuuuuuguuacauugaaccucauugaaccucgggcuugcaauuucagcuagauugguugaccauuggguccccguucugagaacccacuguuuuuguccuccauuauugugggcccagguuacagauguucacuaccuuaugcagcuuuucugucagugcuagggagcaaaacuaagguccucauguuugcaaagcaagcacuuuacccauuaagccaucuccucaauccccaccuuggguuuuuguguauuuauucguacaguauuaggaccuuuaaaaaaguucaagauugucuuaggguuuuacugcugugaacagacaccaugaccaaggcaacucuucuaaggacaacauuuaauuggagcugacuucuagguucagagauucaguccaguaucaggcaggagcauggcaguguccagguaggcugagaguucuacauuuucaucugaaggcuucuaggagaagauuggcucccagggagcuaagaugagggucuuaaaacccaugcuuacaaugacauauuuccucucacaagaccauaccuacucccaacaaggccauauacuuccuaauagugccacuccuugggccaaacauauuuaaaccaucacaaauguaaaauauaaaaaucuggggagaaaguugugagaaaagcauugucugcccuucuagugccuauucuuagcacccacaucguggcuuacagucacaaggugucugacacccucuucuggccucuguggguacugcacacaugcgguauagggauguccaugcaggcaagacacucaaacaaauaagauacaauuuaagaaaaacaauaaaaauaucucauuuaguagcaagcauuuaaaagauuuaguagcaagcauuuaaaagauuuuuagcucgucagugauggcacaugcauuuaaucucagcacuggaaagacagaaacaggcagaugucugaguuugaggauagccuggucuauauagaguuucaggacuacacauagaaaccuugucucaaaaaaguuuuuauucaggaaaguuuaugcuaugcuuuacacacacacacacacacacacacacuauuaauugggauguauuuaggcuaaugugguuuucuuaaacgccuaguuguuuaaaaugcuuugcugggaaguccuucaaaggacuuuucuaagagaaaauaauauugucuaaugugugggcuuauccauaauuaggugcugcuaaguaugccaaacacugaaggauguaguuaguauugacauacucugaauuugaaaggugaggcuucuaaaauaugcauaaagccuggggaaagauaggacuuuuucaguugguuuuacuuguuuuuguguaagagcacacacauaccacguuguggauuuuuguuaagaagcuagaaacgaacuaccuuagauuaagucauuugauuuuuguaauuuguuuacaugcaguaaaaaacaucaaaauacuugcuauacuuuuuuuguugauguauuuuauauuucauuuagacauuuuugcaagaaggaaugccuacuucugcacgaugugaugauuuagaagcuuugaaaaagaaggguugccagccaagugacauagagaaucccagaggcucucaaacuauaaagaaaaauaaaaaugucaccaaucgcagcaaagggauggcagagaagcuccggccagaagacauuacucagauccaaccacaacagcugcuucuaaaauugagaucagguaccucuaucccuaccugaguuuuccauagcaaguuuauacaagccuuuucccagucuuuugaugguucauuugggugaacugguaccccaaauagggcauaaguuaaauuuuagaggacauaaccucuuuuuguugcuuuuugcuguccuggaacuugcucgguagaccagguuggcuucagucucagagaucugcuugucuccucuucccagaugcugggauuaaagguguaugccacacuuuugauuccuggccacaauuuuuguaagacauauuacuuuuaauaauuuaaugauagagauuaaaguuaagagugaaauguucucuguguaaaggcacugcuacacaaaggugaguaacgaucuaguuuuacuuuagaguuguaaaaggaaguuacagaggugaagucauaauuacaaaaagaucaaggaaaaaaagaugaagccuaaacugaaaaaugaggaaggcgagagagguaaaaguuguuacauguuauuuacuuaaaaagcacagagcuggaaggcagcuuagugguagagcauccaucuguuaguauaauuucauaauauaaaagcaaaguuuuacuuauuuauuuaauguauaugaguacacuguagcugacuucagacguaccagaagagggcauuggaucccauuacagaugguuugagccaccaugugguugcugggaauugaacucuggaccucuggaagagcagucagugaaaagcuaaguuuuaauccauacaucguuuaguaccauuuaaauacuaacgauuuuauaagugcucauggccaucccaccucugaaauagacaacaugcccucuuucugccugucauccuuccauccuguuacugcugccuggcuaaacuucagccuaggaaauagacauuguuauaguuugaaugugaaaugucccacuuagguuccugcaugccgacuuuuguucuuggcuuguagugcuguuuugggagucuguggagccuucaguugcugaggcuugacuggcagagugugugucucugggggugggcuuuaguuuccugaguugccaagacauagagugcuguucccucuugguccugcucuaacuucugugaccuucuugaaacugagccaaaaauaaaucuucuuucuccuaaguugcaaugucaggaaaaguacuuaguacagacuucuuguacauauacuguaguggaauacuacuaucauucuuugaccugcaggauccugaucaggacauugauuauguauuugccuaagucacauuuuauuuuaaucaucauuacuuaaaaacauuuuuuagguuuacuuauuuuuuauaugcacauuuugccuguaugaauacaugcauaugugcaccguguauguaccuggugccugcagaggucagaaguuaucagaucccuuggaacugaaguaugguuaugagcugacauauguuaggaguugaaccuggguccucguaaaagcagcaagugcucuuaacuucuaagucaucucuagccccucgucguuacuccuacuguggggagcuuguaagaggcucucuucuuaaacuuaggaguccaugucacugcugguuuuucucaguuccuuccauugcuuccaauuuccuuuuuguguuuucuuccuuucauccuucugcaaauuuagguaagacuugguuuuccucucaucaucauuggaaaucaucauucagcaaugacauaagcuuuuccguuuagcucuguaccuguucuccagcugccugccaggaagucagggaaaaaagaucguuuuucaucuaagcagaccuuccauuuucucccauguuuguguuuuauuuugugguacuggagauagaauuuaggaucucucaugugcugggcaaaugcucuaccacuaagcugccuuccagcucugugcuuuuuaaguaaguaacauguaacaacuuuuaccucucucgccuuccucauuuuucaguuuaggcuucaucuuuuuuucuugaucuuuuuguaauuauggcuucaccucuguaacuuccuuuuacaacucuaaaguaaaacuagaucguuacucaccuuuguguagcagugccuuuacacagagaacauuucacucuuaacuuuaaucucuaccugucuagaauguaccuuucauucugccaaaacucaugguguucugauuuucucauaaguuuuuguguaaaucaccuugugguuacaguaacaacuacuugaaauacauguaaaaagaaaagcuuauuuugggccauaguuuuagaaguuuucaucugacggaguggccuguugcucugagcuuguggugaugugagaugucaugguggggcaucugggagauaagacagaaaggaggucccauagacuccagggcacaucacugguaacccaaaccuccugcuaguccuuaccucucaaacuucccacugccuccugaaaguaccaacacaugggcagauccaaacuguagcagaauuauuuguauuuuguggguugcuggagagggcauugccuucaucauuuuugccuccuuaggucuuggaguuguaaaugguugguuaaacgaaaucaagugugccuguugaggcgcuaacaaaauucuuagauuuggaaaaaauauacacuuaagacuauaucauugaacauguaaauuggacuuacuuuuuuucucauuuuauuuugauuacuggccaucuaauuucaguuuugaaucuuguuaauuaggagaaccacagaaguuuacauuaaaauucaagagggcugaagauuacccuauugaucucuacuaccuuauggaucucuccuacucuaugaaagaugaucuggagaaugugaaaagucuuggaacggauuugaugaaugaaaugaggaggauuacuucagacuuccgcauugguaggaauguugggaacauuuuguguguguguguguugaggggugguucugcaugugugcagagcaggcuauugagugucuuauguuaucacuuugugucucauuucugugagacacaguuuaucacuuaccuagguuuguggccuauaauuuccugucuuuuccugcagcagugcuggggugcaagguguguaugugcacgccuggccuuuuaccuggcugcuaggaucugaacuuauccucacgcuaaugcagcaggagcucuucccacagugcagucccugcagccuccauacugggcuuuagaaaaagaugugcauuuagaguuggugagagauggcucaggggauaaggguccugccuuuaagugugaugacugagcucagucuccaaaaucaguuccugcuuguccuuugaccuccagacaugcauugugguauaugugugcacauccuucacccaaauaaauaaguaaauaucaauuuaaaagugauguaaguuuguuggucucuucccacucaucuauccaaguacauucuuuucuuuaggcuuuggcucauuuguggagaaaacugugaugccguauauuagcacaaccccagcaaagcuaagaaauccuuguacaagugaacaaaacugcaccagcccauuuagcuacaaaaaugugcuuagucuuacugacagaggagaguuuuucaaugaacuuguuggucagcaacgcauaucuggaaacuuggauucuccagaagguggcuuugaugcaaucaugcagguugcgguuuguggaguaagugauuuauuucuacaggggacuguuagcauugucuguggggauuuauuuuaaguguuuuuaauaaaaguuagaacaaaaggaccauagcuacuauaagauuaccccgaggagcacugaugucaguucuuacguucccacugcugcuuucucgggugucuguaaucauugcaucucugucugagccagaaagggaguucacaccuaaggagugugaaaggccagcaugcuguuuauuugaaacaguggaacacagauagacuucagccgguuuaggauuuuggaagaggcugagguuuucaaacuuuguggcucuguacuagagauguaacugauguuaucugaggugucucuaggagcucugaacaugccauguggaauugugucucauaccauguuccucgggucaguuuucuauuuuaauaauaaaaggaaagaacuuucaaagcccugauugaugagcuauaugacaacuuuuuguaauaaaaguaguaauagaauauuuuugguuaaauuguauuguuucuaaggauaguaagccuuguucuguugcacuagggaccaguguuuaugauccauggguauuucugauugauuuuuuuuuuuccuguuuugagaaauggucuugcuguguggcccagccuauccuugaacuuguagagauguuuuugccuuuaccugaguacuggcauuccaggugugcuccaccauaccagacccucaaugaucuuuuaaugagaacugaggcugagaguagaaaacauuguuaggucaauaagguuagucuggagaaaguauaaagcguuguuuuuguggagggaggauuuuccuguccuuucuugcuccuaggcaggugacuuuguaucuuuagagcugcgccuuuuagaaaaauuaacaacagacagcccacaggacagugguaaggaccguugcagugaucuguaugaaguacacauagacacucaauauauacucaccacuguucuuauuuuugacuugcuacuguagugcucauaauuuaaaaaauaguacuucaguauaauuggccuuagccuuccuuauucucugaaaagcacucuccccacucccuacuucuaccccagucacuguguggagaacauuuucuaggcugccucugcuuuaaccagcaggcaaacugacccuauagucccgaccacccauuuucggcuaugcugccuuucugaauuugucauacuuuagagcaaaggagcaaguaaccugucuuugaaagaugauuagaaucaagaaaguuaauuucuaucuucaaugaauuuacaaacauguguuguuacuuuaaauuuagaaaauaaauguaauuaauuacauaauagaagaggguuuucacauugcuuaaauucuuuguugaguaagcuagugaaauuacaaaugaacugauuucaugagcuagaauguagggauuuaaaguacagaaagaucuuugaugauuuuucuuacaguaagaaaaugaaacuaguagguaugguggugcaugucuaaaaucucaguauuuaggaguuaggagcagggaaauuaaaaguucaagccuauccuuaacuaaacaguaaguuugaggcuagcaugaauugcauaaaaggcugcuucaaaaaaguaaagccuaguguagaagagagcugauaagguuuaauagggguauacagaaguguggguaggaacaggagucaggauugagucucuauguauucaacauagacucaguaccccugcugaaaagcagacucugaauugaggccaguaugaagaagcuauaaaguucuggaggaccaucucugcacugacagcaacauuagccuugggacaagaaagacaaugauacagaauuagguuaaaagugcaguugcagcuugacaaccugaaagcauuuauguugaguuauuaugggcagugucugcaguugacuucuuucuuuuaaagucgcugauuggcuggaggaauguaacacgacugcugguguuuuccacggaugcuggguuucacuuugcuggagaugggaaacuuggugguauuguuuuacccaaugauggacaaugucaccuggaaaauaauguauauacaaugagccauuacuauguaaguacuuaggccugccuagugagugaguuuuggugauuuuaguguaauccugagcaugugggagggcaggguuugcagcuuucuuguuuugguuagugugggcccugaugauggcugggaaagcugcauugcugcuuguaaagcucuuggcaaugugcuauucugucuggguggugggaaugcugagauccaucugguuccucacuugaauacaucauuugucagucuugcuggucauauuucuaaaugugcaauuuuuaacuaggcuuacccucuauaucuuaugacuuaaaaauacacacucuggcuuucauugaaagcaaauauaggcaaaucacucagguucuagaagaaaucuaguauuggugaaucuuagucuuaagugcuagauaaugggaaccuuuaguucugguuccuuaauuucacaguccucacauuuaaaguacauagauugucuugcuuuugaaaccucuuaaaaugggacuggagagauguucaguaguuaagagcacuuggcaacucuuccagaggaccuggguucaauucccagcagccacauggauguucacaccuuucuguaacuaucuaguuccaggguuucagauacucucacacagauauacaugcagacaaaauaccaaugaauauaaaaauaaauuauuaaaaaaugccuuaaaaaauagaaguucuuaaacauagaaaagagagacacgugacccagcuuagcacuuauuugcauuugauauucuuucuugaaagcagucugugugagugcucugauuaugaaugcuuauugacucaaauacuguacucuuagcaauugagaguaaaccuggacuauagagugagacccaaacaaaauaaacaaagccucaucauugauugcaauguauuuauauacuaaauuguauuacuuuauuccuuaggauuauccuucaauugcucaccuuguucagaaacuaagugaaaauaauauucagacgauuuuugcaguuacugaagaguuccaaccuguuuacaagguaauacaaagaaugaaaguucuauauuuuuccuauuguuuagucauuaguagcugaauuauauuuuuggaauguaagaaaaugccacaaggcauuauguucaguagcuagacugaauuugacaaccgucauuuauguucauuuuaguuguguauuauuaggauuguuauuuuaaguuugccuuugaaagauacuuaggaaaugaggugucaaaauacuacuuuucaguggauuuuaauugguugaaaaaguaauauuuauguuuuacauauuuaauuucaggaauugaagaauuugauuccuaagucagcagugggcacacugucuggaaacucuaguaaugugauccagcuaaucaucgaugccuacaacgugagugcuuuaaaugcugucagcuucaugucaugccuuaaauaaaacacccuuuauacaccucagcaagcugaagaaacuaugcaaaacgugaauuuaaauuccauggcuggaggaaaacuugauaucauuauaaucuuugaaagcacaguguaagcagagcagugguauuuagauaaaggcaugugcauaauuuccaaacuuguuuaugugucauuaggccacauaucuccucguuggaacacaacugacauuuugauguauacagguuuuauuuuaucuucuuuuucuucccuaaagccacuuuuaucgauccaucuuuuuaaguuuuauuuauuuuuucuuuuggagauuuuuuuuuuuuauguugcccugacagucuuggaauucacuauguagaccaagcuggcuuugaaugcacagagaucuaccugcgucugccucucaagugcugggaugaaagcuuugcaucuggcuagcuuucaucauuuugaugaaugaugccugacauuucuuacuuuucucguuuuucgcaagagacucagaggacacacuuuucuguuuuuaguaguaguuacacacugucaugaauguacauacauagguauaucauucaggaacugaaacuacaucagaauuuccugcagaaugcaugugauguuucccaguaagcaccagcccagucaucauuuaaaaugacccacaggcacuuacaauuucauggagucuguuaugcauuauauacaccauuuccuauauauuugguagguuaauuuagauuaaaaacuauuuuuuuaagagagagagagaaagagagaguguauguguuuguguauuauaagacaacuugugggaguuaguucucucuuaccauauggauuugggaucaaacucagguuaugaggcuugguggcaaguuuguuuuacacucugauccauccugcuagcccuagaauuuuuugagacgguaucauaugacccaggcugcccugacuucuuaguauuuccgaggaucggauccugucauguuuuugucuccaccacccagguaugcuaugucaugcuuggcuuugaacuucacauugauuucuacacaugcuuaagguuccaagacauuuuggaaagauuaugacuuagagggguuaaagacaagauucuacuucuuuuccauccucccauuccagccucucuuggcagauuguuuuccucacugcuauuccauaggggcguugucuuagugagaguuuccauugcugugaagagacaccaugaccaaggcaaacuuuuacaaaggacaacauuuaauuggugcugguuuacacuuucagagguucaguccauuaucagcauggcaggaagcauggcagugugcagguagucauggugcuggaggagcugagaguucugcaucuugaucugacugcagcuaagagaggaaggucuuuucugcauaggauugagccugagcauaggauuucaaaaccugccuacacagugacauacuucuccaacaaggccacaccucuuaauagugccauuucccaugagccaagcuuauucaaaccaccacagaugugaaugacgagagauggcuuauacuuacuaccucacuguccugagaugucugcucuuuuaaauaagcacugccugaacucuuccuugucaguuuuccccauauuuuauuuuuuauuggugcugagaaaagcugaggaccucauggcuucuagauaguguuguaccauugaguuaagcuccaguucuuuaggcucuagaaggguugggaagugagcaagaugacaguggucccaaguaaauuaguguacucuguugcuguggucucuggccagaaggaaggaggccagaggauaguuuuuggaguuguugugacacugggagcaacaaauaucuguucuguguucuuaggauuccucauaaucaggccuuuguguugugagaucauuagcauuuuagcugauuaauaaaaaguaaaugcuuucauauuguauacauuauuuugaggauuggaccuuuuuuagaguugguuauucuagguuuuuuuuuuaguuguauugaauugcauugaaaugauaguggguuuuuuuuuuuuuugagacaggguuucucuguguagcccucgcuggccucgaacucagaaaucuacaugccucugccucccaagugcugggauuaaaggcgugcaucaccacugcucugcaauaguguuuuaauaacaucuccuuucauccauuguugugugaguguauccaagucguauuuuauuuuacuucccuguucaugguuaguuuuucuuuuuuagucucuuucuucagaagucauucuggaaaauagcaaauugccagacggaguaacaauaaauuacaaauccuauugcaagaauggggugaaugggacaggagaaaauggacgaaaguguuccaacauuucuauuggagaugagguauguuguaugaccguuuucugugaaaaagaaaaacaugcauaaaaauguggggcuggagagauggcuuagcaguuaaagcacuagcauuugaaauauuuucauguucauugcuaaauuuauuaaucuuuuuuccuuuaagguucaauuugaaauuagcauaacugcuaauaaauguccaaauaaggagucugaaaccauuaaaauuaaaccucugggcuucacugaagaaguagaggucguucuucaguucaucuguaagugcaauugucaaagccauggcaucccagccagucccaagugccaugagggaaaugggacauuugaguguggagccugcagguaagugcagccuugcugcagcacaacagacaguauaggccacuuuaucugggaagccuguauaaaauaaagacacaaauccuuugcuccagucacucauauacucuuaaggaucucucuguucuuaagcuuuuagcuagguaagcaguguguccacugucucucagggcagcauuugggcuuuguucucugaauggcacuuccaguucuugacagcaaaauacauugaaaagaaaagguagauagaaacauuuuuguacaaacugucaauggugacuguauuagucaggguuuuacugcugugaauagacaccaugaccaaggcaagucuuauaaaaacaacauuuaauuggggcuggcuuacagguucagucagaaguucuguccauuaucaucaaggugagagcauggcaguaucccggcaggcauggcgcaggaggagcugagaguucuaugucuucauccaaaggcuucuaguggaagacugacuuccaggcaacuggggugaggaucuuauauccacacccacagcgacacacccauuccaaccaggucacaccuauuccaacaaggccacaccuucagauggugccacucccugguccaaggauauacaaaccaucacagugacuuuuuaaauuuuguuuuauuuuggaugacccuaaauuuaugaucuuacugucucaguacuuggguuauaggcagaacucaauacucucaguguuaaaugacaguuuuaucugugacuuaguuaacaagaaaaauguuuaccauguccaggauuaaauuuuguauuucugggauaaaaauaaaauaguacuuaaaguuuacauuuauguauguauguauguauguauguauguauauguguguaugugaguguguguguauacccuagugucuuggcacaggcuuguggugagaacaguuguaagaguugguucucugucuaccuugugaauccuaagguugucagguuuggugacaaguaccuuuaccuucaccagacuucuuggcuacuuuuuauguuaaaaacuaaacuguguuuguaauacagccuuuucuuuaaaguaauagaaccuuuuaaucuaaaugucagucucacaucacagugguuuuguuuauuggcccaaagaaaaaugaauagcuaauguuuacuauuaauugcccauuuuaagcaaugauuuaaauauuguguuuuuucuguuauauuuaacuugagacauuaagauaucuuuuuguuuaaacagcauuuuaucaaaaaggauuuuuuaaaaauucuuugucuucuuuuugauuagcauaugcaaaaucaguuuauccaguguccaagaacaugcuccaagauauguaggauauuuuagaagucuagaucugugcaguaaacuuacccuuaguuaaagcuaguacuauuuucaguuuguguacuuuauguauuuuucaacuuuugggguugcauucauugcuauuuuuuauccuaacagacccuugcuucaaauuuaguggcagguagucuguaacaauaauauaauugaaaauauuugagaaucuagcccugcaaauugauacauuccuuuauuccccugcauuugggaacuagaggcaggcagacucuguggucaaaguuagccuggucuauuuuucuauuuuucuaguuguuuuguuguuuguugcuggaguaugcuuucauuuugcucagagugguuccuugcuaaagguaaauuuuccccaaggcuccuguauguucuauaagaacuugaguugcuacuugcauguguguauauauaaacacaguggacuuaucuuauguuuguacauguggagugagcaucccuacuugauacuuugcuaaugugaggaaauuguuacacuuuuuguuuuaugugacuguguuuggaucuuucugcaggugcaaugaggggcguguugggaggcacugugaauguagcacagaugaagugaacagugaagacauggacgcuuacugcaggaaagagaacaguucggaaaucugcaguaacaauggagaaugugucuguggacaguguguguguaggaagagagauaauacaaaugaaauuuacucuggaaaauucugcgagugugauaacuucaacugugauaggucuaauggcuuaauuuguggagguggguaagcaccagcaguagcuacacacauaguuccucuaaugagaucagauaucugagagucucuggguuaacacacagaaggggaggggcuuucuucuauguuguggcuuguuuuuaauuugugaauaauugcugugauuauacauuuuaccauuguuuugagaaaugaucuuuuucguugcaggcaauggcgugugcaggugucguguuugugaaugcuaucccaauuacacuggcagugcaugugacuguucuuuggacacugguccaugucuagcgucaaauggucagaucugcaauggccgggguauuugugaauguggugcuuguaagugcacagaucccaaguuucaagggccaacuugugagacaugucagaccugccuuggcgucugugcagagcauaaguaaguacugccaaaguguuucacauagucacauucacuuuacugacccuacaccacuagagccagaggagagugcugauagaguauacuucaaagagaauauuugcugccuuuuauguaccauuuuuuauguccuaaaaauucuuaauuguguaacaaugaagugugccaugagaguuguacuauuuuuuuuguuguuguuuguuuuuaaucugaaaucacuguauaaguuugcuguuaguuggcaauacuauccucuguuuuuaagguuuagugguagagauaaaacaaugaacucuaccauagaggaauauucucuagucuaguugcuaucuuuugcuucaggagaauggaaggugaauuauuauaccaauacugcuuaaguuauugugguuuuuauguuacaaauuuaaugugacauagguccaguuuuauuaacuacaucuuaauuuuguguugugaagauuuauaugcauacaugugaauguauguaugugugugugggcuaucaccaagggcuuagaguagauuuuaauauaugucccccacgucugcaaugugcuacuuguuggucuuagacauaccuguuagagguuugucauggacaugcuggugucuuuacaaaaaggauucacaguguaggccuaauuggcaucuguguagcaaccauagcugugcucuggaugccagggucuguacuggaugcugagcagguccccauagcugacuaggaaguaagguuugugaauccgauguugggugaacucuucuugauaaggcuugguguuacuaggccccauagucacuggccuuuacugaagcuccuuauuccuccaguggagggcacaugcuucaggcagcuucuguagccagaggcuuccugggugcuuugcuacugccaguggacuuaguccaaggugggucuggagaauuuauuaccuaccccuuuauucuuugacagguuugccagccagaguguugcuggccuuaguggccguggcuuggcugaggcugcuggaaaccaggaucucauguggagcauaaugccuauuuccucugaauguauauugcccuuagauugguauggccauuaguuuagcacaugaaguauucuaagcaaaguuaaucuuaauacacgcuaaguguaacaauuucugucuuagagaauguguucagugcagagccuucaauaaaggagaaaagaaagacacgugugcacaggagugcucccacuucaaucucaccaaaguagaaagcagggagaaguugccccagccggugcaggucgauccugugacccauugcaaggagaaggacauugaugacugcugguucuauuucaccuauucagugaauggcaacaaugaagcuaucgugcauguuguggagacuccagguagaagucagaggaugccuagcauuguuucuuaugaugccuugcuuuuauucugagucauugcugggguucugguggcagaaacagccuguauucuuaucuuacuauuuauauuagguuuauauugggauauuuucuucucaaagcuuaaaguagaauuuggcuaauuauauaacaacuaaggaaggaaucaaguuuauguaaauggaacccaugcuauacuguuggugcuauuuaaaucugagcuugauccagcuuuaggagccggaagaagauauccuaaagauauuauuaauguugaauuuguucaacuucccggaaacuaagcacauuucaccuuuguuuuccuaguagccuuccuugucacucugucagguuucugguauggacacauuuuagaggaugugguaaacgucuguucaguguuacaggaaaugcuccaacuuuuacuucuuuuuacaaaugcuuuuaguguuugaaaaaagagaggacaacuuuguggaauuguuucucuuuugcuggauggguuccugagcaucagacacauguggucagucuuguuagcaagugccuuuacccacugagcccucuuguggucucugcauuguucugcagcaccagacaggagcacugugaauacuguuguaugugccucuguguuuuuccauugccuuagcaauuuuugaacacaggggcuuuauugcuguuuuugugguggugugcagugaacccaggguguugcaauaguggcuuccugauuuauuucuacaguguuaaugaugagacuuugauugacauggcaauagauuacagauuaaauuggggaaaaugcaucuugauaaaauacugucuuuuuaaaaauuaauuuaguaugugggcagaggguuaggguuaggguuagaggguuuuuuucaugugccauggauuucuccaauuaccccagucauuuuuauuugcuugaggacagucuuaccauguagcccuuggccagucuggaacuaacaaccuacauuaggcuacuucgaaguuguggcaaucuugcagccucugccacuugaaugcuaaccuauacuaccaugucuggcugccaaucaucuuuacuacugucuuuuaucauuacuuaguacuuuauaaucuugaaaaaauauuuuaauuauauauaagcuuuucauuauuuuugaugcuguuacgauuuuuuuuuaacauuuuucagucuuuagcuaaagaaauagauuuuaugacccccaaauaaaugaccugcugaucauauuuucuacugucuucuaagcucccuuguuagagccuaguagcuucuuuuuguuugagacagggucuuaccuugucuggucuggaacucacuuuguagaucaggcugaccucaaacuccuagaacuccauuuugagauuaaagguaugugccaccacaccuagccuggaacuuaguagcuuuuaaauagguuuuugggacagugcagucucuugaguguucagcacuauuaauuuuguaagaucccauccaacucuuuguggucaugugaacuuuguauauacucagucuuuuuaugcucacgauuaaccuuuucauuuguagacuguccuacuggucccgacaucaucccaauuguagcaggcgugguugcuggaauuguucuuauuggccuugccuugcugcugauuuggaaacuuuuaaugauaauucaugacagaagggaauuugcuaaauuugaaaaggagaaaaugaaugccaagugggacacgguaaguuaugaaacauuacugagagcaguaggaugguuccugaaguaaauguaacuuauuaauggugaggcugaccuuuaaagucuucuuuaaauauuuuauuucccccaaaguucaaaauccaaagaaguugcauuugcugaaaacaagaaaccuccuauucaauuaauaauuuaggaggauaugauacucuguauauauaguggccauuguguuuuaguucuuuaguaggucagauucuaaguaugcuccucagcucauuugucuaauauaaaagagaaucuuaaaugauaccaccagugucucuggccacacuagagcuccucuuccccuccauacacucaugauucuuuucauaugguuucuggaauauacaaccaaauuguuauuucuaaggcuagacugaggggagggcugacuagaaggugggauuacaacaggccuucuuagaugauuucuagguguguuugcacauuuggaaauacucagccugagcuuaauguauauuuuacucucuucagauugcaucucuguaaaaacuugcuuaauagaaaaacaggcuuugacugguaugugcugaucacugguuucagaauagagucagguaguuggauaaauguugccucuuauagauuuacauuuugacacacuacaguuagguuguuuuuuguuuuguuuuguuuuguuuugaaauuucagaaguauagaaauagaauuccaguuuauagugucaauacacuauacauuccaauuuucuuucugaugaaaucacuagaaacuauuucuuucacuuuagcaagaaaauccgauuuacaagaguccuauuaauaauuucaagaauccaaacuauggacguaaagcuggucucugaguuuccguucguauuucuuuucacuuucuauccuugcaugugaauuucugucucucuuuuuuuuuacugcaccaugugugugucucaacaccacugcuuuuuuuucuuuuuuggguuuggcuuuauuuuuauggcuauguguggcuuuucucauauguuaacuuagugcuuggaaggacuuuaccauauaauaagguauagaagccaccccuguguuggagagaaaagaaugcuuugcagucacagagccccaaucuacccuagacuugcuuaguaaguagagcagcccugagcuuuguuaccucucugaggcuccucuuaagucuucagcagggaggauuuuaacugacagcuggcugcagucuacuaugcaaucucugaugcaguccuguucaaaggucaugguacauuauuccugaauugaacagugaaauugagugugaaaucaaaauggcaaaaccaaggguaaaugacuguuguguaguuuguacugucacaguuacaauucauuuuacccauucuagaaagauucugaaaguuuuuucguucuugauuaugugggaauuccauuccacugagaaacagaguaccauuguguuucuuacuaguucugauuuucaaguuuaaaacugaaaacugcuuauuuuuauuauuaucuuucaaacaauucuuauuauuuauuuauuuauuuuugcuugagagaaagucuuacuauguagcccaggcuaucuuggauuuugcuguguacacuaggcuagccuugaccucacagacauuuuugccucucuuaaaacucccauaaaaaggcugauuacauuuagcaccaaauuauuuucuauggauuggaagagccugggagaauuccuguuuucuuaucuccauuuucugucaacagagacaauguuggcaauagcuacagagucccguguuuuaggaaugguucuuaauauccuauauuuuuuguuauuugcgagaauaauggggacuauauucuuguuuuauagaagagaagacugaggcagaaaaacagcuaguuaguaaaaagagauuuaaguucagacuaugggauuccaacacuuaugucccuauccucugcccuggacccauuagcagguuagcaaucacauucuuuaggagaggguuaccuggucaggaagaaauagaacacuuuacagaucuggccauuuucauaguguugugauuugggguaaugcuauuguguagagaaaaucucuuacacacuguguggaagcaucaccugucaauaaaaagcuguuugcaugaagcaggaaauagaagguaggauauuugggagggagagggagagggagagagaggcuucugggaaagagccaagagcaggaaauucacccugaacucugaggaagucagaucuaugaaacugagaagaaaccagacacauagcugaacucagauuagaauaaauggguuauauaaguuaugagcuaauugaggaauaagcccaagcuuauagcccuauuuauaaauaagucuuagagucauauuucuagguacaaacaccuagggagaaaaguuccuggcuucccugcugggcaaacauaaugggagaaucacuuuucuacuacacagaacucagcacugcuguuaugcuuacuuauucuguauugaccuuggaaagccaaauugaagggcuacaggauguauaaucacuuaagcagugaaucagucaauuaaaaugaaagacuugcagaaaaccccaaaucagggaguguuguauauuuuuaagggacacaggaagcagcagcaguacuagaaaucaugacucgcuguaucucuuuuacugcuaagaaacuuuuauuuaaggcuaguuuguugguagaaaguuauuguuaaaucgugugugugaaacuugaugcauucuuucacucuuaccugauacuuuacagaacuuaauuuuuauagaaaagcugauuagcuagugagauuacugugauuuuauuuauuuauuaucuuuguggucacaaucagguauuaacaguuucauauaguuacuucucacagaagaauuuucacuuuuuuuuccugugguaaauuauuugcccuuccuuuaaugacacuuugaguaauauuaaucaauaguuacuauuuaauacuaaauguuuguauucuugauuuaauuuuuggcuaucaggguuaggguuaccuucuuuagcuagaauaaacauuucauacaauuaaaaaagcaaggguuucuuaaaauuuauuuauguauuauugaaaucuaagaaaauuuauggcuauagauuaucccaagauguuaucuuaugaauauuauaguagaaaugaacaauacaaaugaaugagaguaaaacuaucagaaaaaaaaucauauaaaaacauuuuuuugugauaagggaccaaaacuucuuaccaauuaauuacaccauuagcagacacuguaauuaugugagcauauaagacugccauguugggacacugacaaaauucucaggucugcccuucccugcugugaacuacaaaccucccaguuuucauugcauaucucacauaccucacauauauaaguacacauacauaaguaauuuacagccaccacuaucagcugcucauaguagacaaagagggacucaccccaaaggauagccuacacuuuagaugcaaauaugcuuuggcuucuuggggcaggggcuguaccgagugauggaacuaaucugaauuacuuuagccuaccuacuuuuaaacugauaccuaaugcauauuauagugaguuuaucucuaacuugcauguuaaauuuuuguuugauuguacuuugacauagugaauauaaauguuaguauguauggcaaaccaaacuuauccaaagguaaguguuuuccauauaaauucugcuuuagacuccaugauaauaaauccugaacuucucuccuuuuauauuuugcuuuauguuuuguucccuuauuauucuuaagcaguaaauacuagauuuuguuaaaugcuuuaacuuaaagacaguuaaauaguaguuuaguagccuaauauauuugaaaacaggcaguucuagcaucacacccaggaaguuggaaaccucuuaccugaaugaaugcuguaugaaugaaugcugaaugaaggaugcuguaaaccccaaacagccagcaagcugggaucuugagauugugagcaguuuuguugucaguguaauagaauguuuguugaugaaucuuguaucacuuacuuuuuccauuggucuaacgagaaaagauuuacucagguucacaauuagaggguacagucugccauaguggaauaguuaacagcagguggagcuuggggcuccugaucaaaucaaagugacagaugauggggcucagcucacuuucuccuuuuauacaguauucaagcucaggaaaugauucuacucauagugggcauccugccuuaaguaacguaauccagacaugccagagacuggucccccaguuugcaucauguuguuuuaucauaauacuugugauaaacaugguugugauaaacaccaugacuuaaaagcaacuugaagaaaugaaaggguuuauuugguuuacugguaucaucagaggaaacuaaagcaggaacaugggguaggcaccuggaggccuccagagaaguucuuacugcuguguaguaacauacuuuuccugacauacucagcugccuuuugaauacaucccaggccuaccugcccagggguggcaccacauacaguggggcuggauucuccuaacuaauuaacaaucaagaaaaugcccacaggccaguauuguuggagacaaucuuuuaauuaagauccccucuuccaaggagaccuuaguuugugucaagaugacagaaacuaaccagcauuccaccacagacccuuugugcgcagaaaaguuauguuugaggaguggaagugagugaucaggugugcggucuuguucugacugguauuuacaaagcugcugccaucuugguagaugcccucucugccuuccucuagucucugcuccauucccaguaccucagaauauauuuuucaauuucaaaugaaguggauguaucucuacaucuggcauucuuuguauuuguuuuuuuaguaauuucuauguagucaguuucccuauggaaguauucuuaaacuucucauguuaauaacccuaacccuuuuucuaguacucuuuauauuauguauauaauucuaaucugaacucucagauuaccuuauuucauaucccuccauacuauacucucuucaagggcaaaauuaugauuauauaauuaugauagcuguuguucugauuaaaauacuguaguauauuuuucaauccugagaaauguuuguugugguuucgaguccguugcugaauuugcagcuguucucacucaaggaguagaacugugauuaacauuacccuuagguuauugaagaauaacaauuucaugaagcaugguuauuaguuaacauuguaagcauauuuuuggauugugacuugaugggcagagugccuugggugacacuggcagacauauccagaaaucaguucuauagagguuucaggagcacaucuccuucccuggauggaagccagccacccuauaauaaguauuucuaagcauuagaguguauaaguuagguuuuuaggguuuccauaaguugguacaagaucuucagagacucuaauggcagcuguaaagguucuguguggaggccuuuugugagguagcccucuagggaugacggacuggagucagagcacaauauuuuaauagccugagacuuuugggucagagcuggccuucucaccacugugucggauuuuaucuuugccuucuaaacucuauuugacacuggauauuggaagagacuuauuaagacaacugcagcuauuaaucuuguuuuggaacacugauuuuagagaguaacuggcaauuuguguuuuuuuuagggugaaaauccuauuuacaagagugccgugacaacuguggucaauccgaaguaugagggaaaaugaauccuacucaggcggauuuugcaacaccaagcucacagcagcagcaucuuagucacaguaggguaguuuuggggcucuguggccaggguuuuauucacaugcagguuuggaaaauguacaauauguauaauuuuuaauuuuuuauuauuuugaaaauaauguuauaauccaugccagggacugacagaagacuugagaaaggaucuuuauccuugucagcugaggucacagugugccuuuuuaacccuuccuucuggaccauuggaaucaagcucucacuagauugaaugacacugcuagugccaaugcagggcagagcugagcagcgucgcagcaucugaaccaugacugauuuucagcuucacaggguggccagggcugguuauacagaaucaaagaacaguccuugcugguggcuuuguucuuuguuuagccugcuggcugcccucugggaauucccagugauguauguggaagacaagaguguugacaguuuccaauuaaaauaaaauugacacaguugauguucaaguccauuggaaaaauucugagaggugggaaggaaaucuuagcuuuaaaaccugugugccauugugaguuacuugauccuguaacuccgacgccuuuucuuuauaaauccaaccuuggauaaaaguacugggaacuucucugcuaaaaagucccugacuuagcacuauucacauaaaggccauaauuuuaguagcauugcugaguggggaccuuuuggguugagcuuauuuuaccuuuuuuuuuuucuuuaauuccuggugcuccuuuaucaccuucucuaaucuuuuaaugugucuguuugcaauauggggguuagacuuuuuaucauuaccuuuucuuuuccuuggcuguacauuuaccuuuuucacaaauacuguaagcuguccugcugcuugcaggacuacagggccugggcagggccccccagcaacaauucacccacagugcaccugcacaugccuuuccuacaugcuugcucugucucgaacuagucacaaucuuguuuuaagugccuuuucauuuugacagugcuauuaacugaaguuauuuauuaaaauaaaaaggccuaaauacauuaagugauuuguuuuggcucuguauuuuuauuaguuuugugcauuuuuauguguuaaagauaugguagagaaacguggcucaaaccacuuaagccaaaaugacucauuuuagacauguggggaguggguaguagaacagauuuuaguuagguguuuuauucuuacguuagcagaacauuuuaugaauaucauuuuaggcuacuagaugcuggagaacuaauaguuaagagagggguuguauuuucauucuuaggaagaacuagggaaaucuuaacuuucuuuugguuuuaguuuauuuuucuguaaaacuauuuccauaaaaacacuuguguaagguuuaaaagaacuuggguuggcaaagugucuuaauggguaaaaucucuugc

SEQ ID NO: 4910 - RNA, 47928 nt, Mus musculus
gcaagagauuuuacccauuaagacacuuugccaacccaaguucuuuuaaaccuuacacaaguguuuuuauggaaauaguuuuacagaaaaauaaacuaaaaccaaaagaaaguuaagauuucccuaguucuuccuaagaaugaaaauacaaccccucucuuaacuauuaguucuccagcaucuaguagccuaaaaugauauucauaaaauguucugcuaacguaagaauaaaacaccuaacuaaaaucuguucuacuacccacuccccacaugucuaaaaugagucauuuuggcuuaagugguuugagccacguuucucuaccauaucuuuaacacauaaaaaugcacaaaacuaauaaaaauacagagccaaaacaaaucacuuaauguauuuaggccuuuuuauuuuaauaaauaacuucaguuaauagcacugucaaaaugaaaaggcacuuaaaacaagauugugacuaguucgagacagagcaagcauguaggaaaggcaugugcaggugcacugugggugaauuguugcuggggggcccugcccaggcccuguaguccugcaagcagcaggacagcuuacaguauuugugaaaaagguaaauguacagccaaggaaaagaaaagguaaugauaaaaagucuaacccccauauugcaaacagacacauuaaaagauuagagaaggugauaaaggagcaccaggaauuaaagaaaaaaaaaaagguaaaauaagcucaacccaaaagguccccacucagcaaugcuacuaaaauuauggccuuuaugugaauagugcuaagucagggacuuuuuagcagagaaguucccaguacuuuuauccaagguuggauuuauaaagaaaaggcgucggaguuacaggaucaaguaacucacaauggcacacagguuuuaaagcuaagauuuccuucccaccucucagaauuuuuccaauggacuugaacaucaacugugucaauuuuauuuuaauuggaaacugucaacacucuugucuuccacauacaucacugggaauucccagagggcagccagcaggcuaaacaaagaacaaagccaccagcaaggacuguucuuugauucuguauaaccagcccuggccacccugugaagcugaaaaucagucaugguucagaugcugcgacgcugcucagcucugcccugcauuggcacuagcagugucauucaaucuagugagagcuugauuccaaugguccagaaggaaggguuaaaaaggcacacugugaccucagcugacaaggauaaagauccuuucucaagucuucugucagucccuggcauggauuauaacauuauuuucaaaauaauaaaaaauuaaaaauuauacauauuguacauuuuccaaaccugcaugugaauaaaacccuggccacagagccccaaaacuacccuacugugacuaagaugcugcugcugugagcuugguguugcaaaauccgccugaguaggauucauuuucccucauacuucggauugaccacaguugucacggcacucuuguaaauaggauuuucacccuaaaaaaaacacaaauugccaguuacucucuaaaaucaguguuccaaaacaagauuaauagcugcaguugucuuaauaagucucuuccaauauccagugucaaauagaguuuagaaggcaaagauaaaauccgacacaguggugagaaggccagcucugacccaaaagucucaggcuauuaaaauauugugcucugacuccaguccgucaucccuagagggcuaccucacaaaaggccuccacacagaaccuuuacagcugccauuagagucucugaagaucuuguaccaacuuauggaaacccuaaaaaccuaacuuauacacucuaaugcuuagaaauacuuauuauaggguggcuggcuuccauccagggaaggagaugugcuccugaaaccucuauagaacugauuucuggauaugucugccagugucacccaaggcacucugcccaucaagucacaauccaaaaauaugcuuacaauguuaacuaauaaccaugcuucaugaaauuguuauucuucaauaaccuaaggguaauguuaaucacaguucuacuccuugagugagaacagcugcaaauucagcaacggacucgaaaccacaacaaacauuucucaggauugaaaaauauacuacaguauuuuaaucagaacaacagcuaucauaauuauauaaucauaauuuugcccuugaagagaguauaguauggagggauaugaaauaagguaaucugagaguucagauuagaauuauauacauaauauaaagaguacuagaaaaaggguuaggguuauuaacaugagaaguuuaagaauacuuccauagggaaacugacuacauagaaauuacuaaaaaaacaaauacaaagaaugccagauguagagauacauccacuucauuugaaauugaaaaauauauucugagguacugggaauggagcagagacuagaggaaggcagagagggcaucuaccaagauggcagcagcuuuguaaauaccagucagaacaagaccgcacaccugaucacucacuuccacuccucaaacauaacuuuucugcgcacaaagggucugugguggaaugcugguuaguuucugucaucuugacacaaacuaaggucuccuuggaagaggggaucuuaauuaaaagauugucuccaacaauacuggccugugggcauuuucuugauuguuaauuaguuaggagaauccagccccacuguauguggugccaccccugggcagguaggccugggauguauucaaaaggcagcugaguaugucaggaaaaguauguuacuacacagcaguaagaacuucucuggaggccuccaggugccuaccccauguuccugcuuuaguuuccucugaugauaccaguaaaccaaauaaacccuuucauuucuucaaguugcuuuuaagucaugguguuuaucacaaccauguuuaucacaaguauuaugauaaaacaacaugaugcaaacugggggaccagucucuggcaugucuggauuacguuacuuaaggcaggaugcccacuaugaguagaaucauuuccugagcuugaauacuguauaaaaggagaaagugagcugagccccaucaucugucacuuugauuugaucaggagccccaagcuccaccugcuguuaacuauuccacuauggcagacuguacccucuaauugugaaccugaguaaaucuuuucucguuagaccaauggaaaaaguaagugauacaagauucaucaacaaacauucuauuacacugacaacaaaacugcucacaaucucaagaucccagcuugcuggcuguuugggguuuacagcauccuucauucagcauucauucauacagcauucauucagguaagagguuuccaacuuccugggugugaugcuagaacugccuguuuucaaauauauuaggcuacuaaacuacuauuuaacugucuuuaaguuaaagcauuuaacaaaaucuaguauuuacugcuuaagaauaauaagggaacaaaacauaaagcaaaauauaaaaggagagaaguucaggauuuauuaucauggagucuaaagcagaauuuauauggaaaacacuuaccuuuggauaaguuugguuugccauacauacuaacauuuauauucacuaugucaaaguacaaucaaacaaaaauuuaacaugcaaguuagagauaaacucacuauaauaugcauuagguaucaguuuaaaaguagguaggcuaaaguaauucagauuaguuccaucacucgguacagccccugccccaagaagccaaagcauauuugcaucuaaaguguaggcuauccuuuggggugagucccucuuugucuacuaugagcagcugauagugguggcuguaaauuacuuauguauguguacuuauauaugugagguaugugagauaugcaaugaaaacugggagguuuguaguucacagcagggaagggcagaccugagaauuuugucagugucccaacauggcagucuuauaugcucacauaauuacagugucugcuaaugguguaauuaauugguaagaaguuuuggucccuuaucacaaaaaaauguuuuuauaugauuuuuuuucugauaguuuuacucucauucauuuguauuguucauuucuacuauaauauucauaagauaacaucuugggauaaucuauagccauaaauuuucuuagauuucaauaauacauaaauaaauuuuaagaaacccuugcuuuuuuaauuguaugaaauguuuauucuagcuaaagaagguaacccuaacccugauagccaaaaauuaaaucaagaauacaaacauuuaguauuaaauaguaacuauugauuaauauuacucaaagugucauuaaaggaagggcaaauaauuuaccacaggaaaaaaaagugaaaauucuucugugagaaguaacuauaugaaacuguuaauaccugauugugaccacaaagauaauaaauaaauaaaaucacaguaaucucacuagcuaaucagcuuuucuauaaaaauuaaguucuguaaaguaucagguaagagugaaagaaugcaucaaguuucacacacacgauuuaacaauaacuuucuaccaacaaacuagccuuaaauaaaaguuucuuagcaguaaaagagauacagcgagucaugauuucuaguacugcugcugcuuccugugucccuuaaaaauauacaacacucccugauuugggguuuucugcaagucuuucauuuuaauugacugauucacugcuuaagugauuauacauccuguagcccuucaauuuggcuuuccaaggucaauacagaauaaguaagcauaacagcagugcugaguucuguguaguagaaaagugauucucccauuauguuugcccagcagggaagccaggaacuuuucucccuagguguuuguaccuagaaauaugacucuaagacuuauuuauaaauagggcuauaagcuugggcuuauuccucaauuagcucauaacuuauauaacccauuuauucuaaucugaguucagcuaugugucugguuucuucucaguuucauagaucugacuuccucagaguucagggugaauuuccugcucuuggcucuuucccagaagccucucucucccucucccucucccucccaaauauccuaccuucuauuuccugcuucaugcaaacagcuuuuuauugacaggugaugcuuccacacaguguguaagagauuuucucuacacaauagcauuaccccaaaucacaacacuaugaaaauggccagaucuguaaaguguucuauuucuuccugaccagguaacccucuccuaaagaaugugauugcuaaccugcuaauggguccagggcagaggauagggacauaaguguuggaaucccauagucugaacuuaaaucucuuuuuacuaacuagcuguuuuucugccucagucuucucuucuauaaaacaagaauauaguccccauuauucucgcaaauaacaaaaaauauaggauauuaagaaccauuccuaaaacacgggacucuguagcuauugccaacauugucucuguugacagaaaauggagauaagaaaacaggaauucucccaggcucuuccaauccauagaaaauaauuuggugcuaaauguaaucagccuuuuuaugggaguuuuaagagaggcaaaaaugucugugaggucaaggcuagccuaguguacacagcaaaauccaagauagccugggcuacauaguaagacuuucucucaagcaaaaauaaauaaauaaauaauaagaauuguuugaaagauaauaauaaaaauaagcaguuuucaguuuuaaacuugaaaaucagaacuaguaagaaacacaaugguacucuguuucucaguggaauggaauucccacauaaucaagaacgaaaaaacuuucagaaucuuucuagaauggguaaaaugaauuguaacugugacaguacaaacuacacaacagucauuuacccuugguuuugccauuuugauuucacacucaauuucacuguucaauucaggaauaauguaccaugaccuuugaacaggacugcaucagagauugcauaguagacugcagccagcugucaguuaaaauccucccugcugaagacuuaagaggagccucagagagguaacaaagcucagggcugcucuacuuacuaagcaagucuaggguagauuggggcucugugacugcaaagcauucuuuucucuccaacacagggguggcuucuauaccuuauuauaugguaaaguccuuccaagcacuaaguuaacauaugagaaaagccacacauagccauaaaaauaaagccaaacccaaaaaagaaaaaaaagcagugguguugagacacacacauggugcaguaaaaaaaaagagagacagaaauucacaugcaaggauagaaagugaaaagaaauacgaacggaaacucagagaccagcuuuacguccauaguuuggauucuugaaauuauuaauaggacucuuguaaaucggauuuucuugcuaaagugaaagaaauaguuucuagugauuucaucagaaagaaaauuggaauguauaguguauugacacuauaaacuggaauucuauuucuauacuucugaaauuucaaaacaaaacaaaacaaaacaaaaaacaaccuaacuguagugugucaaaauguaaaucuauaagaggcaacauuuauccaacuaccugacucuauucugaaaccagugaucagcacauaccagucaaagccuguuuuucuauuaagcaaguuuuuacagagaugcaaucugaagagaguaaaauauacauuaagcucaggcugaguauuuccaaaugugcaaacacaccuagaaaucaucuaagaaggccuguuguaaucccaccuucuagucagcccuccccucagucuagccuuagaaauaacaauuugguuguauauuccagaaaccauaugaaaagaaucaugaguguauggaggggaagaggagcucuaguguggccagagacacuggugguaucauuuaagauucucuuuuauauuagacaaaugagcugaggagcauacuuagaaucugaccuacuaaagaacuaaaacacaauggccacuauauauacagaguaucauauccuccuaaauuauuaauugaauaggagguuucuuguuuucagcaaaugcaacuucuuuggauuuugaacuuugggggaaauaaaauauuuaaagaagacuuuaaaggucagccucaccauuaauaaguuacauuuacuucaggaaccauccuacugcucucaguaauguuucauaacuuaccgugucccacuuggcauucauuuucuccuuuucaaauuuagcaaauucccuucugucaugaauuaucauuaaaaguuuccaaaucagcagcaaggcaaggccaauaagaacaauuccagcaaccacgccugcuacaauugggaugaugucgggaccaguaggacagucuacaaaugaaaagguuaaucgugagcauaaaaagacugaguauauacaaaguucacaugaccacaaagaguuggaugggaucuuacaaaauuaauagugcugaacacucaagagacugcacugucccaaaaaccuauuuaaaagcuacuaaguuccaggcuaggugugguggcacauaccuuuaaucucaaaauggaguucuaggaguuugaggucagccugaucuacaaagugaguuccagaccagacaagguaagacccugucucaaacaaaaagaagcuacuaggcucuaacaagggagcuuagaagacaguagaaaauaugaucagcaggucauuuauuugggggucauaaaaucuauuucuuuagcuaaagacugaaaaauguuaaaaaaaaaucguaacagcaucaaaaauaaugaaaagcuuauauauaauuaaaauauuuuuucaagauuauaaaguacuaaguaaugauaaaagacaguaguaaagaugauuggcagccagacaugguaguauagguuagcauucaaguggcagaggcugcaagauugccacaacuucgaaguagccuaauguagguuguuaguuccagacuggccaagggcuacaugguaagacuguccucaagcaaauaaaaaugacugggguaauuggagaaauccauggcacaugaaaaaaacccucuaacccuaacccuaacccucugcccacauacuaaauuaauuuuuaaaaagacaguauuuuaucaagaugcauuuuccccaauuuaaucuguaaucuauugccaugucaaucaaagucucaucauuaacacuguagaaauaaaucaggaagccacuauugcaacacccuggguucacugcacaccaccacaaaaacagcaauaaagccccuguguucaaaaauugcuaaggcaauggaaaaacacagaggcacauacaacaguauucacagugcuccugucuggugcugcagaacaaugcagagaccacaagagggcucaguggguaaaggcacuugcuaacaagacugaccacaugugucugaugcucaggaacccauccagcaaaagagaaacaauuccacaaaguuguccucucuuuuuucaaacacuaaaagcauuuguaaaaagaaguaaaaguuggagcauuuccuguaacacugaacagacguuuaccacauccucuaaaauguguccauaccagaaaccugacagagugacaaggaaggcuacuaggaaaacaaaggugaaaugugcuuaguuuccgggaaguugaacaaauucaacauuaauaauaucuuuaggauaucuucuuccggcuccuaaagcuggaucaagcucagauuuaaauagcaccaacaguauagcauggguuccauuuacauaaacuugauuccuuccuuaguuguuauauaauuagccaaauucuacuuuaagcuuugagaagaaaauaucccaauauaaaccuaauauaaauaguaagauaagaauacaggcuguuucugccaccagaaccccagcaaugacucagaauaaaagcaaggcaucauaagaaacaaugcuaggcauccucugacuucuaccuggagucuccacaacaugcacgauagcuucauuguugccauucacugaauaggugaaauagaaccagcagucaucaauguccuucuccuugcaaugggucacaggaucgaccugcaccggcuggggcaacuucucccugcuuucuacuuuggugagauugaagugggagcacuccugugcacacgugucuuucuuuucuccuuuauugaaggcucugcacugaacacauucucuaagacagaaauuguuacacuuagcguguauuaagauuaacuuugcuuagaauacuucaugugcuaaacuaauggccauaccaaucuaagggcaauauacauucagaggaaauaggcauuaugcuccacaugagauccugguuuccagcagccucagccaagccacggccacuaaggccagcaacacucuggcuggcaaaccugucaaagaauaaagggguagguaauaaauucuccagacccaccuuggacuaaguccacuggcaguagcaaagcacccaggaagccucuggcuacagaagcugccugaagcaugugcccuccacuggaggaauaaggagcuucaguaaaggccagugacuauggggccuaguaacaccaagccuuaucaagaagaguucacccaacaucggauucacaaaccuuacuuccuagucagcuauggggaccugcucagcauccaguacagacccuggcauccagagcacagcuaugguugcuacacagaugccaauuaggccuacacugugaauccuuuuuguaaagacaccagcauguccaugacaaaccucuaacagguaugucuaagaccaacaaguagcacauugcagacgugggggacauauauuaaaaucuacucuaagcccuuggugauagcccacacacacauacauacauucacauguaugcauauaaaucuucacaacacaaaauuaagauguaguuaauaaaacuggaccuaugucacauuaaauuuguaacauaaaaaccacaauaacuuaagcaguauugguauaauaauucaccuuccauucuccugaagcaaaagauagcaacuagacuagagaauauuccucuaugguagaguucauuguuuuaucucuaccacuaaaccuuaaaaacagaggauaguauugccaacuaacagcaaacuuauacagugauuucagauuaaaaacaaacaacaacaaaaaaaauaguacaacucucauggcacacuucauuguuacacaauuaagaauuuuuaggacauaaaaaaugguacauaaaaggcagcaaauauucucuuugaaguauacucuaucagcacucuccucuggcucuagugguguagggucaguaaagugaaugugacuaugugaaacacuuuggcaguacuuacuuaugcucugcacagacgccaaggcaggucugacaugucucacaaguuggcccuugaaacuugggaucugugcacuuacaagcaccacauucacaaauaccccggccauugcagaucugaccauuugacgcuagacauggaccaguguccaaagaacagucacaugcacugccaguguaauugggauagcauucacaaacacgacaccugcacacgccauugccugcaacgaaaaagaucauuucucaaaacaaugguaaaauguauaaucacagcaauuauucacaaauuaaaaacaagccacaacauagaagaaagccccuccccuucuguguguuaacccagagacucucagauaucugaucucauuagaggaacuauguguguagcuacugcuggugcuuacccaccuccacaaauuaagccauuagaccuaucacaguugaaguuaucacacucgcagaauuuuccagaguaaauuucauuuguauuaucucucuuccuacacacacacuguccacagacacauucuccauuguuacugcagauuuccgaacuguucucuuuccugcaguaagcguccaugucuucacuguucacuucaucugugcuacauucacagugccucccaacacgccccucauugcaccugcagaaagauccaaacacagucacauaaaacaaaaaguguaacaauuuccucacauuagcaaaguaucaaguagggaugcucacuccacauguacaaacauaagauaaguccacuguguuuauauauacacacaugcaaguagcaacucaaguucuuauagaacauacaggagccuuggggaaaauuuaccuuuagcaaggaaccacucugagcaaaaugaaagcauacuccagcaacaaacaacaaaacaacuagaaaaauagaaaaauagaccaggcuaacuuugaccacagagucugccugccucuaguucccaaaugcaggggaauaaaggaauguaucaauuugcagggcuagauucucaaauauuuucaauuauauuauuguuacagacuaccugccacuaaauuugaagcaagggucuguuaggauaaaaaauagcaaugaaugcaaccccaaaaguugaaaaauacauaaaguacacaaacugaaaauaguacuagcuuuaacuaaggguaaguuuacugcacagaucuagacuucuaaaauauccuacauaucuuggagcauguucuuggacacuggauaaacugauuuugcauaugcuaaucaaaaagaagacaaagaauuuuuaaaaaauccuuuuugauaaaaugcuguuuaaacaaaaagauaucuuaaugucucaaguuaaauauaacagaaaaaacacaauauuuaaaucauugcuuaaaaugggcaauuaauaguaaacauuagcuauucauuuuucuuugggccaauaaacaaaaccacugugaugugagacugacauuuagauuaaaagguucuauuacuuuaaagaaaaggcuguauuacaaacacaguuuaguuuuuaacauaaaaaguagccaagaagucuggugaagguaaagguacuugucaccaaaccugacaaccuuaggauucacaagguagacagagaaccaacucuuacaacuguucucaccacaagccugugccaagacacuaggguauacacacacacucacauacacacauauacauacauacauacauacauacauacauaaauguaaacuuuaaguacuauuuuauuuuuaucccagaaauacaaaauuuaauccuggacaugguaaacauuuuucuuguuaacuaagucacagauaaaacugucauuuaacacugagaguauugaguucugccuauaacccaaguacugagacaguaagaucauaaauuuagggucauccaaaauaaaacaaaauuuaaaaagucacugugaugguuuguauauccuuggaccagggaguggcaccaucugaagguguggccuuguuggaauaggugugaccugguuggaaugggugugucgcuguggguguggauauaagauccucaccccaguugccuggaagucagucuuccacuagaagccuuuggaugaagacauagaacucucagcuccuccugcgccaugccugccgggauacugccaugcucucaccuugaugauaauggacagaacuucugacugaaccuguaagccagccccaauuaaauguuguuuuuauaagacuugccuuggucauggugucuauucacagcaguaaaacccugacuaauacagucaccauugacaguuuguacaaaaauguuucuaucuaccuuuucuuuucaauguauuuugcugucaagaacuggaagugccauucagagaacaaagcccaaaugcugcccugagagacaguggacacacugcuuaccuagcuaaaagcuuaagaacagagagauccuuaagaguauaugagugacuggagcaaaggauuugugucuuuauuuuauacaggcuucccagauaaaguggccuauacugucuguugugcugcagcaaggcugcacuuaccugcaggcuccacacucaaaugucccauuucccucauggcacuugggacuggcugggaugccauggcuuugacaauugcacuuacagaugaacugaagaacgaccucuacuucuucagugaagcccagagguuuaauuuuaaugguuucagacuccuuauuuggacauuuauuagcaguuaugcuaauuucaaauugaaccuuaaaggaaaaaagauuaauaaauuuagcaaugaacaugaaaauauuucaaaugcuagugcuuuaacugcuaagccaucucuccagccccacauuuuuaugcauguuuuucuuuuucacagaaaacggucauacaacauaccucaucuccaauagaaauguuggaacacuuucguccauuuucuccugucccauucaccccauucuugcaauaggauuuguaauuuauuguuacuccgucuggcaauuugcuauuuuccagaaugacuucugaagaaagagacuaaaaaagaaaaacuaaccaugaacagggaaguaaaauaaaauacgacuuggauacacucacacaacaauggaugaaaggagauguuauuaaaacacuauugcagagcaguggugaugcacgccuuuaaucccagcacuugggaggcagaggcauguagauuucugaguucgaggccagcgagggcuacacagagaaacccugucucaaaaaaaaaaaaaacccacuaucauuucaaugcaauucaauacaacuaaaaaaaaaaccuagaauaaccaacucuaaaaaagguccaauccucaaaauaauguauacaauaugaaagcauuuacuuuuuauuaaucagcuaaaaugcuaaugaucucacaacacaaaggccugauuaugaggaauccuaagaacacagaacagauauuuguugcucccagugucacaacaacuccaaaaacuauccucuggccuccuuccuucuggccagagaccacagcaacagaguacacuaauuuacuugggaccacugucaucuugcucacuucccaacccuucuagagccuaaagaacuggagcuuaacucaaugguacaacacuaucuagaagccaugagguccucagcuuuucucagcaccaauaaaaaauaaaauauggggaaaacugacaaggaagaguucaggcagugcuuauuuaaaagagcagacaucucaggacagugagguaguaaguauaagccaucucucgucauucacaucuguggugguuugaauaagcuuggcucaugggaaauggcacuauuaagagguguggccuuguuggagaaguaugucacuguguaggcagguuuugaaauccuaugcucaggcucaauccuaugcagaaaagaccuuccucucuuagcugcagucagaucaagaugcagaacucucagcuccuccagcaccaugacuaccugcacacugccaugcuuccugccaugcugauaauggacugaaccucugaaaguguaaaccagcaccaauuaaauguuguccuuuguaaaaguuugccuuggucauggugucucuucacagcaauggaaacucucacuaagacaacgccccuauggaauagcagugaggaaaacaaucugccaagagaggcuggaaugggaggauggaaaagaaguagaaucuugucuuuaaccccucuaagucauaaucuuuccaaaaugucuuggaaccuuaagcauguguagaaaucaaugugaaguucaaagccaagcaugacauagcauaccugggugguggagacaaaaacaugacaggauccgauccucggaaauacuaagaagucagggcagccugggucauaugauaccgucucaaaaaauucuagggcuagcaggauggaucagaguguaaaacaaacuugccaccaagccucauaaccugaguuugaucccaaauccauaugguaagagagaacuaacucccacaaguugucuuauaauacacaaacacauacacucucucuuucucucucucucuuaaaaaaauaguuuuuaaucuaaauuaaccuaccaaauauauaggaaaugguguauauaaugcauaacagacuccaugaaauuguaagugccugugggucauuuuaaaugaugacugggcuggugcuuacugggaaacaucacaugcauucugcaggaaauucugauguaguuucaguuccugaaugauauaccuauguauguacauucaugacaguguguaacuacuacuaaaaacagaaaaguguguccucugagucucuugcgaaaaacgagaaaaguaagaaaugucaggcaucauucaucaaaaugaugaaagcuagccagaugcaaagcuuucaucccagcacuugagaggcagacgcagguagaucucugugcauucaaagccagcuuggucuacauagugaauuccaagacugucagggcaacauaaaaaaaaaaaaucuccaaaagaaaaaauaaauaaaacuuaaaaagauggaucgauaaaaguggcuuuagggaagaaaaagaagauaaaauaaaaccuguauacaucaaaaugucaguuguguuccaacgaggagauauguggccuaaugacacauaaacaaguuuggaaauuaugcacaugccuuuaucuaaauaccacugcucugcuuacacugugcuuucaaagauuauaaugauaucaaguuuuccuccagccauggaauuuaaauucacguuuugcauaguuucuucagcuugcugagguguauaaaggguguuuuauuuaaggcaugacaugaagcugacagcauuuaaagcacucacguuguaggcaucgaugauuagcuggaucacauuacuagaguuuccagacagugugcccacugcugacuuaggaaucaaauucuucaauuccugaaauuaaauauguaaaacauaaauauuacuuuuucaaccaauuaaaauccacugaaaaguaguauuuugacaccucauuuccuaaguaucuuucaaaggcaaacuuaaaauaacaauccuaauaauacacaacuaaaaugaacauaaaugacgguugucaaauucagucuagcuacugaacauaaugccuuguggcauuuucuuacauuccaaaaauauaauucagcuacuaaugacuaaacaauaggaaaaauauagaacuuucauucuuuguauuaccuuguaaacagguuggaacucuucaguaacugcaaaaaucgucugaauauuauuuucacuuaguuucugaacaaggugagcaauugaaggauaauccuaaggaauaaaguaauacaauuuaguauauaaauacauugcaaucaaugaugaggcuuuguuuauuuuguuugggucucacucuauaguccagguuuacucucaauugcuaagaguacaguauuugagucaauaagcauucauaaucagagcacucacacagacugcuuucaagaaagaauaucaaaugcaaauaagugcuaagcugggucacgugucucucuuuucuauguuuaagaacuucuauuuuuuaaggcauuuuuuaauaauuuauuuuuauauucauugguauuuugucugcauguauaucugugugagaguaucugaaacccuggaacuagauaguuacagaaaggugugaacauccauguggcugcugggaauugaacccagguccucuggaagaguugccaagugcucuuaacuacugaacaucucuccagucccauuuuaagagguuucaaaagcaagacaaucuauguacuuuaaaugugaggacugugaaauuaaggaaccagaacuaaagguucccauuaucuagcacuuaagacuaagauucaccaauacuagauuucuucuagaaccugagugauuugccuauauuugcuuucaaugaaagccagaguguguauuuuuaagucauaagauauagaggguaagccuaguuaaaaauugcacauuuagaaauaugaccagcaagacugacaaaugauguauucaagugaggaaccagauggaucucagcauucccaccacccagacagaauagcacauugccaagagcuuuacaagcagcaaugcagcuuucccagccaucaucagggcccacacuaaccaaaacaagaaagcugcaaacccugcccucccacaugcucaggauuacacuaaaaucaccaaaacucacucacuaggcaggccuaaguacuuacauaguaauggcucauuguauauacauuauuuuccaggugacauuguccaucauuggguaaaacaauaccaccaaguuucccaucuccagcaaagugaaacccagcauccguggaaaacaccagcagucguguuacauuccuccagccaaucagcgacuuuaaaagaaagaagucaacugcagacacugcccauaauaacucaacauaaaugcuuucagguugucaagcugcaacugcacuuuuaaccuaauucuguaucauugucuuucuugucccaaggcuaauguugcugucagugcagagaugguccuccagaacuuuauagcuucuucauacuggccucaauucagagucugcuuuucagcagggguacugagucuauguugaauacauagagacucaauccugacuccuguuccuacccacacuucuguauaccccuauuaaaccuuaucagcucucuucuacacuaggcuuuacuuuuuugaagcagccuuuuaugcaauucaugcuagccucaaacuuacuguuuaguuaaggauaggcuugaacuuuuaauuucccugcuccuaacuccuaaauacugagauuuuagacaugcaccaccauaccuacuaguuucauuuucuuacuguaagaaaaaucaucaaagaucuuucuguacuuuaaaucccuacauucuagcucaugaaaucaguucauuuguaauuucacuagcuuacucaacaaagaauuuaagcaaugugaaaacccucuucuauuauguaauuaauuacauuuauuuucuaaauuuaaaguaacaacacauguuuguaaauucauugaagauagaaauuaacuuucuugauucuaaucaucuuucaaagacagguuacuugcuccuuugcucuaaaguaugacaaauucagaaaggcagcauagccgaaaauggguggucgggacuauagggucaguuugccugcugguuaaagcagaggcagccuagaaaauguucuccacacagugacugggguagaaguagggaguggggagagugcuuuucagagaauaaggaaggcuaaggccaauuauacugaaguacuauuuuuuaaauuaugagcacuacaguagcaagucaaaaauaagaacaguggugaguauauauugagugucuauguguacuucauacagaucacugcaacgguccuuaccacuguccugugggcugucuguuguuaauuuuucuaaaaggcgcagcucuaaagauacaaagucaccugccuaggagcaagaaaggacaggaaaauccucccuccacaaaaacaacgcuuuauacuuucuccagacuaaccuuauugaccuaacaauguuuucuacucucagccucaguucucauuaaaagaucauugagggucugguaugguggagcacaccuggaaugccaguacucagguaaaggcaaaaacaucucuacaaguucaaggauaggcugggccacacagcaagaccauuucucaaaacaggaaaaaaaaaaaucaaucagaaauacccauggaucauaaacacuggucccuagugcaacagaacaaggcuuacuauccuuagaaacaauacaauuuaaccaaaaauauucuauuacuacuuuuauuacaaaaaguugucauauagcucaucaaucagggcuuugaaaguucuuuccuuuuauuauuaaaauagaaaacugacccgaggaacaugguaugagacacaauuccacauggcauguucagagcuccuagagacaccucagauaacaucaguuacaucucuaguacagagccacaaaguuugaaaaccucagccucuuccaaaauccuaaaccggcugaagucuaucuguguuccacuguuucaaauaaacagcaugcuggccuuucacacuccuuaggugugaacucccuuucuggcucagacagagaugcaaugauuacagacacccgagaaagcagcagugggaacguaagaacugacaucagugcuccucgggguaaucuuauaguagcuaugguccuuuuguucuaacuuuuauuaaaaacacuuaaaauaaauccccacagacaaugcuaacaguccccuguagaaauaaaucacuuacuccacaaaccgcaaccugcaugauugcaucaaagccaccuucuggagaauccaaguuuccagauaugcguugcugaccaacaaguucauugaaaaacucuccucugucaguaagacuaagcacauuuuuguagcuaaaugggcuggugcaguuuuguucacuuguacaaggauuucuuagcuuugcugggguugugcuaauauacggcaucacaguuuucuccacaaaugagccaaagccuaaagaaaagaauguacuuggauagaugagugggaagagaccaacaaacuuacaucacuuuuaaauugauauuuacuuauuuauuugggugaaggaugugcacacauauaccacaaugcaugucuggaggucaaaggacaagcaggaacugauuuuggagacugagcucagucaucacacuuaaaggcaggacccuuauccccugagccaucucucaccaacucuaaaugcacaucuuuuucuaaagcccaguauggaggcugcagggacugcacugugggaagagcuccugcugcauuagcgugaggauaaguucagauccuagcagccagguaaaaggccaggcgugcacauacacaccuugcaccccagcacugcugcaggaaaagacaggaaauuauaggccacaaaccuagguaagugauaaacugugucucacagaaaugagacacaaagugauaacauaagacacucaauagccugcucugcacacaugcagaaccaccccucaacacacacacacacaaaauguucccaacauuccuaccaaugcggaagucugaaguaauccuccucauuucauucaucaaauccguuccaagacuuuucacauucuccagaucaucuuucauagaguaggagagauccauaagguaguagagaucaauaggguaaucuucagcccucuugaauuuuaauguaaacuucugugguucuccuaauuaacaagauucaaaacugaaauuagauggccaguaaucaaaauaaaaugagaaaaaaaguaaguccaauuuacauguucaaugauauagucuuaaguguauauuuuuuccaaaucuaagaauuuuguuagcgccucaacaggcacacuugauuucguuuaaccaaccauuuacaacuccaagaccuaaggaggcaaaaaugaugaaggcaaugcccucuccagcaacccacaaaauacaaauaauucugcuacaguuuggaucugcccauguguugguacuuucaggaggcagugggaaguuugagagguaaggacuagcaggagguuuggguuaccagugaugugcccuggagucuaugggaccuccuuucugucuuaucucccagaugccccaccaugacaucucacaucaccacaagcucagagcaacaggccacuccgucagaugaaaacuucuaaaacuauggcccaaaauaagcuuuucuuuuuacauguauuucaaguaguuguuacuguaaccacaaggugauuuacacaaaaacuuaugagaaaaucagaacaccaugaguuuuggcagaaugaaagguacauucuagacagguagagauuaaaguuaagagugaaauguucucuguguaaaggcacugcuacacaaaggugaguaacgaucuaguuuuacuuuagaguuguaaaaggaaguuacagaggugaagccauaauuacaaaaagaucaagaaaaaaagaugaagccuaaacugaaaaaugaggaaggcgagagagguaaaaguuguuacauguuacuuacuuaaaaagcacagagcuggaaggcagcuuagugguagagcauuugcccagcacaugagagauccuaaauucuaucuccaguaccacaaaauaaaacacaaacaugggagaaaauggaaggucugcuuagaugaaaaacgaucuuuuuucccugacuuccuggcaggcagcuggagaacagguacagagcuaaacggaaaagcuuaugucauugcugaaugaugauuuccaaugaugaugagaggaaaaccaagucuuaccuaaauuugcagaaggaugaaaggaagaaaacacaaaaaggaaauuggaagcaauggaaggaacugagaaaaaccagcagugacauggacuccuaaguuuaagaagagagccucuuacaagcuccccacaguaggaguaacgacgaggggcuagagaugacuuagaaguuaagagcacuugcugcuuuuacgaggacccagguucaacuccuaacauaugucagcucauaaccauacuucaguuccaagggaucugauaacuucugaccucugcaggcaccagguacauacacggugcacauaugcauguauucauacaggcaaaaugugcauauaaaaaauaaguaaaccuaaaaaauguuuuuaaguaaugaugauuaaaauaaaaugugacuuaggcaaauacauaaucaauguccugaucaggauccugcaggucaaagaaugauaguaguauuccacuacaguauauguacaagaagucuguacuaaguacuuuuccugacauugcaacuuaggagaaagaagauuuauuuuuggcucaguuucaagaaggucacagaaguuagagcaggaccaagagggaacagcacucuaugucuuggcaacucaggaaacuaaagcccacccccagagacacacacucugccagucaagccucagcaacugaaggcuccacagacucccaaaacagcacuacaagccaagaacaaaagucggcaugcaggaaccuaagugggacauuucacauucaaacuauaacaaugucuauuuccuaggcugaaguuuagccaggcagcaguaacaggauggaaggaugacaggcagaaagagggcauguugucuauuucagaggugggauggccaugagcacuuauaaaaucguuaguauuuaaaugguacuaaacgauguauggauuaaaacuuagcuuuucacugacugcucuuccagagguccagaguucaauucccagcaaccacaugguggcucaaaccaucuguaaugggauccaaugcccucuucugguacgucugaagucagcuacaguguacucauauacauuaaauaaauaaguaaaacuuugcuuuuauauuaugaaauuauacuaacagauggaugcucuaccacuaagcugccuuccagcucugugcuuuuuaaguaaauaacauguaacaacuuuuaccucucucgccuuccucauuuuucaguuuaggcuucaucuuuuuuuccuugaucuuuuuguaauuaugacuucaccucuguaacuuccuuuuacaacucuaaaguaaaacuagaucguuacucaccuuuguguagcagugccuuuacacagagaacauuucacucuuaacuuuaaucucuaucauuaaauuauuaaaaguaauaugucuuacaaaaauuguggccaggaaucaaaaguguggcauacaccuuuaaucccagcaucugggaagaggagacaagcagaucucugagacugaagccaaccuggucuaccgagcaaguuccaggacagcaaaaagcaacaaaaagagguuauguccucuaaaauuuaacuuaugcccuauuugggguaccaguucacccaaaugaaccaucaaaagacugggaaaaggcuuguauaaacuugcuauggaaaacucagguagggauagagguaccugaucucaauuuuagaagcagcuguugugguuggaucugaguaaugucuucuggccggagcuucucugccaucccuuugcugcgauuggugacauuuuuauuuuucuuuauaguuugagagccucugggauucucuaugucacuuggcuggcaacccuucuuuuucaaagcuucuaaaucaucacaucgugcagaaguaggcauuccuucuugcaaaaaugucuaaaugaaauauaaaauacaucaacaaaaaaaguauagcaaguauuuugauguuuuuuacugcauguaaacaaauuacaaaaaucaaaugacuuaaucuaagguaguucguuucuagcuucuuaacaaaaauccacaacgugguaugugugugcucuuacacaaaaacaaguaaaaccaacugaaaaaguccuaucuuuccccaggcuuuaugcauauuuuagaagccucaccuuucaaauucagaguaugucaauacuaacuacauccuucaguguuuggcauacuuagcagcaccuaauuauggauaagcccacacauuagacaauauuauuuucucuuagaaaaguccuuugaaggacuucccagcaaagcauuuuaaacaacuaggcguuuaagaaaaccacauuagccuaaauacaucccaauuaauaguguguguguguguguguguguguguaaagcauagcauaaacuuuccugaauaaaaacuuuuuugagacaagguuucuauguguaguccugaaacucuauauagaccaggcuauccucaaacucagacaucugccuguuucugucuuuccagugcugagauuaaaugcaugugccaucacugacgagcuaaaaaucuuuuaaaugcuugcuacuaaaucuuuuaaaugcuugcuacuaaaugagauauuuuuauuguuuuucuuaaauuguaucuuauuuguuugagugucuugccugcauggacaucccuauaccgcaugugugcaguacccacagaggccagaagagggugucagacaccuugugacuguaagccacgaugugggugcuaagaauaggcacuagaagggcagacaaugcuuuucucacaacuuucuccccagauuuuuauauuuuacauuugugaugguuuaaauauguuuggcccaaggaguggcacuauuaggaaguauauggccuuguugggaguagguauggucuugugagaggaaauaugucauuguaagcauggguuuuaagacccucaucuuagcucccugggagccaaucuucuccuagaagccuucagaugaaaauguagaacucucagccuaccuggacacugccaugcuccugccugauacuggacugaaucucugaaccuagaagucagcuccaauuaaauguuguccuuagaagaguugccuuggucauggugucuguucacagcaguaaaacccuaagacaaucuugaacuuuuuuaaagguccuaauacuguacgaauaaauacacaaaaacccaagguggggauugaggagauggcuuaauggguaaagugcuugcuuugcaaacaugaggaccuuaguuuugcucccuagcacugacagaaaagcugcauaagguagugaacaucuguaaccugggcccacaauaauggaggacaaaaacaguggguucucagaacggggacccaauggucaaccaaucuagcugaaauugcaagcccgagguucaaugagguucaauguaacaaaaaauaaguuaaaaagcaauaggagaagauaaccuguuguugcucacuuucaauggacacauaugaauguacauauacagcacaagacuaagaacagauaauggcugguaaaaguauauuuuuaggcaaaaguaacauagcaagaguauccacacaaagagacaccuggaaagaaugaccaggaugaaaggucaaaacugaaaucuguuuguuuauuuuuaaaucucaaaauccaacaaagcacaagaucugagggaauccuuuuccuucuguuuggguuuggguguuguugcuguuguuguuuuuguuguuuguuguuuguuguuguuguuucaagacaggguuucucuguguagccuuggcugucuuggaacucgcuuugucgacuaggauggcacugaacucacagauaucgccugcuucugccuccugaguacugggacuaaagacaugagccacgaugccuggcccauucccaaauauuugaccaaucaaggagccucauaacaccuaaauaaaauuccacugaacauauuccacaagauccuuuaguaauugagaaguuaugcccuagauuucagaagcuauaguauucaacuuugacuagcuaagucucaacuauagauaaacuauggacccauaaaaugaacgcugugucagcagcuuccagauaaacagaacuucugaaaugaaccccucucuuuaauccagcauuucuaacuguaacaacugguaaagcaugagcuuauuccucauuuuccaaagaaggaaggcaagagcuuccauuggacuuuccuaaauauccccaguuucaccccagugcaccauuuguaguauaaaaaaaucugaaauaagacaaaaacuucucauuuuauauuucacuuugucagaucauguuaugacagguuuacuucagagguucuauuuaucuggcagcugcuggcaccaacagcauucauuuuuaugggaucauuguuugaaucuauaguugaaacuuaccuagucagaguugaucuuacaaguccaaacagcugagugaagacauauacaaagaaccuuugaccuaacauaaccucaaauuaauucaauacaauuuuaguaagcauuauagaagggacaaaguacauuaaucuuuaagcaaacucugaacucaaauuugcauauauuuccuuucacugaaguuaguuaggcuuugagcuuucaaauucccacaacuuucccaguuagcucucucuaccucauagugucaaucaggauguaagcuuuuaacuacugccccagcuccaugucugucugucuggggcaaugcucaaagccaugacggccauggacugacacucugcuuugagccgcaaauuaaauguuuuguuuguuuguuuuauaaguuaccuuaagaaugguuuuuugucacaacaaauaaaauuaacuaagacaaguauuuugucaaacagcauaauucugacuacuauacacuauucaauaaacauuaauuaaaaugguauaucuuaucugacacuucccaaggacaaggcucugaauaagucuaaaaaucagagaauaaauagaacaguaucagaaaucuuaccguauuuguacaccacccacaauuuggcccugcuuguauacauucuccgcaagauuuggcauuugcuuuuaaacaucuauuuuuaucuguuagaaaagaaacaaaaacacuguacuuuucaguaucuuuaaaguuucaaagggaaaaaaaugaaaagaucacaagaaaaacagagaccaggaauaugcaaauaaacauacauguuaaaaaugaacaaaugcagcccaguuacuaagcuauaccaggcuacuccaaagaaaaccuaaugaccugggguccccuugacacugagaaccacaaacggcaaucaucuugucuuuuugcaugacacacuaguacuaauaccauuagccuagcuacacaccauuagaccauacuguugacacuguaauuucagcaccuauuguucugcggguuauaaauguccugguacucuuauaccuaggucagguauugccuuuuccuuaugacugacaaucucaugcccauaccacauaaaugucuucagggcuuccacuccacuuuuaguauguuaaauaacugccaagcccauauucauccaacucauaaccaauugagcuuucauuucuuugacucaaucuagacuggcacauuuuuacuuguaguaaauacuagaaagacugucuccaguuuucugauuagaauauaaacuaugcuugaagugaaaaauuuaagauaaccacccuaccaauuuuagguguguccucaggauacaguuucugggggcuguagauuuuauguaucauuuccuacucaguaucuuucaucauuuucacauguccaucuugagaugagauaauucuaauuauuuuauauacuaugcuuuuuuaagacauagacaguagaacaagggaugguuaugguugucagagaaauuuaaacuaucuucagcuuguuaccugcucuuauagauaugcuaauacaagacuucuugaucacagaacaagaauuucuucuagaaaguaaacuucugaguuuucuuccucuucuucuucuuccuccuccuucuuccuucucucucucucucuaguuuuuugguuuuguuuuuuuucuuuuugccacuccaaacauagagcuuugacugaacuauauuccaacccucuaggauuuuuuuaauuugggggauggagaaggggggguuguaucuagcacaggcuagccuaaaacucaugauucuccugacuauuucugccuuccaagugcuaggauuacaggcaugugccaccauguccagccuacuuucccuuuuuagaugcuaauggacacacuuucguuguaauccaccaaaguggauauuuauuuuauuugcuucuaaauauauuacaugucucugccuuuguucuggucccucuccagcacucucacauucuccaauuauuuuuguguggucuaugacauacugucaugugagcucucacaauccucacacugaagucagggaugauuaacugauaaugaagaccccugcaggcuccuuggaaaccuguuuuucauucacagugagacgaugcugcaaauuuucaggaguguugugaucugauggaggguugcccuucccucuagaaucuaacugaccaaugacuauugauacaagaugcugaaauaaaaagauaacaacaacaacaacaacaacaaaaaaccaagaaccuuuuuuuuuaccuguuuggccaaauacagaacaaaucaaacugaucaauccaauccaggaaaccaguugcaaauucaucuauaacagaaaauguauauuauuauugauagagaaaauauuacauuccaccuucccuucuuuuucuucucaaucuauuucucuccaaacaucucuacacugccaucugccuuucuuccagaugguuaccuuucaccuacuucacaccacacuugcagaauguguuucugucgucucuaaaugaaaugucuuagcauucaauuaaacauuacaaaauuacauacauucuaaagaaaccaaaguuaguauuccuacagcagaaagcuguggcggcuuguccuguagaauguccaucuacacagucuccuggggcucucaaccuaauaggcacauccagaggcccaguuaccucagaaccaagaguacuuuccagcacugaaucauucaucccaugcugacaacgcaaagaguuuuuauuucuccucaggcuaaaacaugaauucauauucaagguucugacucauuuuuucugugugcuuugcuguuauuuuuuuucuuuuguaagaaaauuaacuaugcaugggauugguaaaauacucagcuugauucccucaacuuucuacagcaaaaugccuuauuaaaccaagaaucuguauuguccuuuagaaucucaggguuaggaggugaggaggaaagagaucagauaauauucuauguauuaaacaggcaacuucuauucauucucucuauuucuauucaaccaauguuuucauuccuaaccaaauguguucaaagacagcugagacugcagacuacucagcuaacauguuaacugccuucuguucauaggcauguccagucuagugcacaugcauacacaucugacucacccacagaaugaaagcagaguaaggaaugcuggcaugggcauaaucccagaauuuaagaggcagaggcaggagaauuaccauaaguuuaaggccagucugaucuacacagaaaaauucugucuugaaacccaggaaaagaaagaacauugggaaaguggaggcaggagaaucagacguauaaguucaucauccuucccuagaugguaaguucaagaccuaucuuuaaaaaaaaagaaagaaaagaaaagaaaagaaaaggaaaggaaaggaaaggaacgggaagggaagggaagggaagggaagggaagggaagggaagggaagggaagggaagggaagggaagggaagggaagggaagggaagggaagggaagggaagggaagggaagggaagggaagggaagggaagggaagggaagggaagggaagggaaggaaaggaaagguucuuuaguucuauuuuaacccugaguauuucuuuuaaagaacagcucuucccaaagcacagaaaacuuugcucuggucucaggucccuuucauaugagaaguaaaggcagacaugcuacugugcauugagacaugguccuaaucuuaagauaaacacuucugcuccacugcucaccuagacuucccagagacaagagagguagcucugggagucauccacccgcaaucaggcuuccuccaggaaaugagucucuccuggggcugacagguugaugcagauagcuugggacugcauccaagaagugaauaaaaccugagugucacaaauguaugauguucuaaggguuaggguuacaauguuguaaaucauuacagguugaaauucucaacaauuucaauagagccacugaugacuaaggacagagaacgugucacuccaguggaaguggaugaucacaguaugaggauggauauacuccuucaggcuaccuuaauacuugcugaucagccuugagaaaucuuccaaaauaccauacaagucagagagacaaacuaugauagaaugaaaaagauaauguuccccaauauucugaaauacauuacuuuaaaccauuacuguaagugccacagaccucugcuucuuuguauccugauaggccaaagaaccuacuuacuaaagcccucauaccucuggaagugugccaccacgcucagaagaagacaaaacaaaguucuaguguucaagaacugcugagagaacuaggacugucuccaaacaucuuggagauagucaucaacucuucuguaaggaucuguaagccagcaggaaacagaggagcuauugcuugguggcuuucauaaaugcuggguuuuagggacaggaagaaguaagaauucagcaggacucuaaggacaaugacaguaaugagaaagcaagagcugggagcaugagacugagaccauacuugagaguggcccuuagggaggcggcacaacuggaaucuggaccaaagugccugcccgaggcagaaugggggaaggcuugagaaagacuacaucacaguucacguggauguccuucucagacauaaagcuauaacauauaaccuugggcuaugcgaggccugucaacaaaugacucuauacagagaaauggggcuuagagguucccuagcaauggcaucucacugaagacaacucuucaucaucuaugaggauuauuucuaaagauuaaaguauguuguagaaacagucaaaaugaaacuuauagaaagugacuaugguuuugugugugucaucaaauuuuuaaagucaaaacuaaauaaccucagauaaaaucagggcuugauucuguuuauaacaauaagguuuccuuaaauauugaucuauucugauaugcucuuuaaaauguuaacaagugaucgcuuaaaaaaacaaauacuuuuaauugugacaacuaaaaugcagaacuaguuacagucuuuuucaagaguaagaaaaaccagauauuuauuucauaaacaacuccauucugacuggacaacaagauucuauccagauauaucuuaccuacuccuagauuacaaaugaaaucagcuuucugauucacguuucuuacauuaaauacacaauaccuucaucugagaguauaagcauaaucucauuuagaaaauucuggcugauacucaagugccccauguaauauaauguaaacauuucucuaacuuuuuuguuucuuaaaauccuuuuagaauucgauaucuuuguguauuuaguauuucacuugguauacucauaagugauaaauuaaugcuaaucuuguuuuuauugaauucaugauauuuuuccuuucuuuccccccaucccucccacucgauccagcccauagguuuuuuauuuguuucucauuaaggaugguuguuagccaccauguagauucugguauuugaacucaugacuuccggaagagcagucagugcucuuaacugcugagccaucucaccagccccaauauccuuccuuucauaaucaucuuuuuuguuaugacuuuuuacuuauccuaaacaucuaccuuauuuaaaucuuguuuucauguuuagaacauucacaaauauuuuuguguuuuuuaaggaaaaaacucauuauucgcuuuuaucuggguuaaagaaaucuaguuuuucaacugauaaaaacauuucaacaacaacaaaaaccaaaaacccacucuccaguuuggaaguaguguauuuuaaauccaaauuauuacugccaaaaaauacaaccaauuagacuacuucaggguuguuguuguuguuguugcuguuaacuucauuaguccagacaauauucuugauuauuuuaaauuucauauauuacucuaauauagaucccauguuauaucaaauauagacaguugaaaaucagaucuggggcuggagagauggcucagcaguuaagagcacuggcuacucuuccagagguccugaguucaauuuccagcauccacaugguggcucacaaccaucuguaaugggauucaaugcccucuucugauaugucugaagacagcuacaaauguacgcauaaacauaaaaaguauaaaccuuaaaaaaaaaaaagaugucccaccaugccacaggggcauguguuccacuaaguucauagcggccuuauuuaugauagccagaagcuggaaacaaccuagaugucccacggcagaagaauagauacagaaaaugugguucauuuaccaauggaauauucuacucagcuauauccugaguuuugcagacaaauggauggaacuagaaaauaucauccaagugagguaacucugacccaaaaggacaugcaugguauauacucacuaguaaguggauauuagcaaaaaaaaaaaaaaaaaaaaaaacagaauauccaaaauacaguccacagaacucaaaggucaaaaggucaacaagcugaagugcccagugaggaugacucagucccacuugggagagagaagaaaccaaucacaaguggggggggggggggggggggaaggagggaccugggagggaaaguggagggggagagggagaccuaucugguauugggugagggaaaaggacugaagcccugagggccagcagaaaagaauggaaacaggcaaccucaggaaauaggagguuggagggaucccccagaaugcaccagagaccuaggagguaaaauacucucaggaaucaaagggagggaccuuagaugaaauaacugacaguagggagagggaacuuacagagcccaccuccaguaggaagacagggcaucaagugagaaugggguugccaucccagucaucucugaccuauaguuguuccugucuaaaagaauuacagggauggaaauggagaggagccugagguaaagaaggucuagugacaggcccaaagugggauucagcucaaggggagguccaaaaccugacacuauuacugaggcuauggagcgcucacaaaaaaagagaccuaucaugacugcccuccgaaagacccaauaagcagcugaaagagucagaugcagauauuugcacccaacuaauggacagaagcaccugacuucuauuguugaauuagggaaggcugaaagaagcugaggagaaggacgauccuguaggaggaccagcagucucaauuaaucuggaccuccaagaucacucaaacacuggaccacaaaacagacagcauacaccagcugauaugagguccccaacacacacacaguaaaggacuucccggucuguguucauucagagaugaugcaccuaacccucaagagacuggaggucccagggaguuuaaaggucaagugggguggggggugaggucauccacauggagggaggagggaggugugagaugaggagcugucagaggguagaugagggaugugguggggaauggaauauggaguuuaaaaaauaaauuaauuuaauaaaaaauaaauuaaaaaaucagaucugaaccauaauggcuauuagauuuuaaugauauaaucuagaagguuuuuuuuucucccuuuaauggcuuuuaccauauguucuaguuugcuuuauguugcugugauaaaacacugaccaaaaccaacuugggaggaaaggaaguguaaaagguuuuauacuuccagguccaucacugaaggaagucagcacaagcacgaacucacucacucacagaggaacacuguuugcugggcugcuuccucugguuugcucagguaucagcccaggucuaccagccuagggacagcacagcugguaauggaacgggccaaacuacgucaauuagcaaucaaaaaaaugccccagaaacaugcccacaagccaauccagaagaagaauacucuuccacugaaguucccucuuucuagaugacucuagguuuguguuagguugacagcugaagcuaugauaccagguauucuucuccccuuaaagacugcucaccugccuacuaaucaauuugaucuacaucagaucuuaaugagccuuuccuuaaaaaggagauaugaaugauauuuaauaaguaaaauguggcuaccacauauauaaaaugugagauaugcucaagaguagaaacuguaagugaaaaucuccaaaagaagcugcauuuugaauugaaccaucuaugaggcugacagacugauuagaucuucaaugacuggagaauuuggaauguugcaaguucagagcuaaaaacuugugccaucuuuacccucuuaauagccaucuauugcccuuauggugguuugcauuagaaauguuccccauaggcucaagcaucugaacacuugaucucuaugugggaucccuauuaagaaaauuuaguauggcuagagaaaauauaucacugggaacaggcuuugaaauuaagacuuguaccauuuccaguuugcucucagcuucaugucuguggcuaaagaugugauuucucaauuucuuauuaaagcugccaugccacuccagcaugaaggacucuuacucuucugaaaccauaagccaaaacaaacucuuccuuaaauuaucuuggucauggcauuuuaucaccaaaacagcaaaguaaccaauacagcccuccauuagauaagucacuuggaauguagaaacauagcacuaguuauccuuuggaauguauuaacuuagaagaugaucagcuuccaccagcuagcaucugaagccagauuucccuacuuuguucuaacccaucucucuaacguuuccuuccaccacuguacuuagaaguaacuugauuuaugguuuucuuuguucuguuacauaaaacuacauaucaaacuggaacauggaaucuaggguaaccuaaaucuguguuuccaggucauggucagucauauuuggcucuagaauacaauggacaaagggaucuuuugagguguaaacuguguuuuacaucaacacaggacauaguguaaagacaccuaacugucuaacuacaggaagauggcaagauagaagcaugguagcgcagguacaaaugguaccuguagaguauggagagguagcugagaauuuuacaucaggaucagaaagcagcaggaagagaggaugacacugggccuggcuugagcacuugaaaccucaaagcccaccccaagugacacaauuucuccaaggccacaccuacuccaacaagggcacaacuccauagugccacuuccuaugagccuaugggggccauuuucauucaaacaaccaugucucuaucauaaauacacauuauauuuuuaaaaucuuaaaaguaguucugagauuugcauuaugcacugaaaauagcaggagcugaguaagagcaaacacgcagcaggagccagauuacaagagguuaaauuuuguuuauugucauaauugagaagcagaaaagccuguggcaagauagaacaugauuauauaaacacagcagcaggaaauuaggggagaccaggauagggacgacgccuuacaggcaggcagaguuuaucacacaugucacaggcauguguugccucaugucuauaauacaaacacucaagaaaaauuaaagcaagaagaaugagaaucaaaggccagcaugaaauaacaugguguaaugauaagacuguaucuuaaaaaaaaaaaaaaaaaaaaaaaagccauugugucaaaauguacaccacaauagcaaugaggaaaugcaaacaagucuacaguuaggugguuaagguaauuacuuauagguuaugauauuuguuuaauuaaggaaaguggggacacagauguggaucucgggagauaggcuggaguuagagauaugcacagaagagaucauuauucaagugagcaugcaugguguuaugaagaaaugaaaacucaggaagaaaagaaggcugagaggauacuaaaagucaaaacauggaaaagaaaaagacaaaugauaaagacaguccacccuggagcagagcagucacucagacuacugggaauguaucacucugaauuaggcacacuaauuuucaccacaacaaagccacuccccuaucaauuccuccucaaguuggaaaccaagauaacugaggacauggaaaaugggcaauaguacuauggagaagagaugugggcccagcagccacuguacgcacuaauuuauagaggugcauccuaauauuuuacucaucuguaacuacuuuuaauauuggucuuucccccaacggaucagguggggugggaguggggcaagagaacaagaucuuagugucuuagucacaaauauagcaacaaguacuuggcucaaagauaauacucaaccugaauguccccucccugaggacuagcuuucaugguaccaaaaagcaccauguaagcuucagaaagagggaagaaaacaagaauucuacccagcugugauaucuacaaaccacaacaaacagcauggcaccauggagauaaccugguugguuauugucuaauuggcaauuauuaagucuaauugacaccaucucaacaagagagaaaccaugcuugcuacuggaaaucuagcuaacuacucaguuguugugaagucauaguuauuggaggagaaucuacuaucucuaguuuaccaaaccaccauaaucacuaaucuauaaaugucuguccuuauacacacagauaagugcagccuucauccuucaccaaggaaacuucccuuugcaaccaagaccacuacagaaaaccacaaaaacucaaaauacagaguuguggagcccagucccaauagauacaucuacaaaaacaccuaaaggucagggaacauugaggaagaggcagcagaaagacaguaagagccagaugaucagaacauuugcuguuagcuugugucuucuaguaacaucugaagcuacauccaugaagccucuccaacaugaaugcccgaacaugagcugaacaaggaugacaccaauggacugagaaaagcacagaacuauaggcaacuaaggaaagcuguuguggggaaaguuaguccucuccccagagaugaacacacccauuggcuguccagugccaaacaauaagcccugaaaauauacacacauguaacauuauacaaacucaaguuauauuuaggaauauauauauauauauauauauauauauauacugcacauauaugcaugcaacaagaaucaguuuuuaaaaagaggcuaugaauuuaaaggagagcagaagaguauauaggaagguuuggaggcaggaaaggaaagagaaaaagauaacacucaaaauguuaugcuggaauauauuaaauuauacgaccuugucuucugacauuacucaggagcucagaaaggagacaucucugcuuuacagaugaaauugucaccugagcuucugaacucagaagcuauagccugauuuugagcuucauuaaguauauuuuuugaaggccuauuuagccacuauuuuagacggaucuagaguuagaauugacucagaccacagaaaugaaaaaaaaaagcuuauaauguuuuaugaguuuauuuaauaaacauucaaagugaauggaggccaacaaguuaucuuaauuucuaaauagaugcugguuuugugucuuguucccacaaaagcaucucauuaagauuuuuuaaagcauauucaauuuuuaucuaagguggcauaauucaucccugagcaaaauauucuuaaggauagcuuaaguaagaaacagccccacauuuauacaacuaucuuaaucuucaaaguaaacaagcccuucugaacuuuuaaacacuuaauuuuuuuaauaaaauauaaauaacaucugguauuuccuuuuacuaagacagggucucauuacaaagcccugacugaccuggaguagaucaggcuggccucagacucacaaagaucugcuuuccucugccucccaagugcugggguuaaagaugugcacucccuuuacaaaugauaucuuuuaaagcuugauauauacagauuaaguaucccuuauucaaacugcauagggccaaaaguacaggacuuucagauuuugaaauagcuacauguagugaaacuuagaccugggucuaaauguaaaauccccuuauguaacuuacauacaugccuguauugaguauuaaguauucaacuggauaauaccugcauaccacugauccugaagggacaacuaggugcagaauuuuuuguaccauguugacauucagagauuuacaucugaaccauuuaaauuuuucagauaaaggaagcucaaccuauacuauuuuuguagaaaucacuuacucuuaaaaggaaaaugacuuuaaaauuagggagauaucucagucugcaaaguuagaaucucaauucaaaucccuagcaccuguguuaaaagcugagugucaaugguguguguccguaauccuaacauggggagugggcaggcaaaggcaaggggacaccaagggguugcuacucaguuucugcucauauaggcagaugagggaggaacacauccucaauuccauucaaacagccaaaucucaucuccaauucagugagagaucuccaaagaauaaguuaagagaacaauuggagaacacauccucugucaacuucuggccucuacaaggaauguauaagccaguucacacaaaaugaaguacuuaacagcuggagaugaagcucagugauaaaacacuagcuuggugugugcaagacccuguauuaaacacuccccaaugcugugucuggauugaaaacagauaaugggauagagaaaucagcauuugaauaauacaaggauaaucuuuacacacuacacaaaaacauuaugcuuacacacaaggaagaagaaaacaaggacagugccuuagucagaguuucuauuacuaccacaaaaaacacccugaccaaaaagcaaacuagggagaaaaggguugguuauucagcuuacacuuucagaucauaguccaucauuggaggaagugaggacaggaauuuaagcagaaccuggaggcaggagcugaugcagaggucauggugugguucugcuuacuggcuuacuucccauggcuuguuuggccuacuuucuuauagaaccuaggaccaccagccauuuucucagcugaggcuccuuacucucugauaacuuuaacuuaugucaaauugaaacaaacaaacaaaaaaaaaacagccaguagagucagaaaaagaggcuagguaaccuaagaugggaaugguuuuuuguuuugggguuuuuguuguuguuguuuuucgagacagggguucucuguguagcccuggcuguccuggaacucacucuguagaucaggauggccucaaacucagaaauccgccugccucugccucccgagugauggaauuaaaggcgugagccaccacugcccggcuaaguugggaauguuaguagcaccucacugcagccuaccauccuauaaguacacaacagucucccuagacagcuucuuaaaugccagccaaaacucuacccugacugcaaacaaaagacuuuugaagaacucaaugaaaauccuuucuaaccaauaaaacauuugucugagccuaauaaacuccuacaaugaagguuuuuguuugaagcuaaguacaaugguucaugcuguauguaaucccaguacuuugaggcuaaaguaagagaauuucuagaaguuugaggcuagccuguuucauacagugaguucuagguugguuaugcuacaguaaaauaacaacaacaguaauaauaauaauaaauuaauaaguuugauccaaagcucacaaaaaaaaaucugaucucuaaaaacaguucacucgcaacacaaauacacaaaaaaaaauuuaaaaauacaauucacgacuacugaugauuccacuaucccaaggaaaaugagaguaucaauguccucuucaaaacucauaagcuccaggaauauaaucaacaaaacaagaucaaaccugaggugucacacaaaguacaaacuaccaaaggaaaggaagagccaacaagacagaauguguggugacagacaacugacaucuaccuccacuacccucaccugaaagaagagcagccccaagggcaagugucgaauucaaaucagucacuacaaaguuaaucuaaugacugccaaaugauggaaggagugagaauuuugguuucuuaaaaaacccaguauugauaugugaauauguuuuuguuuuaauccccaggugugggauaugggaccacuucagauuguccacaaccacuaugauuucucucuugcugcagaagugugauuuugccagcugcaaauagucuacauuuggaauuuuggggacucuugagagaguguaagugugagugccccaagagccugugguggcagcugcugguucugcugcugcuuuagcuauugcugaacugcugguuccugaauccugaguugcugguugcuggcuagagauauucuaaccaugaagauuggacuuguccaagaaccucgaagccccuaaucagcaggaagucuaacuaggucuaugcucccuuuccccucuaaccuucuucucaacuaccuaguuaguauuagggggguuggaaggaacuaggguagaggagugugguaaauauaagaacccaauaaaguagccccaaaaguauggcuacagaugaauuuugaaaauaaaacauuuuaagaaaagcuauaaaacgaaaacauaaacagccagucuacagugagagaagaaaaacugcugcccagcaccaucugcuaucauccuuauuaccuagcaaaugagacuuuacgaacuaaccuagcggucccuaagcuagcgaucccuuuauacuuucuacauaugcaaauuuuauccuuucuuuccuguuuuuuguuuuucccuaugaaugaggaaaauuaucaaauguuucaguugacaaaacuuauauuucacaaauguaaguguaagaggucuugcaaaaguuaacuaucugggcacuagagcgaaagaagggucagugcuuaaaaguacuugcuacucuugcagagcaacuagguccugaucccaagcauucacaccuggcagcuuacaaccaucuguaauuccagguccagaaaaucacaacacccucuucuagccucugcugggagcaaaacacacacacacacacacacacacacacacacacacacacacacacacacgguucacacgguucacacgguucacaugcacacaugcaggcacauaaacauaaaaauagauaaaucuuuaaaaaagaaaguuaacuaucuguuaaugguaucaaaagcauuuucccuauacauaauuucaauuaggaggaauuuugaguuacauuucuauauugcauaaucuuaucuacugguuuccaaaaaauuuuucuggauaaaaguucacuuugaccaccaccuuuuauccuaucuuccuucucucaccugguguggauggaauaagcacaauccaggcauacuuuauacaacaaauguuuaaaaaucaaacuauagggcuggagagauggcucaguggcuaaaagcacugacugcucuuccauagauccugaguucaauucccaacaacuacaugguggcucacaaccaucucuaacaggaucagauguucucuucugcugugucucaagacagcaacaguguacucauacauaaaauaaagaauguuuaaaaaaaaaaagcuacagauaaguuacuucauuucucauuugacucaagacuaggcuaggagugacgcauauuucagaauuugggaaaggauaaaauaugacccugauggaaaaguuuuagcaacaaauauuucuauacugauuuucuuaacacugggggcgggaucugaauaacuccuuaauauguguuucucaacuuuguuguuguuguuguuguucugugcuagagauugaacccagggccucucaaguaugaacacaagagacaccuccaauucuuuuaaagucaugcuuccauacuucuuuaaucaggauaacucaugccuauuuuauuuuauuacauuuuccaaauguagaauuaggccacuaaauguaguuucaaacuucaauaucuuuuuuuuuuuuuccgauuggauauuuucuuuauuuacaugucaaauguuuuccucuuuccaggucuccccuucagaaaccccuaacccaucccccugcucuaugagggugcucccccacccacccacucccauccucccacccuggcauuccccuaaacuggggcacugaacacccucaggcccaagggccucuccucccacugauguccaacaaacuucaauaucuuaauuaucaaauaguauaauauuccacaauugaccucuaagaaggguaaaaaauaauaauaaaauaaaucauauauagucuauaaaauacuggaggcauuagaaagcuauuugcauccuaauuucagaguaugaaauuaaacauucaauaagcauauagacugaauauguucugugcuucuaaugacauuuaccagaauuugcauguaaauauuuucacccuuccacuugaaacuacauuccuuaagcaaaaugcaaugcaaauucuucuaccuuuaugacuuuuacuuguuucuuuucuuuugcucuuuuuuaaauacaucuuucauaucacccaucagcccauuccucacucagaccucaucuucuccaucaagccuuccaaaaccacuuaagccaccacugaccuuuucuucaaaaaaaacugagaguaucaucugggauggcacacuguauaaacuauucuuugucauguuuuccugaguggaacacaauugaaccaucuagggaauuuacucaaaaucaaagacaugccgaccccugaauuacacucuuugagcacaugucuuugcaguggcaaugacucaguacacugacgagcuacaaugcaaugcacuacuaaagacacccugacaaagagcagccaguuacagacgugacaaaucagcccuggcacaaccaguguuaauugcacagcaucuauacuuucucauaaugacacaaaacgguugcucaggcaaaagagggcucaacagucaagagcauuugcugcucuuccagacaacccaaguucaauucccagacuucccauagcuccuauuagguggcucacaaccuucuauagcaccagcucuaggaaaucuaaagccucuggccucugaaggaacuugcacucaugugugcaaagucauaugaagacauacauaccuacacauaauuuaaaguauuuuuuuuaauuuaaagaaaaugguuucucaugaaaaaacaaaaauuguacucuucaguacuuagaucaggcagucacucccucuuaucucaaagugagagcaacagugcagaugugaaaccaaagcccuagggaguggugcaccaaugucauacaguaauccagguucagcaccugcacugaaagccagguuucccaugugaagccucuccucaaucaaacugcagcucugaucacugcucugggggaaugggugugaaaaauaaacuagucuuuaauuuaaacaugcuaauugcuggaaacccccacaaauuccuacacucucuaaaauggccggcaaaggauccaaaaguucaaagaaaaugggaaagugaacgacuuucccuacucucaagagccuucucuacucuacacuccggugcuuuuauuuugcagccuauacuaucaaccagcauugauagauggaaaauucccaaacucuaggccccauggucaccuuaaagaacucagcaugguagauccuacgcucuuguaguagcacugccucccuggguaaaugcaccaccuggccauucaccuuuccauuucccucaacaugaaccccaggucaccaauuccccuuccuacacaacauaauucuuguuucccuacuggcuaccacuugggaucuauaagcuuuuugaguuucaucucuaucacuagaaaaaaaauuggccaugcacccauuauuuauaaauuaaaacauauauuuuauagcaaugcaauaacauuauacaugauaaauacguugaacuuuuaaaagcuauaaacagagaaugcucuuauaaaaugcuuauacucaaaagccgggcaugguggcacacuuuaaucccagcacucgggagguagaggcagguggauuucugaguucgaggccagccuguucuacagagugaguuccaggacagccagggcuacacagagaaacccugucucgaaaaaacaaaaaaaaaaaaaaaaaaaauaaguagaauaaaaugcuuauacuccuuacagacuauuaaguuauuuuacauaacccugggguuagaaaccuguuauuuugaagccuugguaaaaugcuccuacaaguaagagauauguauguaugcauauauauauauauauauauauauauauauauaugcuuguuuauauaaauuuauauuuguaauauuuaauauguacaugcauuugcgugcauacagauauauaugggcauguaugucugcucuaauaugauauauauuugaaggagccucuuuucucacguauacauuuuaugaugacauauaugcuagacauacggguaaagauaauuauucuuaucuucuaaagccacacaccaaaaauaaaguuuucaaacucugaaaaauuuacaauauacaugcuagacauauuuguaaagauaauuauucuuaucuucugaaagccacacaccaaaaauaaaguuuucaaacccugagaaauuuacaauaugcaugcuagacacauugguaaagauaauuaucuuuaucuucuaaagccacacacagaaaaauaaaguuuucaaacugugaaaauuaacgaaguaguuuauucuuuaucacacagcuccugaaagugagauacacugcccucaccuaucuacgucaauuucuaagcagucagaauuguguggacuguccuuuaaccucaguacacuucugauuucugagacuguauacugcuacuacuuuagaucugauccagaagacucaauuacuaucuuuucccccuuuauccucacauuccugauugccaacuauuugacauaugauaaacaaaaaagucugaaaaccuauaaccaaagucccaauaaacaguacuauaauagaaaacacuaaucaacucugaaacucacuaauuugcaaacaaaugguaaaagcuuauuuuaucauauucaccccauaaugaaucuucaagucagcugggcuuauuacacuucaaaaacuuuuacauuuaaauucugaggaaaaaaaaaacaauccucugaaacuuuuacuagugucaacauguuuaucucaucacucugguaacacagguaagaauacuaguacucauacacucacggaacacuaauaaaauuauuuucuccagacaacaaacuaugauauacaccucccucucuacauguaaaccaggggguggggcucuguuagaaaaacaccagagaguaaaggaacuacauuaggcagaaagcauucuggacaaacauccgucaagcuaauuaauuuuccuaguaauaaagagugaggagaggugagcaguguucauggaguuaaucaauacagaacuauauuuucauuucauugauguugauucagaacagauucaaauuaggcugaccagaaaauuaaagacaacugauuacuuuucaacuuuguugauucuguaauuuucauguacaauacugaagauuacaaacaaccuggugggaggggguaggggaagacaugcucuuccagaggaccugaguucuauugcuagugcccacauaccagcugacagccacuuguggguacuguuccaggagauuugaccccucucuucuggccuccacuggagcggcauacacacagggcaaacuuacaagcaggcaaauacgcacccacauaaaauaaacaaaucaaagccuuaaaaaaaggaaacaaccucaaacagugagauggcucaacacaugaaaaugcuuacccaagcugggcaaccugaauucaaucccugaaauccacaugauaguggaagaaaagaagaaaccucacaaauguauccucuaaccuccaccuaugcucggcauacauucccacaugcaaauaauuauaaauuaaaauuaaagaaaccaucuuaauacugaacuucauauccucaacaacagauucuucaacugcaggccuguaaauucaacagauaagcuagaaacugcuuucuacucacauaaaaacuagaguucuaguaucuucuacucuccccaagugccuauauacaacaugccaguguuucauccguuuucuauuugucauucuaucauuucugaucauuaaccaugguugaaugaaucaaaauuccucauaaacuuggauaucauaucauauauuaagauucugaugucaguccuucccuucgggccuugauguccaucaguaugcaagagguaacucuaaacuaaaauuucuuaguccauucuacagguuaucuaggauaugaccuacuguaauggcugugugcgauuuaaaaaagaaaucuaaucagaauucaucuaacauuuauuucuguccuaugcaagcaacaaccaccauuaaaaaauaaaaaccuuaagucauacuauccucuucauacccaaguggaauggcauauccaggagacuuuccuaauacuaccaaaacauucugagaaguuuguagauuuuuuuuaacauagcaaaagcaaugaaaaguaauuaauguauaugaagcauuguugucuaaguugugguuuuacauuucacuaccuacuguguccuuuucuuuuuuuucuuuucuuuuuuuuucuuuucuuuuuuuuuuuuuuuuuuuuuuuuuuugaggcauugcccuggauuccucuugccauacauauacauacacacacacacacaaaaugccuucuuuauuuuacauuaguuagguuacuuaaaguucaaauauaggcucuggaggugagcccaugaacucuccaaauuacuuaaaacuccugcaccucaguuucuuccuuuguaaaaugagauaggcagucccaauaccaccauggaucaggaucaggguucugcagugaggucaguacaugcugggaguuuacaugcugggagcugggucugacccucgugucacaagaauuacuauaauuaguguaggaacuccuuuucucuuuuaaagaugaggaaacggaaauaggauaauuuauuacuaguuauuacuagguuucaaauuaaaaguucaaauucacuguggcauucgggaucagcgcggucauuaacccagccugucacuaggaggcacgagaaaggguaggcagccacacuccacgaggccccgggugggcaccgccucgcggaccacgggcgcugcggccugguucccagggucccgcgccgcgcuggggaaaggcgcccgcugggcaccgacggaccgaaccccucuaaggucagcggcacccagaucccugucguacccacccuugaaccccgccacgccccggugugacagacugggcucgcgacccucccuuaggacaaggccgggcggggcggggagcugcagccgaacgaggccgagcgccgcggucccuaaaaccggacuccacccggcccaggccgcagagacacgccugguuagcccgaguugcccggagcccacgcccgcacguccacacgcccgcggccuuaccuuuucgcagcguccgcccgacacgcgggcggcccgggcuccgccgcguuccgccucucggagggucucgggucggugucggcggaccucggccuuucggagggucucgggccggcgucggcgggccucggcuucucgguuggucucggguggcgucggcgggccucggccgcuccgcgggucuggcggcucuucagcgagugggcggagacucggcccgccugucccucaggaagccgccccgccccgcccccgccgcgaagcucuuucucccgggcugcccggcuuuucucucccuccggaaacg

SEQ ID NO: 4911 - RNA, 3364 nt, Mus musculus
uguuacauauguuuaacaauaauaugaaaagcauacuaauaacagggauguuuucuuaaaugauuuucuccugggcauugccuaugggaacuaaucugucauggguuauuuauuaauccaaagcauauucaucucaggaccuucaccugcuaguuauuagcuuguaggcuucugacaauacaugcuucugggaaacaaauucagguauucccacuugcaaggcaggcacuuuaccaacugaaauaguucccuaguccuacuacaacuuuuuaauaacuuaaauauuugucauugguuaaaauccucagaguaauccauuguaggcccuucuauuaaagagaagcucaaaagguuuaauuguccauauuauuauuagauuguaaaagccaaaguuuaaaaauacuugaauuaauuuuccuagaaaaauuaugggugguagaccacuaaaaaagucuguaauaauucacacagggauaauguugacuaugcaucuagcuucaaaauuguuggcaaccuuaaaaauagaauuuaaacuauagggaaauuauguaaaacucucuagccauacaauaacccaaaacauucuaauaggaaaauuacacuuugacaagaauaaugaacaggauuccucuccaguggccucuuuuccccaguuuauagcuuggucaagacaaggucuucugugaaugccuucaauauuggacugugagaaccuuccacauaccucuuucccaacaaaacucugucacucuuaccagaaauuaccuauuuuucugugaauuuauaaauuacuauguggauaggcuccucccccucuaguacuuuccauugucccaucagcugcuccuaguauaaauauacacucuacagguauaugagagucuaguauauuucauguguucugcuauuacuuugcauaagguuuuaaaugaaacuuacuauauggagaugugguacaugacacaucuagcuauuauggcuuuugaaaauagaaguuuuaagccauucccaagauggaaaaagacccaugggaagcauuacccuagacaaaucaucacugagucucuauggcccauaucucagugauuauguuuuagauagucucaaaugcuccagaaagaccacauuacuuggccaaagcagaagcaaaaaucauuuagccacagagauauaggacagaauaaacugaggguaauaaaauguccacagaaauaaggauucuuggaaacauuuaagcuaaagacuugauacaaaaaaaucagaaaugauguauucacaaguugauuuucaauucccaaguuaaagacuguuauaugaugcaaagacccuuuacuguguuugaacuccaaagcaacuggggucuucauguaagggaaguugcucuugcuuuaucccuacuaccaagugaauacaacauauuagucacuuuaaagauagacaucauccuugcaaaaggacauucaugguaggcucuccuaaauuaaucacuacaggaauggaguaccuagauuaucuuuauagagcauuaacagauguguuugucaugugugcacaugucugacuccaagagauggcuggagaguaugcuaagggaaacaacaaauauguuucuauuccagauaggagcagacacccaaaguagcucucuguggauagccaaggauaugagaguugacuuuguaguuuucaugauauuagauggucaaucuuuccuaacccacuuagggauuuugcugauuugauaucuucuauuuuauuggccaauacuggagaaaccagucuguucaagaccaggacauagcaagagacaauggagagacauaugguaacaagacucuaguguaaugggaagacacagcagaguuagcucuucaucucuggguggcauggguggcucucuuacuuucccuuaugacuggggagagaugguuugugcuuggugggaauuauguguacacugcuccaccuucaucuuccuuuucauaacaaggccacuuccaugaccagaaggcucuuuccuguaugugguuguuuuaaguauucacuuuucucuuccaauucuccuaucauuugguaaaaagguaugugaagaggaguuccucucuggaacacuuucaauugugaauucacugucuguucacccauucuacaaguauuucuacauagaauaaucucuuccuugggaauauuuuuaccucuguugcuucuucuaauuagguuuucucuagaaaaccacuaauaauagaccccagauaagggcaguguaaauggcaacagugaacugagugaauuaggaaauauccucuggcauucauaauguuaacauaagauuucacuuacagaagugaauucugauacaauugggagaaauacauuuuaacagcuuguuucauaauuagaucuaaauugcccacuuaugugacaguugguuugggagaauguggaggcuuugagacaugaggacugacugggggaagcaggucacugugacacugugugcuuugcuggguucuucuucccuuggguugcuucuuguguuugguaauagugaugaauauaauacagauaaguauuuuuuuaucauuuucacuuucuauucuagaguuaucacauguauguguuuguucuauauauuuucuuuuucuagcccucuccuguucaaaugugggcaaaagaaaggggacuuuaucuggcucugcuguacaugaauuucauaacuauagaauauucaccauuugagaguaacaaaaaaauguugagugaauaauaaauuaaugaaguaaacuuggcagcugauaauuuauagagaaaaaacaguauggaaaacuuuuuuuuuggcauuuugugaguuauaauaagccuauguagucuuuggaagcagaaguuucaaugaaaauacucaaaaugaugagguuggauguguaacucuuaaaagugaaacaccaagaaauaguuuagauuuucaugucuuaaacauguaaauuucacuguaaaacauuuuauagaaacuaucauugcauauauuugagacaguaagcuauuacaaucuguugucugguaaaauauuugucacuaauucauuccuuaagucaaaaugaaccaugccaagugcagaagaauguuuuuuauugcaagcaaugccauauauuugcugagguggaaucuuccucugcucccauccacucugggaagguugaggggcuuccaaaguacuucacaaauucuauuuggcucuaaggaguaacccaaaaugaagauuggugaauaauacugugugcuaugugcuuaaagucugauuuuaaacauguuuagcaauauuuaaaauauagcuguuaaugggcaguucuauaaaguuuacuaagca

SEQ ID NO: 4912 - RNA, 52764 nt, Mus musculus
caccuccauuuucucugcaguguucuaagccugagguauaggaguugugcuguagaugucaguugagacugaacucuacagcucugcauuucgauuggugugguuuacacagguaaguucccuuaagacuacaguuauuugugaguauaagaucaaauguuuagcauuuaguaacgugauaguuguagguccuauuccaacgauuacuauucacccaaauaaagcagccaaauuuucuguuucaagcagcaguuuacagacauuuggcggagaaagggucaacaaagaauuugagucccgaaggggguugugguagccccagggacucaugggaaauguaguacuauugucugcaacauggcggcguccgguugaaagggugucagagcauagguggucaggcugcaccggggaaggcuggcgauugacaaagcagcugggaggugaacauuucuggugaggagagagaaaaguguacgccaccugauuggggccuggggauauggaggaucgcaaauccuggcuuacuccuuucagcucccugucugcucuguccugaccagcaugggccgacucagaccgcgaagagugcaguuuauggguuggggagguaaggccguugggaacccugguaggaucuaauguccuuauguuuggcauaugauggaugccuagcggugucuguauuagcugccauagggguugaagaccaacccuugcuuuuagucguuuuucagcaagcaucaauucugugaagcacggauaugcaaggcacucuuggcccacaucugccuuauauuuuuuucuugaucaguccuucugcuucuggggucaaguagugucagacugugguuuugaugauuucguuuaacguuugucucuagcuguuuagcagguacccaagauuguagacgagaguuucugacuccaacacaugcagauaauugggauacucacucgguggguguuacggaaaucgcugaagauggcugccaaaauuagaauuacggaguuuaauagcuaaaauggcaaauucugcuuagguuuauuuaaauauguauauuuaaugagucgcuacuacauaucacauccuguuuaagugcuguguacuacccggugaauaauacagacaaaaucacuacuucauguacuuaacuuucuauucacuuacagaagauaacaaacaaugaguguaagaaaaaauagaguguguaauucagaaacgguaauuuuuuucuaagucuuaauguuuaacucugcuuucuuuuuaaauagauaauguaauuuggauagcuuauuaauucaaaagacauguaucaccugcauguguaucuauauaccaccuacaugccagaagaaggagugagaucuggaacuggaguugugaaugguuugaauuacuaugugggugcuaggacuugaacccggguccucuggaagagcagcuaguacauauaaccagagucaucucucuagccacagcucuauuuucuaacucagacacggauacaguacaguugguacuugggguacuauccaacaagauauauugagaguuuacuaguagcagagccuuuauuucuuuguucucgucuuaccaacagagaauuugcucagacugaaggcaacugaacaacuaacugcgauggcuaguauccuauuuaauagugaccuuacuccugucacaugccaggugcauccaagcagcugugcacugacccgaucccuguucuucacaucugaguaaucagccaaggccuauugauccugugggaacuuuguucucauccuugcccuccucuccuccccuccccuccccuccccuccccuccccucuccuuuccuuuccuuuccuucuaugccuccaguagaaacuagguuaacauuucugcuugcuacagguggauuagugcaggucuucucauucugaauuguccuaucaucauuuacaauuaaccugcuuuacugacuguaccucuuaacuuguuugcuaagaaacugaaguaaugccauuuuccuacugucaaacuacuagaguuuugacugugccuuaguuggguuuuuuuguuguuuuuuuguuuuuuguuuguuuguuuguuuguuuuuugagacaggguuucucuguguagcccugguuguccuggaacucacucuguagaccaggcuggccucgaacccagaaauucacuugccucugccucccaagugcugggauuaaaggcgugcaccaccacaccgggcuugccuuaguuguuuugaaacauaauuuuauuuguuuauuuuguuuguuuacuuugagguaugcagcuuuauucuagagggucaguaaacauaugcuacucaaaaaauuuuaugccagcuggauaugaugcugcacauuuguauuccuagcauacaaaggcugagacaggauaaacauuaugaguuugaggucaccuaggucuucauaguaagaaacugccugaauaaacaaaacauaagcauauauuggauauguggguauauacccacuucaaagguagauaucagaaaugcaagguuauccucugccuugucacaaucuggagaccagccugggagauacauggcucccucuuucaaaacaaaacaacaagaaaguggggagggggaacccuucaaauuaugucuguauuucacuauuguuggacauuaucguuuuuccuuuuuccuuuuuuuuguuucaauuaucucucugaauaccuucuuuuaaaaugacuauuuguucuguuccuucuaauuugaaguuuuacaaacuuuuucaguaacauuguuuuuguguuuuggucucuaguuaugccacaaaacccaguaauacuguuaaauacuauuagcaguuaauuauauggagauaugucauaacuuuucauuguuagguaugugcuuguuuugcucaucucacaaguucccacaaagccacgugccauguuacacuuguaugguuagagcacugagacuaucauaggcauacaugcucacuugguuaccauucacuccuucuuuccauauguuuccugggcacauacuauaugcuggcauuccuacuuugccagaguuuacaucaugauggaaaacuuaagcuaacagaugaauuguuaugcauguuguguuaaauucugaaguauuuuuacauuuuuauuuguuuuccauuuucuagauuuuuggaaaggaaacuaaaguuucuuucuuuuuuuuuuuucuuuacguaacacagaaaauuuuauaaaguauagaauguaugaauaauaauuguuccuucaagacuuuuaaaacauauuuuuuauauauuuuacuuacaguauuacuaugaauaucaaucauaaagguguuuugaaacucacuaaaauggaaaagaaguucuuaaggaaacagaguaaagccaggcauguguugcugaaacaugaaggcauccaagcagugucuuaucccacucaggugaccuuaaauuguuauuaucauuugaauguggcuguaccaguauguuaauauauuaugggguuuuuuuuguuguuucuuuuuucauaauuuauuuacuuuacaucccagucccagcccucccacauuugcccaguaccaucacuacauccccauuccucccuacucccguuuuacucagaaaagggcagcccuccaccccauggguaccaacccacuuaggcaaaugagauuggaguaggacuagguacauccucucucacugaggccagacaaggcagccuagcuaagggaaagggacccaaaggcaggcaauggugucagagacagcccuggcuucaauuuuuaggagauacacauaaagaucaagcuuuacaucugcuaacuauguguagguggccuacaucuaucccaugcaugcucuuugguuggugguucagucucugugagccccuauaugucuagguuaguugacucuguagaucuuguguuauccuugacccucggucccaucccucacuuucccauaagacuacccgggcuccaccuaauguuaggccguggaucccuaaaucuguuuccauuagcugcuagaugaagcucuucagaagacaauuaugcuaggcuccauucugcaagcauagcagaguaucauuuauagggucaaugguuagcucccuaccguggguauuauguuaauauacuuuaggauagcucaaagcuguaauuguuauguauugcacccauauuaaauauacauuguggcaggaugugcuaguuuuccauuuauaugguagccuagucuguaguuugaauuccuuucacuaguggaaguugaacuagagcagugguucucaaucuguaggucaaaaccauuggaaaauacauauuucugauggucuuaggaacuccuaaccauaaauuuauuuuccuugcuacuucaugcuaaauuuuguuguuuaacagcgucucauuuccuaaucccaucagaaguauguguuuuucaaugauuguggcucacgggauaagaaccauugagcuagagcauguugcagguacauauuaguaauaauauuguacaagucuuuauaguugauaauacaaauucaacaaucauuauuauguuuaguucuuuuuaaaacucuauaugagcuagauuggaaaacuaucuagagagauuaauuuccucuauuauaaaccaguuagugauugaauagaaacuugaagguagaucuuuuauauccuaauauagucuuguuucuuuucuccccuuuucuauguuacaaaguauuuagauuauauaauacaaaauauuuucauuaguccuuauuuauaaaaccuuuucacugucuguuggcaguaagaugauaugagcuacuguaaaguuucuugggcuuuaaauuacagcucaguuuaaauccucacuucucuucuuauuuagauaggagcauuauuuuugaccugggcuuuauuucuaagcugggcauaguauagcauagcuaaagcuuuuggacucucagagguaaaucugcuugucuuuuauuuauuaaugaagugacuaaugacuucuaaguagccucugaucacuggagacaccaaggcaugauuggauaagucaacuuagccauccuuuuuccugugaaaggaaguugaguugaguacuauauuaguuacuuuuauuaucauuacaacagaauaugugacagaauaaggaagagagaaauuaauuuuuuaucauaauuuagaaacuacaguuucuauagcagaaaagacaugauauaauauagcagaaaagacaugauauaauacuagcuucuguucuuccauaguccuccccaaaacauggucauguuugucacaacuucuggugccaacuuguauuaguuaggguuucuauugcugcaacaaaacaccaugaucaaaaaagcaagcuggagagaaagagguuuauuuaguuuacauuuccacagcccuauucaucacugaaggaauucaggacaggaacucaaagagggaagaauccuggagacagaagcuaauacagaggccauggcugcugcugcuuauuggcuugcuuacccuuacuugcuuugccugccuuuuauagaacccaggaccaccacaccagugguggcaccacccacaauaggcuggggcuucccccauugaucgcuagguuuggaaaugccuuagagcuggaucuuaugaaagcauuuccucaaccaaggcuccuuccucucuaaugucccuagauugagucaaguugauacaaaacauccaguacacugguauucuagaucauguuguaugagaauguacagagaauagaaaaagguacuuuguuuccuuuagugucucuuacucaguuuuagggaaagaaucgaaauguuuuuguaauguugucacauauaaccaaauuguuauggcauguuuugaaaauaccuuacugaauaagguccaugguaaagcaaucugagaauaaauuuuaugcuguucaauguaguacuguagcaaugaauugaauauaaguauauccuuaugcuuguguguaaaauguauuugacuagacucuauagaagagaguuuuaucuuucuuauuguccaauuuauuggcaguucuauuacacucuucaaggaagcuuauaaauauccucguuuuagguaaucuaguuaauuuacuaaauuugagcuaaauacauuucaaaaaguuaguaaauuuauaaugagaacaaaugugucuuguaggcuaagaauuuuuucacauuuuaaaagcauauuaaauaaauugaacugagaaauuuauauggucuguauacccuugaaauacucuuuuaagaacauuuucaacacuugguauaaauaaugaaauugguaagaguacaccaucccugcugaggaauggugguacauauuuuucaucuaagcacuccagaguuagaggcagaugaaucuuugugaguucgagaucagucuggucuacagagcuaguuccagaacagccuacauaauauauucguaauacauggguacuguggcacaugcacucccgcacacagacacacacacacacacacacacacacacacacacacacacgcaugcauaagcuuucacauguauacaaauaagauuuaaaaauaauaggugguaaauuacauugacauacuuuaacauuauaacauuauauauggauuuuuuuuuucagaaucuuucuuuuuuucuuuuuuuuuuuuucaaaacaggguuucucuguauagcccuggacucacuuuguagaccaggcuggccucgaacucagaaauccgccugccucugccuccugaguucugggguuaaaggugugcgauaccacgcauggcugggaauuuuuuuuaaguauaguaacuaugagaguacuauaccaugaacauaaaaauaaagaugagaagauucccucuuucacuccaaaucccuugacuagagcagucuucaaauugacagaaaauaagcuugcaacuuauaaaggaaagaaaauuacuuaaaauuugacugaacuauuuuuuuuuuaaagauuuauuuauuuacuguauguaaguacacuguagcugucuucagacgcaccagaagagggcaucagaucucuguuacggaugguugugagccaccaugugguugcugggauuugaacuuuggaccuuuggaagagcagucgggugcucuuacccccugagccaucucaccagcccccugaacuauuuuugacucaguuaauuuccuugagaagaaaucuuuucauguuucgugaaccugcuauuaauuuuuugauucaauuucuuggcuuuaccuuuuugguaaacguggcauaauguuuauauucaaagugugaguuccagaaaacuaacagcaauaauauuuaaaccuagcuccuuaauuacucacuuaacucaacuuuuuggugaguacguucccacucuauaaaguggggcuuauauuauacaaauaaguuuacucugucuuaaaaauuaugcuaaacaugauuaaauggguaaaggcaaaaaguaucaaggugaccgcuggcugcaugcuucucucucuauucuucuuuucuuucuuuuuauuaugcuaauuuggauugcugaacaauaggaauuuaucucuuaacuuauauuucugccgaugaagaaaugaauauauauauauaaacaauauaaguauuuaaaaauaaauguuuauagcauaggaauacuuuuaccccaaauacuuaaaaaauuaguuuguauacuuuguaugaagucaucagaacaaauaacuauuuuuguguacaaagaaaucagaaacuauuuucaauuacauuuuucugaaauaauguaauuucauuuuaacuugaaaauaaauagguuauauccauuauacccauuguuuauuacuuuuuuuuuuuuuuuagagccugguuauugccaaugguggucuggguaauggcgugaguaggaaacaacugcuuuugacuuuggagaaauguggaccuguggaagcucuccucaugccaccuaauaagccauaugcauuuguaauauuccaaacuauugaagaauccaagaaagcauauuuuacccucaauggaaaagaaaucauugaugauuuggggcagaagaucuuucuguacuugaauuuuguugaaaaagguaccuugacauuagcuucuuucaauuuacuuuuuuugugugaauuuucuucuuacagagagucucuuucaauuauucuuuaugucugggaggugugugcuggugugcuugaucaugcugugccugugggggucaaagguuaauguaggaagagaagagcccugauuugcugcuagugggaauauggauaacaacuugaaguggaauuuccauaugauccagcuuuuccacuccugaguauauacccaaaaguuuuaauguuuacuuuucuguuggcuaaaaauguugaacauuuuucguuguuucuauuucuucuuucgagauuugucugcuuuauucauuugccugugaacaacaacaaaaaaaaaaaaaaaaaaaaaaaagacaauaacaaacaacuucccuuugauuccuuucuuugcuacuucauuauuaacauguagaaaagcugauuuuuuuuuuuuagccgggcgguaguggcacaugccuuuaauccuagcacuugggaggcagaggccggugaauuuuuugaguucgaggccaguuuggucuacaaagugaguuccaggacagccagagcuacauagagaaacccuguaucuaaaaaaaaagaagaaaaaaaaaagcugauuuuuggguguugaucuuguacucuuauuuuguugaaaguguuuauuggguuuaaguguuuucugauggaggauuuaugaacacaaauauagauaacuugacuucuuucucuguguauaccucuuuuauuucuuccucuuucugcucuagcuaagacuucaagcacuauauugaauaagaguagagagaagacaccuuuguaucauuacucuucugauauuagaggaaugaauucaguuuuucucuuuauguacgauuacuguauauguagccuuuauuauguugugguauaguacuuucuaguuucaucaacccuuuuaucaugaagagauauaaagacuucuacauugugugaaaugaucaucuaguuuuuucucauucuguacugucuuacacuugacuuuuuuuaauaacaauuuauacaguaaguauuaugaaaagcguuauccuugaaugauguuuagaaagcaacucaauuauuuauguacaaagagaagacuuggguaccauucuuuacugaagagaacauaacauggaguaugacuaauuuggucuuuuuuuuuuccuccauuuugugggugccauuuagcauucuuacuucugaaaugacaauuaagagccuuucagacuaugcuucuggggcacaguucucuguauagaggaguauggguuuugcauaaaacggauuuuuuuguuuuucuguagcacaauggaaaaacaugggccuugaagccuuaccuccaggccucuuggugguagaagaaauuauuucuucugaggaggagaaaaagcuucuggagagugugaauuggacagaagauacaggcaaucagaauuguauguaaaaaucuaugguccaaaauuagauuguuggauacuauccuguuccuggucuugcuuuuguuuucuuauuguacauuauagguuuacugacauucuacuauuuccucaagaucacuggaagcagcuuagagcuaauaguaggcaaacuacacugacaauuauuaaguacaguguuauauauaacauuucuagagcuaccaguucuaaauuccagucuuuuauaaaccccaaaggaauaguuuuuaucagcccuccacuguuugaaaucuuguuuggucauugacuugguccagcagguuguucuuagugacaguuuccugaggaccaggggaucaagacuagaauguucaggucagcaggucuugcacaaguauguuuuaugucaaacaagcuuauuaagaaguacagcaucauacauacaguuuauagggggaauggaacaaaaucaggagaaaguuagucagcuaaugcugcacaaaacaacacauuguaucuuaugugugccacacaccaaguacucagucacccugggacugauuacuguuucuucaaaggugaaaagucagguucccagaacugaaacuuugacucuuucaaggcccuggcccaacucccagacuggaacuugccagaucuguauggagcaaggacacagaggaaguguucuuuucucuuuucaucauugccucugagaagccagagagugaccuggcucccaacaggucccuucugcccugaggguuccucuaaguucuucucaguaguacaggacaucccauaagcaugaagcugcuaugagagcugcucugccuuucuccagaucauuagcaacuguauaaguggcaguauauaugcacacuucugucccgguaauaggugaaacucuuaaggguuuuaaacaacaaaacaaaugacauaagcaaaauggcuuaugauauucaaacaauaauuuagcaauuaacagaaguuuuuauuaccuaugacuccuuacaauguuaaaugaaauaugaaggguugcuauacauuuuuaucaaagaguuuuuuuccuuauacaguucaaagguccuuaaaacacagaagagugaaacauuuuggcuaugaauuucacuaugagagcaacacuguggauaaagacaagcccuuaccuggggguaaguacauguuaauacacucuuauugcuggcuuagaaacagugauacauuagaaguuaaguuuaguugaggagcaugucaucugucagcaaacuuuugagauaacugauuaaauuuaggucauuuucauuuauuaaguggccugguuuuguuguaaaaguucaaacaucugaugaagucaaagcuccugcuuacuucuaccauccuucucuacuucuucccuuuaaaaguaggugcucuuaucaguuuaccacacauucgucuucuucuuuuuuuuuuuuuuuuuuuuuaugaaaugaguucauauucaagugugacuauguagucaaguacauaguugaacaugaguagccucauaucauaaaaguagucuucuaucauucauauacaguauauaucauuucuauacacuccuuugcucuauacugugccuuggagaucuuaagucauguuaucaucuuaaagugugucaggguaguuaccuaccucaggcauucagguuauuucuaguuuucagcacuuacaaauagcacuuuagugaguaucuuuguguguacuuuuucauaugcuguguaacaguuucuuaagcaggacugcaaaaauguaaauugcugcuuuucagcuuagguucaucuaacagauacacuuuccuucaaagagcugggucagaauauuuuuacacacucuccccuuccagucuuuccaacaugcugugcagccuuucaguauaugguuuccuaguuaguaaugagguuugccacuuguaauuucuuuucugauuuucuuuucauaucuuuuacugggugcauuuuuaaaaauggucuauauaaauugguuaccuaaguucgacuggcaguaauucuuuuauuagauucaauuuuacguauuuauuuauguguuuauuuguguguguguguguguguguguguguguguguguguauguuuguuuguguguuuguacaagugucuuugaggaggggacagucuucaguauuguucuucuggagcuguccaucuuauuuugagacaggguaucacuggccuugaacucaccaaauagaccagucugguuggccagugaagugucugucucugucuaguuuuucagguauauauuaccaugcccaacuuuuuuucuaucuuauccaacagguccuuuguggguugaaccaucuccaguccuacauauauauauuuuuuuaugaucuugaucauauuuaaggcuuucaaacauggugaaaucacauuuaugaccucauaaaaauuuuauuugauuauguaugauuuuuuuaaaaaguaauaauuuacaaucuuugagguaaauggaauacuuucgaaacuuuacaaaguauacaauuuaauuucuaacauaaaaucuacagguugagccucccuaaucugaaaauccaaaauucaaauuucucuaaaaucuaaagguguuugggagcugacauuaugcuaccaguggaaagucuccauaucuaagcucaugugaugggucagucaagacacaaguacaugaaaaauaagguauaaaauuacucucagccugagguguaagguauuaugaaacauuauuaaauuuggauaagggcaaugcaauguguauuaaguuuuauuauuuuauaaaguaucaacauuauuaguaguaaaauuacuauuuugugcuuuuuauuugcuagaaucaaugguguacuaacuuuaaaggagucuuacaagucuauuuaauuuaauuugccuguggacuuaucacuuuuauuuguuuauuugcuuauuuauuuaucauuuuuacuuaccauguuuauuaguguuauuuuacaacacuaaaaacuuugaucacuaucauaguguuacugucuuuuuuauucauaauuaaacaugcagauauuugaguguguuuugcuuuucugguuaccgacuuuaggucuuccugagguuugcaguagcauuuuggagaaguuguugaaagaagguuauauuaaacauaaaccagaccaguugaccauaaaucaauaugaaccugggcaugguagguguuucuuuaaaaaaaaaaaaaauguuaguuuuacuuuuuagaucauuuauuuucuuucauguaggugacuguuuuaccugcaugaaucacauguguccuuagugcccuugaagaucaaagagagcaucaagugcuguggagcuguaguuauggaugguugugagcugcuguguagguccacugauagaguagcuagugcuuuuuuuuuuuuucgauaauuauuuuuuauucacuuuacaucccaauugcagugucuccucuccucuccuuccagucccacaguuagaaaugcuccucuugccccuccuuuucuccucagagaaggagaagcuucugcuugcuuaugacccaacgcugcgacacauagucccagcaggacuaggcacauucucuccugcugagacccaaccaagcagugcagguaggggaaggggugcucuuaaacuuagagcccugggcugaugagauggcucaguggguaagagcacccgacugcgcuucgaagguccagaguucaaaucccuuaaagcuguaucuuaacuguuuagccagacugacucagacuugagcugcuugugucucagcucccccaggccaggauugcaagugugugcuaucauacccauacuguaaguaucugaaccgcauauauuccugucuauaauccuuuaggagaauguaccuuuuuucuuuguauuguuucuuuguguugcaguucccuuagcaauggcugcuuauuuaccagaaauugugucuugauacacuuaguccuuacauuuguccucugcucuccaaguccuugagaaucccagugcuuaaaggaagaggaugggaagagagagagagagagagagggggagagagagacacuaguauuuuucuuccacauuguccucuuaugcuaugaauguuccuauuuaaauagugacucuugauccugaauuuuauagucaaguuucaguguggugauguugagauauuguuucagauuuaguuuaaauuuauugaaucauauuuauuaugcuugcugugaugguuuguauauucuugggucagggaguagcaccaucuggagguguggccuuguuggaauaggugugaccugguuggaauaggugugccucugugggugugggcuuaagauccucacccuaguugccuaggagucaguuuuccacuagcagccuuuggaugaagacauagaacuuucagcucugccuguuccaugacagccuggaugcugccaugcucccaccuugaugauaauggacugaaucucuggaccuguaagccagccccaauuaaauguuguuuuuuauaagacuugccuuggucauggugucuguucacagcaguaacacccuaacuaagacacuugccuuuaacuaagauuauuguagcuuuuaaagaaucaaacacccuuuucauuguccuuaugugcagcuaggugugcccagucugaaucugcaucggacaaugaaaugaugucauguuuucuaucucaggaauuccugcccauauugacacgcauucugcauuugaagaugagauuauuucucucaguuuggggucagcgguaagugcaguguaaaacauuuuucuuuuaaauuagcuuuuagcauauuuuuaccuugcacauugccucuccuucacccuugugggacuaucuacauuguaaagaaaauaaauaagauuuuuuuuuuuuuuuuuuuuuuuuuuuguaaauagaaagggcugggcuggagagacggcucaucaguuaagagcacuggcucuucuuccugagguccugaguucaauucccagcaaccacauuauggcucauaaccaucuguaauaggauccaaugcccuccucuggugugucucaauguacucacgaacaaaaauacaucuuaaaaaaaauaccauugauauuaaaaaagaaagaaaaggcuggguggugguggcagcaacacacaccuuugaucccagcacuugggaugcagaggcaggcggauuucuaaguuguaggccagccuggucuacaaagugaguuccaggacagccagggcuauacagagaaacccugucucaaaaaaaccaaaagaaaagaaaagaagagaagagaagagaagagaagagaagagaggagagaaagcauuacacuuuaauuacuuccagaggaggaaguuuuuacagucucucauuuuagaugucugaaauuuuaucuuauauaguucauuagaugauaugaaaaaucuauucauuuauguauccauuucacauuagcaguuaagugcaauccagauuuugucuagugccguuuggccaccuuuugaccuaccuuugcauccuugacaccuaguggcaaaagauaauaacugcaggaaguagacuaaugacagaacugaaguucacauaccugggaauuuuauucauuuuuugcuccuguuuuuuagucuuggucucuuuguccuugaacucccucuguagaccaggcuggccuggaacuuacaaagauccaucugccucugcuuccugagugcuagaguaaagacaugucauguaccaccauaccuacucacaugacagaucuuuuuacauaaguaccuugagucagaccuauuagacacuucagcagaggauuauuucugcccuuccaggucaaggagaggcccauauuauucagugcuuaauuucuguaguugcaagcugguaaccauguaaaaccaugauuuaaacuggugaauguaagcccuuccagcuacaguacaaauuacuacucugacagccaggcucagcuucuuggggcauguaagucaucaguccccaaccccauacuacucuaguggccuuacuggccauuuccagcuccuggagaugcaggcagcaaucuaugccuuacagaaaaagaacacaagaucuggccacaaaaucccaucaauuucuggguuuuucccaauaucaggacacagaaucccaccagucuacuugcucuaaggucaggccacagaauaucagcaauugcuaagcaugcccuaaaaucaguccauaaaaucccaacaguccccaggccucccuggaaagcucucccccaacuuagaaacccuacguacaaaucugccuccugcuuaguucuuugcugcuuccuucaugagcagaggcaaucacccuucugugucuuucucaauaaauuucuuaugugaaguuuguuggggguaugaguuugugguauuccucaguuuccaacugcuaggauacccuuccccuuagagcuguaauacuuauaguauuagcagcaaguuacacaugaacuuucagacagaaauaaaagaaaauaaauucagaauaauucuugaaauauugagaucaucugaucuaacuagagauugcuugaaaaucugaugucuccuggaggcaaauacuauuuuuugucuauccuccucuuguccucuuuauccuuccucuuuuugucucuuccccuauaucaauauaguucccaucucuauaguuuaaguacuuuggcuucuuaauguuugcuguauuuuugugaucaucuugaugcugugguuaaggaaacagaaauguuuguuggauacaguaaaaccaucguaucauuuacauauauggauucuugauauagagcuuuuuggaaauagcaugagagaaaaaacaaaaguuccuuuuccauguugcugauucuuuuuuguaguuuuagagggaauucccugagguuuuuuuuuucccaaaguugagaaaucagaaaaagaacaaugggagaucaaucuguuuucaacucucuacugagaaaagugauugcagaccucacuauaaugucuguggcuauguggaccucugaauuacagagcacugucuugguucccagcccagacucugcuuaaaggaagaggcuaccuuguaguguuggacuggaaguauccuguuagaucuuacaaacuggcuuguaggaaaaagauuaaagaagagggcagggacaagugaacgugguuauaggcuaauggguaagccagcauuucugcucugcuaggaagcuaucagcaaggugguaaguaaaagucacaacugugcuuucuguuucuccuugaaaaauguacuuugcuucucaagaaauaaugcagaugugcgggagcgagggaaguugacugcaccuucccaacaccuccaaagucacugaaaugguuuaauuaaagaugguaagauggggaaaucuugugcuuuguuuaacugaaaucacuuugaucauuauuuccauuugucaucucuugagacgugguuuucagcugcugguggaaugauaguuuuugguuaaaauuuucuuuguauuagcuagagagcauauauguuauaguuaugacagaaauagauuuuacuuuaaaagauaguuugaggguaaguaaaucuuugacauuuugaaaauuugaaaauuaaccuuucagauuauuaugcuacuuaaaauaagauucuaauucugagcauuuauuuuauuuaccaagugggauuaaugacauuaauuucuuuuuuuaauuuuuuuauuagauauuuucuucauuuacauuucaaauguuaucccaugacauuaauuucuuaaccaaaggauuaugauaggaauaaaaugaguuaauuuugugaaaaugguuuucaaacuuggacccauccauauagagucaaaaggccugguccauuaggaauacuuguuugaagcuggaagcauauguucucauccuuggcauccucauuuguuuuaguguaccuuuggaaccuagcugcugugguggcuuucuuuucuagccacagaagagcagauucuuguuuauugucaaagcugucaccauuuaauuuguaucagauucuaacuugcacaguaaacuucuucacugcaaggagauucugggaugcuagguuauugggugugugaaaauguuucaguagcuaacauuuaguguauaccugccuauagaauaggguacaagcuucauagcgaaccuauggcuaccuguauuuaugguagaauuuauagcugccuauuuacuaguguacagugucuauaucagcuuucugucucauuugaauacaauuuucagcagugucauuguuuuguauuuuaugccuuuguuugccuuuuuuuuucccucaccaccuaaaauccaagaagauauguauuuauauuacuuuucuccuuucgugggaaauuucuaagaucacuuuuaauacuuaaauuuucuaauucaagguguuccugggagguuuuuucuucauuuuaaacuaagucucauuuaaauaauuuaauuuauuacuauccuaggucuuaugauauuucuaaaaaaguaguguaagucagaaaaaauguugucagacaugcuaguuuauacauuaaucccaguacucaaaggcgaaacccagaagauugggaugaauuuugggccagccuggccuuuagagugagacucuguuacaaagucaaucugaaaacaguaguguacaucuuauagagagccaaguagcuuuaccuuuuucagauauauuuuuauugcuucuacagcuaaauuauggucaucuuaaaugcguuuguaccuuuggaauuaccucauguauguacgaauacauuucuuuauauguauucaugugagaaauuuuuagcugcaaauaagaaaaauuacaauuacauaguaaguuacguugauaucucagauaacaaaauguuguuugaagacuaguucaugcucuacuacacaagaucuagcuuagugagauacuagcaagagguagaauguauugggauaugaaaguauaauagauacccuguauaguuucauuuagguguuccuucaccaauagguuuguucugguauaaacugcagccugacuuuucuggucauguguuuuuugaguaauacccuuaccauaaacuuccuugagauaaugagcuaggaauguugagcagauaauccguuuggcaaaugccauaaggacucacucagcuggagagugaguuguuauuauaaauaccaaguuguuauuauaaauuaaaauuugaccagggcauaacuugaaaacugaaacuaaaaauuauggagaugguuguuuuuucuuuuuccuuuuaacaauauuuaauuuguauaguaacuacuacuuuuuaaacaaugaguuauauggacuuuauguugauacuguuuuaugguaacauaugaugacauaguaauaaaaaaaauuuuacuugacuuuuacagcuuuauuccaaaaagagucucuagcccacauauuucgaaguuuuuaucaauuuuuuugcuuguuuguugggauaagguccuccucugucauguaggcuaucaugguacucacuagcccagguuggcucugaauuaguuguaauucaccugacucagcaucugagugcuuggauuacaggugugagucaucauacuguuuuuccaggagucugucugagcuuucugauauucauaccacauuuagaagcucaaauuaugcccugauugcuauauuuucaaacacgaagugguguuggcaaugauuuaaauaauucuuaggcaucccuuuugucaacuuuagaaagucuuguaguauucuuuguuagaauuuguaacuuuaauuugcuuauauuuguauuacauuaguuagguuucuuugacaucaacauucacuaaaagaacugaaacugggcagggauaguagcugauguugaacauagaaaacuucauuacggggccgggugugguggcgcacgccuuuaaucccagcacuugggaggcagaggcaggcggauuucugaguucgaggccagccuggucuacauacagagugaguuccaggacagccaggacuacacagagaaacccugucucaaaaaaaaaaaaaaaaaacaaaacaaaacaaaaaaaaaaaacaaaaacuucauuacguuauuaauuuuauaaaauucucauuaccucugguuuugcauucaaggucaugaucacuuuagaaucagcaaacauuuuuuuuuugaagauaauuuuguaauuauuuuuauguacagaaaacuuaguguacauuuaacucaguuugguggugaguucuuuagcuuuugccuuuuccagcuuggcaaugugagccacaaacuugggacccaggacauugccucccuaguggcaacggaucucgucauaucugucauuauaauugguccuaauagcuuccaccagcuuagccagagcacccuugacuuccgaguuacccugugugaaggcaacaguggugcaugccuuccuguggaccaggcaccccagccuggccuuucccuugaugaugcaguagggcauacacccccaucuuucaacacagggcaggcgggaaaaccacuagcucaaugaggucuacaucaugggcaaucaccaccagcuaagccuucuuguucuccaccaagguggugacuguauugacuccugcuuggaggacagguggucucuuaguugggacgucuccuuugucagcagcuuucuccucagcaugugccaguagccuuugcugcuucucuugcuuugucucuggccuauguuuguggacaagcuuaaguagcugaguagcuguuugccuguacagggccugagugaacugguuaauggcaggagguacuuugagccucugcagccugauguaguguggccauuugaagaaggguguuggaucucuuuugggcuggauguccugcccaaugccaacguucuugggcauuuucucaaacaaaggauugaccaccuuuuuggccuccuguuucuugaugacagcagauguuggggccaccuucgucccucuuggccuucuuuccaucuugcucuggcgguggagagagcaucaguaaaaauucuugacauguauuuuaaggauucuaacuguuugugguauugagcuuugaacccagagccucacucaugcuaagcugugcuacugagcuauguuggugguccauauaacuuugcucugaagcguuauuuauuacauccuaugcuuucuuuugaaccaacuuuuaaaaggggagauuaacacaaaugagcucauguauaaugaagcucauaaauaaaugucucccauacucaaguuaacacaugcagccaucauccucuuuguuuccauaggcacuguuuccuucaguauuaugacaaaaaggaaaguguuucuagcuaaacuucuagacauuagaacaucugauguccuaaaagcauuuuagcuacucuucuucaagauuucauauacuauugccuuucagugguucucaaccuucugaaugcugugacccuguaauacaguuacucauuuguagugacccucagccauaagaguuuuuuuuuuucuuguuacuucauaguuguaaguuugcuacuauugugaaugauaaugugaauaucugauauuucugauggccauaagggucuguucaacccccaaagggauugugauccacagguuggaaaccaaugugcuaaugcuuucuuuuacuuuugaauguaacuuuggcacauuucaagacuuuuuccuuuuaucuuuuuguuuuuuaugguuauauuaugauggguuauuuuuuccucaguacugaugaaugguuugaauauucuacauugaguuuauuggguuagauuuguccaucguuuugcacagauguuagguacugucucuucauucugcuucugauggagaaaaguugaccagccaugugacauuucacacagaguggcuguugggggugucuagcugggcacuagauguaacugagcaacuaaaguucauggcagauggagaggugcagagauaagaauacugauaagagcacaguuuuccaggugggagauaguagcauccagcaacuuuuccaaaaaggaaaguugaaauucaacuacuaugugugugucugugucuuuuauccauggauucaagagaagcuaggugggagcugguagcaugucccauucccagagcuuaggcuggguagcaaaagcuacauacaacauuauagcauguuaaagguuuucuuuuuaaauuuuugugaguuuuuugguuuguuuguuuguuuguuuguuuaauaugcaugggugguuuugccucauguuuguguaccacauucaagaagugccugucuccacagaagaggucauuggaucucugcaaaugguucuaugcuaugugguugcuagaaaucaaaccugggucuucuggaagaacagucagugcucuuaaccacugacccaucuuccuaaccccuacauuuauauucuacuaaacaaagaauaaauaaagaauacuaaacaaagaauaaauaaaguagaguaaaccccagauggcaauuuuaaucaacauuugauuacuuuugcaacauaguauuagaaauuacaaagguaaagccuaugugagugucuucagaucuuuauaugcugguaccgagaguaggcuaagaacucgguaagccagacuuggauuuuagcucuuccugauuuauaaauuaaugaccccaaaccaguccuuaacaaaacguuuuaaaagguagaugcuggauagaugcaaggacaaagcaauaauguccuuuagcaguaauaauucuauauucaacuucucauaagcuugugcuguugguuacucagauuuguugcauaaaauauugauuggguauaucaggacaaauauuucaaacuaacuagucucacauuuauguucuugucaguacuaauuauuuacuuagauuucuguuuuuaaaaccauugccauccuuugaugcuggggaggguguuugaguuucacaacuaaauguguggugcauuucuaaagugauucauguuggccauaaauugugaccuuuagugagggagagcuugccccuugcauucaguuuugcgaucuuugacugauaaauauuuguugaugaaugaauuggaaucucauuuucuaaaguccuucccagucacagcauggaauuucauuuacuucacagcugaucaucucuaaugaaaauaauuuuguucacuauuuuguccucuuaugaggaccuuagcuuaacuucacaaaauuggaaacuguauauuuguuuaaaguaagccauguggguuuucuccuuucucucaauaauuucuuauaaauacuuucauacaaaagauuugaaagaauuuuaaauaucccuaaaccugcuccauagcuccugcaguuaacauuuauuauauuagcuuuacucagauaucacucuuucuccaucaguuuguuaguguguuuuauauuuacacauuccaagccaaucacaaauaagcacacuucaucuauacaaaccaaauuuauguauuguuuauaaauagagugauuuuagaauauagcuauaugaaauuauuuguggauauuuggggaaaaauguuuguauaaaauuuacucaguuaucuuacuuugcuauauuuauauugaaacaaaguagaaacaaguauguacuuguccaauucauuauuauuuagagauaguuuuuaugcauaucaucuaguauuuuguacaguauuauuauucagaauaacagugauagucacugacauuuguuguauuuuuuuucagcuacugugccaauucucuuuauccuacuuauauuuucugaucacauuuuaauuuuaauaggugauuuguucacauaaaguuuuuguuuucaguucuaugcuacacuguuuaaauucuguuucuuuggcuacugcuauccauagucugaagugccuucucggccauuguauuuuuguagggccauuuagaauauuugaauguaacuuagaaaaaguuguucugguuuuuuugcucauuuguuaguaucuaauuccaguguguuguaucuguguaccacauaggcucugaaucuaauaauuauuugucccuuaaauuauuguuuauuaacagucuauggauaauaaaaauaugcuccuuuuucauauuugccaugugccaaccaccaugguuuauaauauuuauuuauuauuuaauucaugcagcaaucauguaaggauuaaggaaaauagaugcagagaggcucacugacuauuacaaauggcuccuaaacugaagagccagacaaggaauguuucagcaguaugacacugcuuuagcguuucugaugcucugauccuaauacucauaguuuccugggggucauucuuagaaaugugaauuucguauuugccuaguaucaaucuuaauacaaaagcaugcuaccccaguagcucaccuaucuuuauuguauuguguuagaguaaguuguagcuuuauuaucucuuuuuaaaagauuuauuuauuuauuauauguaaguacacuguagcugucuucagacacuccagaagagggcgucagaucuuguuuaggaugguugugggauuugaacucaggaccuucggaagagcaguugguguucuuacccgcugagccaucucaccagcccccacuuuauuaucucuuaauguagaacuaaagucaacauaaaugaauuauucuuaaucccuguaguguaugaaaguagacucauaaccuuucuuggugauaaccuuuccauuuuugucuuugcuccaagauuguuauggauuucaagcauccagagggugucacaguacaaguuauguuaccucgucggaguuugcuggugaugacaggagaaucuagauaccuuuggacucauggguguguauuaagaugaauuuggugacuuucugccuagugaaacuucucauucuucuuuguuuacuaucugagcugcugaagccauguccugugcuauacaucaaaucauuuggguacagccuccuaagauauaugcaagguuuuuucuuuuucuuuuuuaauacacuaccuuuauauuuugaaaagacuucaauuuuaacgaaaucuuguaaauauaauagggcacacucccuucgcuuuucaccuauaauucucaguugugaacacuuuguguauuuucuuuuucucacauauuaucauugcuuuuacuugaucaucugagaauaacuuaucaugauucuucauuuuggugaaaauguauguuuacuuuuuuuuuuuuaggaaggaacaguauacugcuagaauguaugugucugagagaaagcauauguguauaugugucuaaaaauaauuaaaauauugcugaauuuuauauguauucuuuuuugcuuauaaauuuuagcugacauauuuuaaaauauucaagaaaaugauuauguuauuauauugguagcuugucuuacauuuuauuuauuuauuuauuuaaaauagauucuucucuuauacaguaauccuauccucgguuuucacucuguccacuccucccagcucucuuccaucuccacuuucgccccagauccucuucccuucuguuuccucuuuagaauagagcaaaccucuaagacacuauggucaaauaggaaaaaacaauauacaguaagauagagcaaaaaaaacccacccuaauauugguguuguacaaugcaaaccuauagcaggaaaagagucucaagaucaagcaaaagagucagagauauacucacuuccacuguuaggagucccauaaaaacaccaaacuuaaaccuacaacagaggaucugguucagaccugugcuugccauuucagugucuguaagcccauaugagccugucaauaucuagugcauuggguucccaaggauagagcugcauaaugaggacacaggggguacacaggcauagucagacaauguauacuuuauucaaaguuucaacaucuuuuauacagaaaacauuauaaagauuucccacaguuuuccauuccuaccaggugcuguuuaccuaguaauagcuuaucaugguucaaagugaccuauaucuccuugcagacugaaaaaucugucagcagucucacucuuuggugugaugucuaguuaaacuauaagcaaaguuacuuucacaugagaaaaugaacaugaaagcccuuuucucagguuugcaacguacuugguagaacgccaggauucuguguuugagaaacuaugcuucuucagucucagucugcugagaaugacaaagacucuagguugccucaaaacuaccagucugggagcagucuccuuaugcuaugucucuacaugagcccuauguaguugauuuaguggccauauugggccauauucugauguccuccguccacucugacuccaacaaucuuuccucccuucuuccucuuccuugggauucuggaaacugaaaggggaggaaccugauggagaccuucgguucagacucuguugccugauugugggucucucucugcucuuucuugaggaagucucucugaugacaaaugaauaaggaaacuaucuaugaauacagauauauaguaucauuaagaaagauugugggcuuuuuguuuuuuguuugguugguuuuugcaaguuguauuuuguucuacccagaucuuugagcuaugcagacucugguuccuagcuauguaggcaauguagggcaugggcucacucuugggccucaaguuaaaccaaacauugguuggcuacuccuacaaguuuugugcuaucuuacaagcaggaucgauuguaguaggucagggguuuuguggcugggcugguguacaaguugcucuucccauagccugcagauuaccuccuaguagcaaagagaauagaauguaggaaugaagacuccaugcagacaccaguuuauccucucuacauuugaugagcugugugaauuuuguccucaguaauggagccccaauuuccauggaaccaccuuagccagcaacacaaccaaaugcaacccagucacaccaguggaagcuuuggcuggcuacaaaagagagccaguucagacucuguauccuccauccacuguacuagguuuccacuccaucacacaaaaaaaccucuaaauuugaguugucucuuuuuguugugguaaaucuccaacccaaauaugccccugcaacgaaaacacaacucaacuaauaugaauacaugcugugcgccuagauugggcagaucuacugcuacacuaccaucuuccacaucuaugaggccccuuauaacuugcagguucuccaagccaugugcuuuugcucugcuuuucuuauucuuauucuucuuccuccucuguguccucucccucuuccauuuucuccuucuucucucccuccaccuucuguuccaccuucccuuuaucuccccaaaccugagugcugacucacaaccccucacaggagaaugaaauuaauaucaaauguaacuagccguggggcuauccacagcagucucucccugcagucccuuccuccuucccuucccacccaccccaauugaucacuuucaccuuccuuguuguguguuguuuccccaccuccaccaucaccaccaccaccaauucccucuccaaugaauuuuauuauaguugcucuucccagagagaucuauacuuucuccauagagcucuccuuuuuacuugaccucucugggucuguggacuguagauuaacuaacauuuacuuaacaguuaauauccauuuaugauggguagauacuauauuugucugaguccaugcugucucacucaggaugacuuuuucuaauuccauccuuuugccugaaaauuuuauuauuucauuuuuuuuuaacugcucaguaauacuacauuguauaaauguacauguucuuuauccauuuuuuugguagagguucauacagauuguucuaaauuucuggauauuaugacaaaaguugcaaugaacauaauugagcagugguccuggugguagcaugaaauguuuuuuuggguauauagccaagcgugauauagcuggcugagucuugagguagauugacuuccaguucucugaggaacugcaauucugauuuccauugugacuauaaaaaucugcauggucaacagcaauggagaagugcucuccuuguaccacauccuuaccagcauuagcugucauuugauauuuauugaucuuagccauaaugacagguguaagauaaaauguuaaagucacuuugauuucuguuuuacuaauggauugaauguuucuuuaaguguuuuucagccauuugagauuccucuguugagaauucuuuguuuagaucuguacaccauuuuuaaauuguauuauuuggggaguuuuuuguuucuuuguuuagcuuuuguuuuguuuguguuuuuuuuacaucuaaucucuuauguuuuaaauauuaaccucuaucuuauaugaaguugguaaauaucuguuuccauucuguaggccguugcuuugucugaaugacacuguuguuagccuuacagaagcuuuugauuucaugagggucuacucauuaauuauugaucuuauugcuugcacuauugguauucuguuaagaaaguuaugucuugggcgggcuggugaaauggcucaguggguaagagcgcugacugaucuucugaugguccugaauucaaaucccagcaaccacaugguggcucacaaccaucuguaaugggaucugauacccucuucuggugugucugaagucagcuagaguguacuuauuuauaguaauaaauacaucuuuuuaaaaaaagaaaagaaagaaaguuguguccugugccaagguauuaaagucuauuccuugcucuaucuucuaaccaguucaguauguugguuuuauuuugaggucuuugauucacuugguuuugaauuuugagcagagugauaaauaugaauguauuuuuauucuucuaaaugcagauauacaguuugaauaucaccauuuguugaaaaugcuuucuuuuguuccaguguacauuuuuuggguuuuuauagaacgauaaccacagguauaugaauuuuuguauagauauucaauucaacaccaucgaucaacauaaucucuuaguauuccaauaccauguugguuuuacugcuaaaccucuguagaacaacuuguaaucagggauaucuccaguaguucuuuucuaguucaggauuguuuuaacuauccugggauuuuuuuuuuccuuauaaaauuaguuauggucuuuuaaauguauguaaagaauuauauuggaauuuugauggagauugcauugaauuuguagauugcuuuugguuggauggcuacuuuuaauguuaauguuacugaucgaugagcaugggaaaucuuuccaucuucuuguaccuucuucaaguuuuuuuggaaguacuugaaguuuuuaaucauacaaaucuuucacuugcucgguuaggguuacccccaagauacuuuauauuguuuguggcuauugugaaaagaguguucuuucccugauuucuuucucaguccacuugugauuuguauauaggagggcuagugauuuuauauauauaaaguaaaguuaaacuacaauccacagacccaaagaguucaaguaaagaggagggcucuauggagaaaguauggaucucucugggaagaguaacuauaauaaaauucauuggagagggaauuggugguggugguggugggguaaacaacacacaacaacaacaaggaaggcagaagugaucaauuggggugggugggaagggaaggaggaugggacugcagggagagacugcuguggauagccccagggcuaauuauauuugauguauaucuccugugagggguugugaacgaaguauauauauauauauauauauauauauauauauauauauauauauauauauauauauauauauauauauauauauauauauauauauauaugugugugugugugugugugugugugugugugugugugucacccuguagaugaggcuggcuucaaacucagaaauccgccugccucugccuccagagugcugggauuaaaggcgugcaccacuaugccuggcuucuuucuuuauucuuauuauucuuugguuuggucauuucauaauaacauagauuuccuugauauuuugugucaggaacuuuuaaaaauugaacauuuauuauuaaaauguauguauuucuucuaucggaucuucagugucugaguuugucucuuuuaucucauguauucuguuggugaaguuuccuguucucauuucuaaauuuuucauuuccagaauucugucaguuugugauuucuuuuuugcuucuauuuccauuaccaggucuugaauaguauuguuuccuucaacuguuuauauuuuucuuggcuuuuaaaagggauuuauucauuuccucuaauuguuuguguuuuccucacuuucuuugaaaaauuuauucauuucugcuuuaaagaccucuuucaucuuuauguauuuauuuuuaaggucuuuugcuuuugcuuuggcuauguuggaauaucuaaaaccuacuguggugggauaacggggcucuguuggagacauauugcccuggcuguuacuaauuguguucuuaaucugguggcaucuggguuugguguguuguaggggcaauguuuuauuuuuugguuuuuguuuccucucugaauuuuuaaagaaucuuuugacugauuugucuuuuuuuuuuuuuucugguuuucuaagcugguauguucauggggaauguuugcaguagucuacaagucaguuucagcauuaggagugacccugaguuuugggucuuggggaacacagaaaguagagaaggucuauuggcauucuuccuugucaucuggcaggcauagccugugggagagcagugugugucuuccugaguugggguuaaagcacaguguugagguggguauaggagcccaagagggaaugugcuuugaguuccagggaugcgaggacaggaggaaagggagguuguagcuuauauucuguuguugcucuagaguugacccugagaauuugauuggagaagcagaguacggaagguugucaggcaccauaauggggacaagcuaauaacuagcaggugaucauccugagguggccugccucggauuauuauauaaucugcuacaggugagccccucauuaagcaaggcugugagggacccauuuuaagaaagauuccugcugcuaauaugcuuuuccuguuauuacuaaacauauauaucacuaagcaggagcacacccuuuuggagcaaaucucugcagauucaugaagauguacuaucuuguagugaugcuauauagacaaauagaugacuuaagucuuaaugaugauccuauaagaauaccuaaaauuauaucugugauuauuaagcucuuuuauuaaugggacugcuauuagguccuuuucugauagucaaagcugcaaugagaagucucccaaguaucaccaguuaauugcucuuagaugguaaccagacuuucuccuacccagaacauauuccaagagguuguaaaacaauuaaccaaaggacauuaaaagggaacuaaagauuuauuauauuuauuauauauuauauuuauuauauauuauauuuauuauauauuuauuauagguguuaggauaaaauaucgacuggguuuaucuauacaaaacuucacuaauaacuugguuaggguuuuaaaccuucaaugacccuguggagcugagagugauaauggauguuuaacaagauaauuacuccuaauggauaugcguguaaacauucccuguuguaaaugucuauuucaauuuaugauuugauuuuuuugugugugugaacuugugaugaacuuuguaacaugugaucauguauucucuccuccuccccucccuuccccuccacucccccucugucugucagucucucucucucucucucucucucucucucucucucucucauccaggcucuuuguugccacucauucuuaaacuuuuuaagaauaauggcacuuaaaguauucuauucuauuucuuuuuugguuugguuuuuuugagacagaguuucucuguauagcccaggcuuuccuggaacucacuuuguagaccaggcuggccucggacucagaaauccuccugccucugccucccaagugcugggauuaaaggugugugccaccacugcccggcuucuauucuauuucaaucuauagcaucuccugagaugauuuuugguuggguuuuccagcaaaguaccuuggcaggucaggaccaaaguaugcuucaaaaaucacaccaugcaacacuuuucacauuaaggauuuauugguugugggagcaagggaagcgaaagucugucucagaguugggacauaagagaaacagagacagaaagagaaaaagagcaugccaugaugguagggaccuuuuaaagggugcacaugccacacaggcagcuggugaugaaauagcugcuggugcugagucccugaaagugggcugggauuaacaauuuguucacuuuuuuuuaauugaaaauuuucaugccaguagugauuucugaaaguuuguauuguaagucacuccuguuuaaugcugguauaggauuguauauucuuuauaauauuuuuaggagaaagaaaaauaaaucucaacauuauuuuugaagguugcuguuggcauuacugauugauuguguauguguaagugugugagugugugugcaugugcuagugugugcacaagugugcacacuuuagaaagagaugaagggaaaggugggagguacucaaaaauggugaagagguugauauaaaaagaaaaacaaacaggauaccaacaauugaaauguuaauuaagaucuugugaaagggagaaaacauugaaguaagcaugaaagcauaggaaauaaacuugguaaaaaccuuuugauuuuuauuuuggagaaaacagaaaaaggguuccaaccugcuauauguaaauucuuucccaaguacauuguaguuuguagaguguuagagauguuaaaagauauauuaauuccaacauuuguuauguuucuuaagauauuguuuucacuauaaugucaaauaaguuauuuacuguuuucagaauuacaccucgaaaauuugauaccguccaagcgucugagcaauuuaaagggggaauaaucaccagugacauuggagacuugacuuuaagcaagaggggaaugcgcacauccuuuacguuuagaaaagugaggcgaaugcccugcaauuguaguaagucucuaauuucaucugugcugcaacagaauaaaucucguaagaaaaugcuuuaagacuaccagugcuuagggcuuuuuccuaacuuucccagugacaucucuuauacucuguucuggauuagcuuucccugcaguucucugagcuuucuucauugauguuuauauucuuugaaagcagaggcuauauuuuaucauuaaauaugggaaauagcuuucgcauuauugaaugccaagaaaaugcuucauuuuuuaaagugacagauuagaaaguguugugcuauucugauuuguuuacuuaaguauguugauuccuagauguauuucuuggacucaacagaaauucuuuuuauuuuauaaaugauaauuuguaaugauaaauaucagagaaugcuuuucauaucacaaguauuucaauuugggguaaccugcaguaguagccugcaguaguagcuauuaucuguaguaguaguagagcuguaauccuaaaaacauuuuaaauuaaaaaucuuuuaucucagggcuagaagaugguuuaccuguagcuucuuuccacuacccaaauuauuggacugucuguucagguccaaaagaucugauacauucuggccucuacagguacccguacucuguuuggcauguacaaucagaaacauauacacauaaauaaaaauacaaauaaaucuaaaagaacaaagccucuuacaucagaagauaguaauccuguuuaauaaaaccuuaaaauugcugaauuugugaggcaaaaaugaguguuuacuuauuuugcuaauggugucaauaaguuuauauaaugugauauuuuaaaauguuuaguacugggugaguuucccacuucuggcagcuuuaaacggaguagaaaagugaagcaaagcuccccuucuagagcuuuaaagcuuuaagcuacuuaaagaugugguuggagagacaagcuagguuucuuauacaaauguuucuuuguuggggaugguuauuaauuaaaaaucaaaugcuaaagccuuuguuuggucuuucuauucaguuuacagauguuucccuuuuuguuuccccuccucuugcuuuugugacaauuucauacuaauuuuggucuuuguuacucaccguuaguccucuccaagugacugccuucuucccaaaaaacuucccaccccuuaauuguuuuguuucuuuuuuuguuuguuuguuuguuuuauaauucauugaguuuaguuagaauuauuuguuugaguguggguauagaauuauuuucuggagcauggacuacuuaucauuggcagcauuaccaaagaaaaugacacuccuucccccaguaaccaucaacuacacuuagacccuguaccauacauggauuuuuaucugauacccuaauauuuugcauaaaagguaaaaguuuguuacuuuacuuauuuaaugaauuaauuuguuuaugauugauuuguuaacuagguuuauugauugauugagauagggguuucacucuguaagccuaggccacauggaaaucaauauauaauacagagugcccucaaauucuuauuagucuugcugcucaaacucucaaaugguaggguuguagguaugagcuaccacaccuggauacagaacuuuuucuuuucauauagguuacuccucagucugcgacagacaaaggaaggccacaccuccaucccuuacagagagcaguaaagaagcauuggaguuagagcaaaagcauguccaucaaguguacaaugagauugcaagucacuucagcagcacaagacauagcccauggccacgcauaguagaguuccugaaagcuuugccaagugguuccauaguggcagauaucggauguggaaauggaaaauaccuuggcaucaacaaggacuuauauauggcaaguaauugugcuacuucuucuuuuuuuaaauuuaaaaacaaauggggaggauauuguucauacaugagugcuguaauuuaacauuauuucauuccucccucccucucccuauuccaauuucucauauguuucuuucauucuuuuugaacuccaugaccucuuuuauuaaacuguuacuguuauauauaaauauucauauauauauauauauauauauauauaugcauauauauauaugcauacacacacacacacacacgaagccugcugaguccauuuagugguauuuauguauauguguguguauauguguuuaggguuaauaacuugagacuggauaaccuauuagagaggcuucucccugaagaagaugcccucuuucccucucucauucgucauuaacugcccacaauucuucauacaggagugggccuugugaauuucugcccaucuacauuagcaugucaucugguauugucauuuuucaggucuugauuaggcagucauauugagauuccauuguauagcuuuccugucauauauagaagaugcugucuuauagcagaugucuuguuccucugguccuuacaauguuucuacuccucuuccaguuuuucugcuuuaugcaucugcuuuaucuuuauaaggaaaaguucucuauaaaaucucuucuaaucuauaguuuauaaucauaaaauaguugauucaugaccacacuagaaaguaaagucuaaggacaagaaaaauugcaaagaguacaauggucauaaauaccuagggaaacagaaaaaagaauuggagaagucuuggggugauaccucaguacauaaauugcuuuccacauaaacaugagaaacagaauucaauccccagacacucacaucaaaagcuggguacaguggcacaagauuuucuucccaguacugggaagcagugacaggaggguccuuagggcucaaugacuaaucagcauaccugagucaggcaucauugagagauuuuuaucucaaaaaacaagauggacagcuccugaggaaugacacuugaagcuggucuacggccuucauaauuguacgcacacauguauagucaccaacaugcacgcaugugcauacuugugcacacacacacaugcacacacauaaacacacauuuaagagauaaaaaagaaugggcauguuugcuaacuuuuagucuguuguaauaacuuuuuuuucaguggccuuaauaacaacaguaauauacuaugacaaggaagcacaaaaauagaagcacuauaaacccugugucuuagcuuggguuuuguugcugugaagagacaacaugaccaaggcaacucucaucaaggacaacauuuacuuggggcugccuuaaaauuucagagguucaauccauugucaucauggcaggaaacauggcagcauacaggcagacauggugcuggagaaggagcugagaguucuacaucuugaucugcaggcagccaggaagagauuucuuccugcaggcagccaggaggaggcucccuuccacacuggugaaagcuugagcauaggaccucaaagcccacuccaacagugacccuuuucuuccaacaagaccacaccuauuccaacaaggccaugccuccuaacaguuccacuucgcaugggccaaacauauuaaaccaccauauccuaauuccaaacguaaguguaacucuugcagcucaucaaaaaagcauuuuuuugagcagaugaauacuauuauagaaagccacaacuagucaaaauacaaagaacaauuaguugcugaaugccaacuucagcauagccccuauaccuaaauaacagacuugauccucaguacucauucauucauagucagaaaaggaaaguauucccucauagauuuaaaauuuuaugaacuuaaccauucuagauccagagguaaagccauuuccaauucugcaauuaucugcuuucauuuguuauaauuuuguucuuugagccaccccuuuuuuuuaauuuuuccuuucuaugugaagaaaguucuaugugugguaggcuuauccacauuaucuauguuaucacugcucuggaugacuaaaacuuuuauuucucaauauuagggaugaagaggggagggaaaggaaagagggaaggaaaagaggaagaaaaugcaugaaugaaugagucagucuauauccaaguuauugaaauaucucagauuacuuggaaucuuggcuucauucuccaccuuuaacgcuguguaccaacacaaaggaaauacuaccacugcaauuaagggaacuuagagcuaacacucaguggcagaagaaaagaauaguuuuccaucaacaacaaaaugauacucauguauuguuauguauguaguucaauuucaguuugugaauaacagacuaauuugcucacaaugcauagguauuccuuuuuuauuuauuuuuauuuauuuauuuacuuauuuuuguuuuuugagacaggguuucucuguguagcccuggcuguccuggaacucacuuuguagaccaggcuggccucgaacucagaaauccaccugccucugccucccgagugcugggauuaaaggcaugcgccaccacgcccagcuuuuuuauuucuuuuuuauuucauuguuuuucauuagauauuuucuucauuuacauuucaguugcuauccugaaaguccccuauacccucccaccccuaaucccccgcccugcucccaacccacagacucccucuuccuggcccuggcauuccccuguacuggggcauaaugaucuucacaagaccaaggaccucuccucccauugauggccgacuaggccacccugcuacaucugcaacuagagauacaguucugggggguacugguuaguuaauguuguuuuuccuccuauaggguugcagagcccuucagcucuuuggguauuuucucuagguccuucuuuaggggcccgguguuccauccaauaaaugacuguaagcauccacuucuguauuugauaggcacuggcauagccacacaagauauagagauauaaucgggguacuguaggcaaaaucuugcuagcauaugcaauagugucuggguuaggugguuguauaugggauggaucccuguguggggcagucucugaauaguccuuucaucugucccagcucugaacuuugucucuguaacuccuuccaugguuauuuuguuccccauucuaagaaggaaugaaguauccauacuuuggccuuccuucaucuugagucuccuguguuuugcaaauuguaucuugaguagucuaaguuucuggguuaauauccacucaucagugagugcauaucauguguauucuuuugugauuggguuaccuuacucaggaugauauucuccagauccauccauaugccuaauaauuucauaaauucauuguuuuuaauugcugaguaguacuccauuguauaaauauaccacauuuucuguguccauuccccuguugagggacaucugguuucuuuccagauucuggcuauuauaaauaaggcugcuaugaacauaguggagcauguguccuuauuacaaguuggaacaucuggguuuaugcccaguagagguauugcuggaucuuccauuaguauuauguccaauuuucugaggaaccaccagacugauuuccagagugguuguaccagcuugcaauuccaucaacaaugaaggaguguuccccuuucuccacauccucaccagcaucugcugucaccugaauuuuugaucucagccauucugauuggugugagguaguaucucaggguuguuuugauuugcauuucccugaugauuaaggauguugaacauuuuuucaggugcuucucagccauucgguauuccucaguugagaauucuuuguuuaguucuguaccccauuuuuuaauaggguuauuugauuuucuagaguccaucuucuucaguucuuuauauauauuggauauuagccuccuaucugauguaggauugguaaagauccucucccaaucuguugguggccuuuuugucuuauugacagugucuuuugccuuacagaagcuuugcaguuuuaugaggucccauuuguugguucucgauauuacagcacaagccauuacugcucuguucaggaauuuuuccccugugcccauaucuucaagguuuucccccauuuucucuucuauaaguuucagugucucugguucuauguggaguaacuugauccacuuagacuuggacuguauacaaggagauaggaauggaucaauuugcauucuucuacaugauaacagccaguagagccagcaccauuuguugaaaauguugucuugugcccggcaaauacagaagugaaugcucacagucaucaauaggaugaaacacagggcccucauggaggagcuagagaaaguacccaaggagcugaagggaucugcaacccuauagguagaacaacaauaugaacuaaccaguaccccuagagcuuguguaucuagcugcauauguaucagaagauggccuagucagccaucauugggaagagaggccccuuggucuugcaaacuuuauaugccccaguaacaggugaaugccagggccaagaaguaggagugaauguguaggggaacaguucuaggggaggguauagggaacuuuugggauagcauuugaaauauaaauaaagaaaauaucuaauaaaaaaauauugaaaaagaaaaaagaaaaugcugucuuuuuuucacuggaugguuuuaacuccuuugucaaagaucaagugaccauagguguguggguucauuucugggucuucaauucuauuccuuugaucuuccugucugucgcuauaccaguaccaugcaguuuuuaucacaauugcucuguaguacagcuugaggugauucccccagaaucuucuuuuauuguugagaauaguuuuggcuauccuagguuuuuuguuauuccagaugaauuugcaaauugccuuucuaacucagugaagaauugaguuggaauuuugauggggauuucauugaaucuguagauugcuuuugucaggauauccauuuuuacuauauuaauccugccaauccaugagcaugggagaucuuuccaucuucugagauauucuuugauuucuuucuucagagacuugcauauagauauuucacuuccuucuuucacacuaagguauuuucuauuauuugugucuauuguguaggguguuguuucccuaauuucuuucucagccuguuuauccauuguguagagaaagcccacugauuuguuugaguuaauuuuauaucuagccacuucacugaagcuguuaacagguuuaggaauucucugauggaauuuuuagggucacuuguauauacuaucauaucaucugcaaauagugguauuuugacuucuuccuuucgaauuuguauccccuugaccuccuuuuguugucuaauugcucuggcuagacuucuaguacuauauugaauagguagggagaaagugggcagccuuuuaguggaauucuuuccagcuucucuucauuuacuuugauguuggcuacugguuugcuguauauugcuuuuauuauguuuagguauaggccuugaauuccugaucuuuccaaguuuuuuaucauggagggguguuggacuuugucagaugcuuucucagcaucuaacaagaugaucaugugguuuuugucuuugaguuuguuuauauaguggauuccguugauggauuuccguauauuaaaccaucccugaaucgcuggaaugauggacuauuguuuugauguguucuuggauucgguuugcgaggacuuuauugaguauuuuugcaucgauauucauuagggaaauuggucagaaguucucuuucuuuguuggaucuuugugugguuuagguaucagaguaauuguggcuucauagaauuaauugaguaguguuccuucuguuucuauuuuguggaauaguuugaggagaguuggaauuaggucuuuuuugaaggucugauagaauucugcacuaaacccauccaguccugggcuucuuuugguugggaggggauauggggcuguauagaucguuaaucugauccugauuuaauuuuaguaccuggaaucugucuagaaauccauuucuugcagguuuccaguuuuguugaguauagcaaaaucauuucugauuuuguuaguuaggauguugucccugugcccucuagugagucuggcuaaggguuuauuguuggggccggcuugaggcucucauguaagauuucgagccugggaggcagccuggaucugaaagaaaaggaaacuaggcagagagagagagagagagagagagagagagagagagagagagagagagagagagagagagauauggaaccaauacaguauucugaucaaggcucaaauuuuuaaugggggacaagcuuuauaaaggaggggggaagcccauuccugccaaaucauacucggagcccagcugcaggugaccaaguguaggaucagauguagacuguggaacagcuaggcagacucccagcagguagcagcagcagcaguugcugaacaauagagugauccagggaggcaggcuccacccuaggugaucuccuuaguagcaacaaagucaaggucuggcucagccugcuucaggcuuguuagaggcuacaguuuaucuuucuuguugauuuucucaaagaaccaacuccugguuugguuaauucuuugaauaguucuuuuuguuuccacuugguugauuucacccuugaguuugauuauuuccugccuucuacucuucagugaauuugcuuccuuuaguucuagagcuuuuagguguacugucaagcugcuagugugugcucucucuaguuucuuuuuggaggcacucagagcuaugaguuuuccucuuaggaaugcuuucauuguuucccauaaguugggguauguuuuggcaucauuuucauuaaacucuaaaaagucuuuaauuucuuuauuucuuccuugaccaaguuauccacgugaauguuggcuuuguuuuauuuauguuguuauugaagaucagccuuagugcauggugaucugauaggaaucauggggcaauuucaauauuuuuguaucuguugaggccuguuuugugaccaauuauauggucaguuuuggagaagguaccaugaggugcugagaagguauauccuuuuguuuuaggauaaaauguucuguagauaucuguuaaauccauuuguuucauaacuucuauaaguuucucuuuguuuuuauuuaguuucuguuuccaggaucuguucauugaugagagugggguguugaagucucccacuauuauugugugaggugcaaugugugcuuugagcuuuacuaaaguuucuuuaaugaauguggcugcccuugcauuugaaacauagauauucagaauugagaguucaucuuggaagauuuuaccuuugaugagugugaaguggcccuucaaaguuauuuuuuaaaauaacuuuggaaguugauuuuauucgauauuagaauggcacuccaccucguuucuucagaccguuugcuuugaaaaucguuuuccagccuuucacucugagguagugucuguuuuuuuccucugagauggguuuccuguaagcagcaaaauguuggguucuguuuguguagccagucuguuagucuauguuuuuuuuuauuggggaauugaguccauugauauuaagagauauuaagguaaaguaauuguugcuuccuguuauuuuguuguuagauuugggauucuguucuuguggcugucuucuuuuagguuuguugaaggauuacuuucuugcuuuuucuagggcauauucuguccuuguauugguguuuuuccauuauuauccuuugaagggcugaauuuguggaaagauauuuugugaauuugguuuugucaugggauacuuugguuucuccaucuaugguaauugagagguuugcauaguagccugggcuggaauuuguguucucuuagugucuguauaacaucuguccaggaucuucuagcuuucauagugucuggugagaaguguggaguaauucuaauaggccugccuuuauauguuacuugaccuuuuucccuuacugcuuuuaauauucuguguuuauuuagugcauuuuuuguucugauuauuaugugucaggaggaauuuuuuuucugguccagucuauuuggaguucuguaggcuucuuguauguucaugggcaucucucucuugguaugggaaguuuucuucuauaauuuuguugaauauauuugcuggcccuuuaaguugaaaaucuucauucucaucuacuccuauuauccguagguuuggucuucucauuguguccuggauuuccuggauguuuugaguuaggaucuuuuugcauuuugcauuuucuuuaauuguuguaaucauguucucaauggaaucuucugcaucugagauucucucuuccaucucuuguauucuguugcugaugcucgcaucuauggguccugauuucuucccuaugguuucuaucuccagaguugucucccuuuaguuuuucuuuauuguuucuacuuccauuuuuagauccuggaugguuguguucaauuccaucaccuguuugguaguguuuucauguaagggauuuuuguguuuccucuuuaacggcuucuggcuguuaaccuguguuuuccuguauuuccuucuuaaaguccuccaucaucaucaugagaagugacuuuagauccugucuugcuuuucuggugugaugguguauccaggacuugcuauggugggagaguuugguucuuaugaugccaaguaaccuugguuuauguugcuucuguucuuacgcuugccucccgccaucugauuaucucaagugcuugcugcccucaauauaucugauuggagccuguccuuccuauaaucccaguugauucaggacuccucagaguccagcuuucucugugcuccuuugauugugggcuccugugaaccugagauucugggugugucagaguucuuggcagucaagcuccucugagacccugaaauacuggugugacccaguuccuguuauccugggauccuguuguccuaagauccugggcauguuacagugccuggaaauggugucuucuuugaggacaguggagcugucuugucuguuugaaaccaagguaaaccagaacugaucaaaagggaccugagcugagccucuggucaggaagggcuccgguguccuuguuucugcugucacaggcccgucacaauuggauuggaacugauguuguguucugcucaccagugauccuaagaccguguggagaguccucuagggacagucgggauguccgccgacucugugcccaagguaaccuggugcuggugcugacugggcgggauuuauuccauuggucaggccaguuuucugcuucccuaaugcugucucagguccugcgagauugaauuggaacauauguuguguucugcucaccaaugauccuaagaucgcguggagaguccucuagggacaguggggguguccgccaacucugugcccaaggugacccaacuggaagggacuugugccccuggucaggccgguuuucugcuccccuaaucgauauuuugauuuauuuaaaacaguuugggaguucucugcaguccacucugcauacugaagggugugcuuaccuucuuuuuuuuauuuuuuccuuucuuacuugccaagguaacaaucaauuacuuucgugcuuuaaaaauuaugcauuugauaguuuagcaguagaaaauggaacuuuauuuuaaugauuuuuuuuuuuuauguuuuacuuauacuuccagagucauguauuuauaguuuugguuuguuuaguuauuucuuugaaauuuuuaaaaaucaugaaguuacaguuguggagaugguacagugcaucauacaagugcuuauguacaaggaaaaggaccuaaguugaaauccucagaacccauauaaaacccagauagcagguaauaggugucuguaauccacacucucuuccaaugagaugggcaguggugacaggagaauucuuagaaaguggugggccaauuagcccgguguaaauagcaggaagcaagagacucugaauuaagcaaguuggaaugaaaagacuaacaccugggguuguccucugauguccacacaugugcuuuggcacacaucuucuugacaacauaaacacaucacauguacacacauaacacauacacaaacggaggagauuaaagaaaguauuuuuaaaccuaacaugaauguuuauguccuugauauccauccaacagaaugaaauauguagcuuugaaaguguccuuggguucaugguuuucuuauaaauaggccaucuuucugcucuguuguagacauuaugcagaauuaugaagaacuucaaaaaugugauacuauucuugguguuuauaaaagaaagauaaaacaaaaaacaacaaacaacacaaaaacgugauuugaacuaugauguauggaagacucccacacuuuggccacuaucaguaguauuugugugauacaaugccuauucuuucuuguugaugagaaggaaugcuauguccaaacugucaaaagcaucuugugagaggagagaggcauuuccucugauuuuacaugaaugcuguucugauuuucuuugugauucuuagcaacuuuccucugaacaacuugagaccuaccuuuaaaguuuuguuuuucagucagauuggauuucuuccuguuagcuuuuaguaagauuuagcuuucagucacaacuaggcauacuuauggcuuauuauuuuugaacugauuucaaauguaggaaaauauagccaacaucaaacuuaguguauauuacuugacuggaguuuugacucagaauuugggcuuaauuggcugaguuguauagaauauaaauggaaaaaaaaaaaugaaugugaucagccaaucauggaucuugaauaaagaggagaguuaggaaugauucugguccuguuauuaauagcccauugggacaccgcauauggaauuauaucaaggaaagauugcuaguugggaacuuuuauccaacuucaaaaauuaaagcagcucuaaggguuaaagaauuguuuugguaagaaaaucugaauucuuuauuuuuagcagaacugcaagagccguaagagccaguguuuauuauaaugaaaaauaaaugaguaaauaugaguucagacuggccaccauuguuggauuaaaucugccacuuuaauuacacauucuuacagaaagaaaagcauugcucaguauuggauuugguuaggaaaaaugucuagaauaauuauuaaaugguggguuaccacuucuugggucucuuuuauaucgucguuaguuuacauguacacauaacaguuauauguguauagcugugcauguacauauacguagguaugcauagugcauaaauauuugguuguuuguauauauguuacuaaauaggagagcuuauacaaaaacaacagagguauacugaaaaugaagcccuugaaaauuuuagacagaaucgagaucauuauggggcugccucauuaggccuuaccugcuuggggaaguggaaauguuugcucugcuugcugccuucagugguaccauucccuuaggaugcaucuccuauaagaaagguauaaacaaauauaguguuuacaaauuguuaguucaguacuuuguuguuuguaaggcuaggcugugggauccagaaucaaggaggggaagaggaaaguggagucaccugggaaacaaacuccagaaaccaauaucaaggugcagaucuacugugcaaugcagaucuguauugcacagcagcaagccuuuuuauacagccuuggacuaaugggaagucaacaugagcucuggaguaggcaacgaucccucugguauuauggagaaguuccaggcugccaguacccgaggguuccuccuuaaagacagggaaagcagccaccacccuguuuuggagccauucugagauuucacugauuuuucuaggauccucuguuuggugucaugugguaugccagcggauguagacacuuguacuauuagaguguuauagaagccucccucuucaucaacugagcccuacccaggagccacaacacccagaucagguguuuaacagaaaauaggagcugggcgugguggcgcacgccuuuaaucccagcacuugggaggcagaggcagguggaucucugaguucgaggccagccuggucuacaaagugaguuccaggacagccagggcuauacagagaaaccgugucuugaaaaaccaagaaaaaaaaaaaaaaagaaaauagguuuaauaguuuuaaaaacugaaauaaucuuuaccaauaauaaaaaaaaaaaauacaaccaaagcacaccaccaacaaaaauaaacaggguuucacuguuuaauacuggcuggccuugccugccacugcuuccaacaugcuaggaugaacuauuugugcuacuguauaugaccuccacuuuuggggguggaauggaaugguaauugauuuuucugacuauagucaugacuuuguacugacuguuaugacugguaaugucgccuuaugaauaugagccauaugugauuagucuaaaguaugaaauaaacuucuugugauauauaaaugaaauguuauuuauuuauguauuuauuuauuuaucuuaaucacagauugggugugaucguagccagaaccuuguggacauuuguagagagaggcaguuccaggccuuagucugcgaugcgcuggcuguuccugucagaagugggucuugugaugcuugcaucucuauugccgucauucaccacuuugcaacugcagugaguguugcuuuucuuucuguaaggguuuguaacuaaaauggcaggaaaaguaugggugugugugggucaaaauaagccuuuccuuucuuuuuuuuaaugauuuauuuauuuauuuuauguaugugauuacacuguagcuguacagaugguugugagccuucaugugguuguugggaauugaauuuuuaggaccucugcucucucuggucguacccacucuaucagucccugcuugcuccagccuaaagagcucacuccagucaacccugcuugcuccagucaacucagcuugcucagucccugcuugcuccaacccaaagauuuauuuauuguuauaaguaaguacacuauaggugacaucauaugcaccagaagagggcaucagccaccaugugguugcugggauuugaacucaagaccuucagaagagcagucaguguucuuacccgcugagccaucuaucuugccagcacaagccuuuccuuucuucaauuucuuuucuuucuuuuauuuuuuucuaguuuuuucaugguuuccacaugaaguauccuccaaaaauaaaaaaauuaaaaaggcuuuuauguacugaaggcuuggccccaagcuuguuuuucuguuagaaagugauuggguaaugaggguacuaauuccaucagugggucaauucacugacuauuuuauguuguaugcacuauuaagagguggggccugauuuaaagaaaagaguucaccaguacaguggcuuugaaugacauaucuugcccugguuuccucucuuuucuucugcuaugugcugcaaucagauaagcagcucugccaggauguucccuucugugauguucugccuaauaguccuaggaacaagaaacuaaaaggauauggacugaaaucugaagucugugaaccaaaauaaaucuacauuuguaauguuuuucuuggacauuuuaccacagugacaaaaaaucaguaauaauucuuuuugauugcuugcuguauaguuuuaaugcaguuuucccuccuccuuuagcuuucuggauagucuuugguuacuuuuaauauuuaccauaggugaccaauaucuaccuaugacauuagucuacuuugugcuuuuauacuuggcucuucuagcaagauaagacaucagaacagcauuuagcuccucugucuuucaugguagcauuacuauauauuguuuuuguuguuuuaggcucuugguauuuauuuauacuguugaauauuuacucugggcuggugagauggcucagcgguuaagagcaccaacuacucuuccgaagguccugaguucaaaucccagcaaccacaugguggcucacaaccauccauaacaagaucuaacuccuucuuccagagugucuaaagauagcuacaggguagucacauauaauaaauaaauaaaucuuuuuuaaaaaaaaaaaagaauauuuacucuaucuaguacuucuucuuugaagcacuuuuuuuuuuauuggauauuuucuuuauuuacauuucaaauguuauccccuuucugguuuccucuuuggaaacuuccuauugcaucucuccucccccugcuucuaugaggguucucccccaucccccauuaauaguugcuuuaauauacucauuuauaauaugagucacuauaaaauaauugaaaugaugaaauauaaaauuuuuaacuugcauuuuuuuuauuuguugucucucuguguguguauugaugugacugugcauuugccacaggguauuguuuguuuugucagagaugaacugugagacugaauuuuauccaccaaauggguucugggaguugauucaggucaucaggcauugacaagagcauuuaccuacuaagccaucucccuaccccaaauuauacaguguuuaauucuuaauuauauugaauauagcuguguuuuucuaugacauaacagaguuguaccuagagccugguguccuuaggccacugaaucuucuguuuucugcuuguauuuuauucccucucacugugaauuaaaauucagucagguccagccugcagacuugcuuaccagugccuuagccagcuguuauauguacaguuuugagcaccagcaaacaguuauacauuuaauuggguuuccccacuucuuuucucugucuccucaggguugauaaauuacagucaucucauuuuauuggguuuuuuuuaggagcgcagaguggaagcucuccaagaacuugcccgucuccugagaccuggugggcaggcccucauuuaugucugggcaauggaacaagaguauaaaaaucagaaguccaaguaucuuagaggaaagagaauuagccaaggagauaaagaugagcuaaacagugccacaucuacggaagaauuucuaguaaaucaaacgccugagggggucaaugaagacccagcauugucugucaacuccaguaguaucaccaaggaagaagaguauaagucaaggaaaguuccuaauucugaacucccuauucauauaaauaggaccugcuuucauucccaagaugugcugguucccuggcaccucaaaagaaacccugguaaagacaaagcuauugaaccaucugguguagcaggauguccugacccaaguccuguguuucaucguuauuaccauguuuucugugauggagaauuggaagcuucaugccaggcugugggugauguuagcauucugcagagcuauuacgaucaagggaauugguguguuguucuucaaaaggucugaucacuuaucugaacauaucauguguaaagagaaaaaaaaaagucaaucucuuuuugaaaaggaaacuaaauuaucucuuuaaauaaggaggaaauuuggaacagagauacuuaggaaacauuuuucucuauucccguugucugacuucauaaacguagguuccucuuacaugccuuuuaaguaugguguuugacauuaacuugugaaaagucugugauguuuguauauauauagcauuugaagauaaacuuuuguguuaaaaucuuuuuauaacuccaacuuuuguagggucauauugaagcaauuaugugagauuuuaaugaagugaauauuccuggacaauaaggaaguaucugaagagcugggugugguggcgcacaccuuugaucccagcacucgggaggcagaggcaggcgaauuucugaguucaaggccagccuggucuacagagugaguuccaggacagccaggacuacacagagaaacccugucucuaaaaaaccaaaccaaaccaaaccaaaccagaaagaaaaaaacaaauauauaucugaaguuuuaucugaaauuguuuguuccaaaaaaaaaaaauuauacuuucucacugcaucuugcuauuacauucuggaugccugcccagaaacacuuuagccagaagauucucaguaauuaauagaaauuuaauucaacagauacucauuaagcacacacccuauacugaguaguauuaaauacuaggagugaaguuguaaacaaguaaaagagguugggguguagaugaauugaagaaccuauguuugucauugaagcucuagauuuaguacugauuaccacaaacacagacaaaccagcaggaaacaagaacgaaguaccuagggagcugaccuucaagaagggauggcugguacaagcgaacaaauaaguaaacaugguguguguggugaucauaaaugccauguaaagaguauaaaagucuuugagcaaaagauuacuuuucaauggcaaaaauaacuacuaaucccgacuaauuuauuaccagaaauuacuauuccugauccauuugucuaagcucuaaacacaacucuaauaguuuccuugaacaguuaaauugcaaaaguuaaaauguuuucagugaaaccaaacauuguucuugcagucacaguuggcuguuucuuacucacaguuugucucaguucaggacagggguugcauuuuuaucuagucagugaaaccaaaagcauguucuuggaaaguauuaguaaaauugaugaauaucuacccagacugaguauaccagggggaaauuuuugugauuuuuguaauugccucaauuaaaaaaaauaauuaaaaauaacauguaaauguuuuaaaaccaucauguucuuuaaaaaaauguuuauaaugaacaauuuuuaaaauuguaguaggauuuuuuaaaaauucuauuugcauauacauuuuguugucuauuuuuuucucuuuugagaggguaucucauaugguccagguugaccucaaucuugcuauguaaccaaggaucaucuugaaaccugauucuccuacuuucaccucuccaguccugggguuacauguaccaucacagcaggcugaaguuuguaaguguguguguguguguguguguguguguguguguguguguguguaugaaaaaauuaagauguugguuauauauuaaagcagcaguucucaaccuguaggucaugaccccuuugggggucaaacgacccuuuuaugauuaccauuggaaauaauaaauauuuacauuaugauucauaauuguagcaaaauuauaguuaugaaguagcaacaaaauaaauuuauaguuggggucgccacaacauugaagggucacagcauuaggaauguugagaaccacuguauuaaaggaacauguagaccagugaaauggcuuaauugguacaggaaugugccaccaauccugacacccugaguccccagaaccuauauauauccacuuaugccuaugcauguguguauaagcaugcaaucacacauacacacgcacaaacacacacgugcacacaaauacucauacaauuaaauaaauaccuccuuuagagaaaggguuucacuuuguaguuugacugucuuggaacuagcuaaauugaacaggcuguucuugaacccacagaaaccugccugucucugccaagugcuggaauugaaggcaagugccaccauguccagcuaaauacauuuaaaaaaaagauauaagauuuuuagcuauuccuaaaucaaaauuugaauauuguucuugugaauuc

SEQ ID NO: 4913 - RNA, 22263 nt, Mus musculus
cagacguuaccaggcuccaccccuuuucaggcgucugugcgaaguagcuggacgcccggcuuagaaguuucacagacccccccacccccaccuuuaguucaggguugagcgugggggcguggccugacgcagcuucgcccccaaccuguacgucuccuacggaagccggcagggcgguuuggggcggagauucagagucaacccagagcucugcggcacggcgugacgucuugugagcuuagcucgcucuccucggaaagggcgggaccagaguuucucagaaccguuuuagcugcucacucuggagaaagagcuaacgagacagucgcacaagccaaucgcagccggaguuuacaggcugggccuggguggagacuucaccgacugcaguugcaggugggugagcugugcgguuugagggaggagugggcuuggaccggcuuggaccggcuugaaucuggcuguuggaggcaaggcuccuacuacucucgguuguggugcaucucgugagcgcuccggaaaggaaagguccgcagcgaggagccuucugcacagggaguucuauauggcagccggcagggaggugacccuucccuucguuugccaaugggcccuccgcagaccucccugucuaccccgggccaaccgagaacagaaucgguggugcaagcccucuaagcuuugcugugccccucaaggguucugcgcaccuugaugccucaugcuguucuuccugccgucacaccagugcauuucuguuuccuugguugcuuguguagauggaugucggugcucuucugugaacauccauuugaacaaagucgaggacgaguuaggguccauggaaaaguuggucucugcagaugaauguggauuucguggaugaugguagauaggugucaugcugauucaaccuuucuaagguggccagaaaguaucugggaaagcuagcaauaaucuaaucuacacaaccacuguccauuaguucuguauuccuagagauggguauagucugaucuguacuuauucccauuaacauuuuuugugauauuacacaccccucgagucuucugcagcuacauggcaguuugagucacucacacacagacauugcuaucuugauauaaccccuuaucuguuaaaagagugagugaggugcuauuuaagaugugaauauugcaaagaccucauaaugugacaagguaucugaagcacacagaaaaagcuacaguaagcaauguggggaugaauaaagacagcaagcacuaauacccuuaucaguaauuauaauaauucaaguucuguuuuucauccuauguagcuaagaauccuguuauagugucuuuccccguguuuuugaugauaguguggugacgugggccagagcaguucaaguaggacaaaagaggaacaugacuagguucaugaugacuggacguaaugguaccaaaagaguauugucaagcuuguuauccuggauaaggaguagaaaauuacaguggugccuaggggagaauaggaagucaagagauggggauuuuuuuguuguuguuguuugauauguauuuaaagauaagaguacuggaauugcauguuaugcuaagugucuaacagagaaggagaaauuucuaauguguaugccagugacagacagacagaagaugauggccauucuagcaaucacuccagagggauggaccauauuugcuuuuugccaugucacugagcuggagaugcaacuucguauuaaaacucgugucuagugggguguagagauagcucagcuguuaagagaacugucugcucuuccagagggcuugaguucaauuccaagcaaccacaugacggcuuacaaccaucuacccugggaucugaugaugcccucuucuggcaugcagguguacauacagauagagcauucauuuacauaaaauaaguaaauuaaaaacaaaaaaaaccaaaacccucaugucuaguuaugcacuguccuggguuuaaaauaguaccuuccacaauaauuacucuaaauguuccaacaaauaaccuucuuucaacuuaugucacuuaugagcuacaaauauauucuaaaacuggaacaucaaauuacugccacauuagaaguuaaugguucuugacuuuagaaucauagguccuuuacuuguuuucugcaucucugucuucuguggacaguaauggcuaccucuaacuuuuuaaaaccaaaagacuccuuuuucauuugagggcuuuauauaauuucucuguugauuuaccuucucaucauuuaggugucaacaauacauccucaaaaagauuaguauuguaauggaugagggcaagcccuccagagucagaguauuugaguuuacauaccagcuucccacuuacucauuguaugugaccuugugcaaaguacuuauuuccccaucuauaaaauagagauaauaauaguuuuugauuuguauaaguagcuagaggauuuaaagagcauacaaaauaugcagaaguagcagcacuagauaauaaacacaaaaagaaagaaaauauagaaaguguagguguauguaugucugucauauucuccaaaacagcucucguuccacuagaucauaucuguuccuuaauuggcacugaagccuacuucuucaggauuccugcauagacagaagaccagcugaaacugagcaacuacuagauuacagauagcuauuuuugguuuagccuguaaguccuuccaaaaauccagguuauaauauauaauccgguguguguguguguguguguguguguguguguguguguguguguguuugugugugugugugugcaugcagagagagagaggcgggagaauuauuuuauaaguucuacggugcuagagaaugcugauuaauacagugcuuuuacauaacuucuauaguaaacuccauaucuagauauuagugacuggaugcucuaaugaaauaaaguccagaugaaguagaacacagcccauccuuauuuuaauuuaucuuauaaauuacuuaauaaaaucauuacuuuauaacaaggauuuauugcuaagccuaauucuugagcuauuaaaauuuuaaacuaauuuuuauaauuucaauauagucuguuuugaagucacuuccaugaauacauagcauauguguucuucugcauaguaguuguugaugaaggaauagcacagagagaguguguggauuaauuuggaaucaugcuuuaagacacaggaugcgacagcucacuccugugagagguugaguaaaggauugccaacuaaaagucagccugcuaaauauagugaauucuuccaaaugccucuggcaguucucucucucauaucuacagugauaacuuuaaccauauuguagaguaauguagcacuuuucuuuacugugcccccucacauguaccuggugcagaaacccaggaugcauauaagaguuuugucaaagauguaugcaagagaggugcaguauaaauaagaggaagaguuuuuuuuuuguuuuuuguuuuuuuuuguuuuuuuuuuuuuuuuuuuuuuuuuuuuuuuuuuuuggugcauaagagagaaaauauccagaggcaucugaaagaggccaaagcagacagagacagagacagagacagagaccgaaagaaagaaagaaagaaagaaagaaagaaagaaagagagagagagagagagagagaaagagagagagagagagagagauugaacauggccaguaggguggcuauggcccaggcucucugauaaagggagacuagccaaagauaagagaauagagagagugagaauagcaaaagcccagaauagugagaauaguuguaaggaggaggaguagcugagggccagaaaggccaugaaugagcaggcagcugggagcuuagcauugaggaagaagugagaauggcuaggaugcuagugugaggagauggaguuuccuuuaaaccugacaauuauaauaagguaauagaaaccuccuugaauucaaagcuagccaaggcuacauugugaaacccugucucaauggugacaccaauuuacuguggcaccuuuugagcaaagccuuaugagaucuuauaagugaauuucucucuuuguuguugcuguuuuuauuuauuuguuuguuuauucuauuuuuugagguaagguuucuucggguagcccuggcuauccuggaaccagcucuauaggccaggcuugugucaaacucagaaauccaccugucucugucuccugagugcuggaauuaaaggugagugccugccaucacugcccagcuguaaaacugcuuucuaaacuuuugguugauguugaaauggagggguggcaugcuuuaaaaagcauggacuucuaguguacaaauguguuucuauauauuuuguguucuuaggcauguuauuuuaucugaacuucaacuuuguuuuaaagaaagcauuauuaguaacagaccuaaagaguuacugucaaccuugagugagaagaccauaaagaguauccaaaguccuaaugauauagccuggagucucaaucagguugguuuccucugccaguuaaaaaacucaagcacagcagguagcugcugagaaaucucacacagggcaaacaggagcagauggaaucggcaguugaagagcagcauguacugaguaugagcaaacauacuuacgcagcaccacagagaaaaagacgcccuuucaaaccaguaaauccaaucucuucgcaagaacuaaggaguuuaaagucacugaaggguuuucuucucauaauuaagguuuugacagucugaauaaagauaggaugguugauuggccaacaacuguuguguaaccuguccugaaccagccuugaacuuguugaaacagcagugggccugcauguagaaagcaaaauggcuacagaguccuuauuuuaugcugcgaggcuuuugucuuaagucaggaggguaaggaagaagccauccaucuuggaaauguucuaccuuuaugaccuaaacauggccucucucccuaucuuucuguguacaagggagucugccugacccuuaguuccucacuuguacugccaggaugguuguaucacugggcagcuacaaaaguucuaaccauuuguuggucugccaauauuuaccuguuaacaggaguggaaguuuuacauauauagucauuguccaguuuacuguauaaggauccaaagacuuugguuugagauauggauacagaugcugaauuuaaacucuuauugucagaauuccauuuuacaucugauuuuuuucuuuguguacugacauauugcauguuuuucacauccaaaacaaaagaauagaguuacaaaguaccuacuuacucuucuaagccugaccuugcugaauuuguuuaaaaaauaauugauggaccaaagaccaaagaaaugguaguggguaaaacacuugucuugcagccaugaagaauugauugugauccuuuucucauaucaagugcauuuguaauccuaguacuuagaagagauaggaggcagagagaugagaauccccacaaguuugugggucagcuauccugauguacacagugccaaauaacaagaaacugccucaaauaaaauggaagguugggcacagauaccggagucugucaucuaaucucaacaugcacuauggcacaugcaacaccaccaccaucaauagaaaagaacauuuaugcaaaccauguccuuuccuuuuaaacccauuguaaugcuccacacuccccaccucuaauucuucaaugguucuuauuuauacuuuagcuuaaagaggccauugacgaugucaaacaucagaugacuccaaccacagcugccugcaauccaacuagcuguaguccugugaaaacccaaagcaacaagcuccagcuaagcccccaguccccugaaaggaauaaaugguccuaagccacugaguguugggagauuuuaaagcaguggauaaucaugaaagagagacauuggaggauuuguuuucccagucucugauuucccuaguucucagucuuucuuuucuguuucucauuucuauaauuuuagcuguuaacacuuuuguguuuguagcugaacuuguuauuugaaaaguuaaugaguaucuggcucugcuguuuugcauucuuuaccuuauauuaagaaauuccuuuuacaauacuuaguaccaguaugcuguuuuucuuucugcuuucaaauaggucaaguaggaccaacauuugcuuuucuuucuuacuaacagccauugucuuaguuaggguuucuguugcugugaagagacagcaugaccacagcaacucuuauaaaguaaagcauuuaguugacacuggcuuacaguuggggauuagucuuuugucaucaugucaggaagcauuagggcucacaaguagacaaggugcuggcacaggagccagauuucuaaacccagaugggaaggccacagggagaaagagugacgcugguccuggcuugagcauuugaaacuuccaagcucacccccaaugauacauuuacucuuaacaaggccacgccuauuccaaaaaggcuauaccucuaauagugucacaccuuuacaagccuugggggccacuuuuauucaaaccacuauagccauaaaguggcuaauaccaccaaacugguggcuuuuuccccccuuaagccaguucucuugugaaaaucaggguuaggguuaaagguagaagauuuguaguauguacaucaccaucagcauuuuaauccugauuuagcuacaggacaucaugcguagaaggacagggauguauagaguauauacuaaaauaagaacuacuucaagaguaauacuuuaauaacaauaggaugagucauguagugaaggccuaaagaagggaaguauucauauaguuuaacagucacuccuacaaccauaaaugucaggucucaauugcauacuucucuauucaaauacacauuuaugaaaauucaaaaauaauuuaguauuaaauaucaugaaaaauaaauguuuaaaguaagguuuacuaucauauugcuguuguugaauguuauaauuucacaccaugaguacauuuuuuaaaaaauucauuaugggggauugugacaaagauggaugucagaaaauaguuugguggaguucucuucucccacuucauauggggccaccggcuugcauggcaagaguuuuuaccugauaaguuauguugccagaggucaaauuaaaucugaaaauaucauuagcuuccuaucacacuuuuuuuuuuauucuagcucuaagaacagguggaauuagcuauggauaauucauacaauuuaaaugaacaaagcucauggaauggaaucucaucugagaagaaaaaaaauuaccuugcaucagaagaucauggacagaaaaucuuaagugugcugcagaguuuuagagaacagaaugucuuuuaugacuucaaaauaaucaugaaagaagaaauaaucccaugucaucguuguguguuggcugcaugcagugacuuuuucagguacuguacccccaucuaugccuuagauuuuauauaugaaauaaauuauauauuaucuuuaucaaccauacucauugcccccugagcaugcuauaauaaugguuaauucuuaauaaaaaagacuuaauuagaacucaauuauuaauagcuuuugaauagggaaucuucucauuuuuugaccaugaaaagauugcuuuauucccugaaaauauucucaacaaagaacaucauaaacaaggcuuuuuuaccauuaagaaaucaauaugugcacaaagugggaauuacugcaaaauuaagagacuucuuuuagacaucucacauggucaaaguuuaaaaaugauuuaagaaugacuuaaaaaacugugcaaguacaagugucuuuaaauguuauaaccagccgggcggugguggcacacgccuuuaaucccagcacuugggaggcagaggcaggcggauuucugaguuugaggucagccuggucuauagcguguguuccaggacagcuagggcuauacagagaaacccugucucaaaaaaaaaaaaaaaaguuauaaucuauauacagguugcacuacuccacaugaaggaauuugcuuacuauggaagcaaacgccagcuuuagaaaaacacacaguugcuugaaaagaacagucuuuacaagaaagauuugaacuuugcccucugugauuguuagucagaaaaacauaaagcaauucagucuuuauauagaagacaaacagagccaggucacauuucuuucucacuguuaacuucugaaagaaaaacaguacuacuuuuuaaaacuacuucauguagucugucaguauagaacagugucacauuauauaaacaacccuguaaugagauuugauaucuaaaacuguauaguuuacuagccucaaauguaauauacuguauguuagcugcauaacaguggugaacuugaucuuuugaaggaaggcauuaauguucacccaauuguuauuuagcuuuagcauaacugguaguaugguucaaauagcauuggaaaaauuauugaagcagucacacgguuucuaaaauauugcuugaaauccaauaauacccagaacauuucacauucuuuuucuccccucaagacaguaaagaaucaaaugaauggagcugcagugguacaaauaacccucccacccgcccacccaccucccuguuacaagaccacuaggaaauuaguuccaauacaagucauuaacagaaucacaaugagcaaugaggccacuaacgacaaucguauuuacaaguauaagcaucuagaaauucccauuuuacaaguaaaaguucacauagaucauuacaaagucucacuaaaguuuaucugguucaaacaaaagcaucacuuagaaacaagcuaucauuaaaauaauuaaaggagauuguuaaaagaugaagguucaucaaacuucucauaaauucacuaaugaaaguaaaauggacccagacaggucuuuaguuugauccuugaauuugaagaugcaccagugcacaugguagagcucuagaagccaccugccaaagcuacaucacaucuguggaggugccacaguuagaggcugagcacugagauggcauauaaagcccuuugugggacuacuacuguagugguaguguuggcaauuuagacacucgauuuuaaggcagcauuugaauggaagcagcugacuuuuuauaauagucccuucaguguuauuaugccaggacuucagugcugaccagauucucccagacugaggugcugaagaugugucacauuucacagagucgguaacugggcuguaggcuagagcagaaauguuuucuuucucuuauccuaaauacuucagguucacauacuaugucuuugugucaaaacuggaauguuugcaguggggaaguuuuagcagcauacacaaauacuaagauggaaacauuagugcugaggugucugacaaagugauuuguacuacaaaugcaaacugaaacaaagauuugagaagaacagaggauuacagaaacaugccagaaaacucuaagcccagaucacucgagauaagcaacaggaugcuaagcaagcacagaagugguacaggcagacagugacaaauggcaaggguucuaagagacgaugaaucuaaaagccaauucaacagagcugaugaaguucaugaagaaucuuaaacugcaguuguaaaaacaagaguucucccaggauaguuucccaaagaucuuuaagauuaguaccuugagcuauucuggguaggacucauaugggguuaacuuugaggaauccgugaaugauaccaucuuagcagaaggugaaaugacaaguugaaaaagauugaagcugaguuacgccauuuccuaggggaggaacugcagcccagaagacuuuuuuuuuccuccuuccaugcauguaauaucagcauugaggaagcugagaaagggagauugccaugaugauaguagguuucuguugcgaugaggucagauguauuauuacaauacuguggaaauugucuccuggccaauaaagacacggguaucuuuuggugacacucugcagucagucauccuagucauacugcaguaaacucaaguccuaacugcuacucuacauuaggaagaaauauuaaguaggguuuuaaucucccaccaaauugguaaaaacugaguaagauuuaauauaugaagcaaaauaguaauuauauugcauuuaugauuuguuuaaguuggggacugaaccuagggccuuaugcuguucuauuuugaaucauuaauucaaaaccugcauuauaaacauguaauucaaaaucugcuguauugccauuaggguaaauaauauaagcuagacuuuauuuaguaagcaguucuugcuaucugcugcuuaccgaacgccugccucugugggguuuugcuuugaauuuugagaucagugauucacaauguccucgaucagggaggcuccagcagucuugaacuagcuguuuucuuaguguaacucuuuucuuuuuguuucuucauauauucugaggcaugcuuugagcucuacugggacccccacuguuagauucuguugauccugggccuccuuugucuucccuucuuuugagcacagcuuuccuuccauguaacuuuuagaguguuccuuguccuuauagauguggccucuucccuagguccugugaaggcucuaugccccaauauaggggaaugccaggaccaggaaugggagugggugggaugggcagaagggggaggaggaaggggauaggggauuuucggaggggaaacuaggaaaggggaugacauuugaaauauaaauaaagaaaauaucuaauaaaaagauaaaaaaauaaauguggccucuuauuuacaggccucugucuauuuaaugguuuaaauacuuaguuuuuuaguauauaugcccuaaucuaaaucccaguuccccugcuuacuauucaugugaccuuauacaaaucacuuacccuuaucagaccuaggucuccuuacuagugacaaggaaauuagaaaaguaaaaaauaagaauuaauacaugaugucauucuggauauuauaaaggaacuuauauauaaaugguuagcauauuuuauuuuacauauaguuaauguuagucaauaaaguucuuguuccauaacauaggaaaacacaguauuucugaguauucagcaugauuuucuuacaauguuuucuagcuacuucaacaaaaaguucuuguaaacauuugaauuugcaaucuucugcucuuaucaaacuuacuuuuuagauaaauaguucuagguguuaauuuuuugaugcuaauucuuuggguuuuguuuuuuuuccauguauacaaugugugcagaugggcaguugucaauuauaaagcuaaauauauuuaagaguauuaguaaauaauacacaacaaaauguagcuucaagcacuuugcucacuuuugagucugcuucucauuguuaaaauugcuauuaaaauagaaugauagcuuucauuuuuaauuuuaaauauuuuuuagguuucuaucguacauauuuauuguauaugauauuguaucauacaaggguauuacacacagguauauauuguuuauauagaauauccuccaugccccuccuguagaccaccuuguucccugagugauuucgcuuuaugucauaagcacaaacagaauuuuguguuuccauagaaaaaucuagaaacaacaaacaacaaaguguguauuuguuucuuugggauugguuuaauuagcuuaauauaauuucuucacuuguauccauuuuccugcaaaccaagugacuuccuuuuucuuugucugaaaacuaucugcuguguacauuauguccauuagaaaaaucuguucuguugauggacaccuagguuccaucauugaauucuaaaaguucuuucuucuuuauuucuuuuuuuuaaauuggguauuaucuuuauuuacauugcaaauguaauuacccucuuuccugccacccuaaaaacccuaucccagcccccucccccugcuuuaaugaggguguuccccuacccacuucuaccucccuguccuggcauuccccuauacuggggcauuuggccaucauaggaacaagagccuuuuuuccuauugaugauuaacaagggcauccucugcuacauaugcaguuggagccaugggucccuccauguauacuccuugguuggugguuuggucccuggaagcucugggaagucugguuaguugauauuauuguucuuccuaugggguugcaaacuccuucagcuccuucaguccuuucucuaacuccucaauugaggaccccgugcucaguccaaugguuggcugauagaauccaccucuguauuucucaggcacuggcggagccucucaggaaacagcuauaucaggcuccuuuccgcaugcacuucuuggcauccauaaauagugucuggguuuggugacuguauaugggauggauguccaaguggggcagucucuggauggccuuuccuucagucucugcuccaugcuuugucucuguauuugcucccaugaguauuuuguuuccccuucuaagaaggacuuugacccuccuucuuauugagcuucauauggucuggugaauuguaucuuggguauuccgagccuuuggguuaauauccacuuaucagugaguacauacaauguguguucuuuuguaacuggauuaccucauucaggauaauaguuucuacuuccauccauuugccuaagaauuucaugaagucauuguuuuuaaugggugaguagaacuccauuguguaaauauaccauacuuuuuuuauccauuccucaguugaaggacaucuauguucuuucuaucuuuuggcuauuauaaaugaagcuucuagaaacauaguggagcauguauccuuguuuuauguuggagcaucuuuuggguauaugcccaggaauguuauaucuugguccucagguaauaauaugcccaauuuucugaagaacggucagacugauguccagaguaguaguaccagcaugcaaucccagcaacaacagaagaguguuccuguuucaccacauuugcugucaacugagauuuugaucuuagccauucugacugguaugagguagaaucucaggauuguuuugauuugaauuuccugaugaauaagaauguugaacauuucuuuaggugcaucucugcaauuugauauuccucaguugaaauuuuuuuuuuuuuuuuguuuagcucuguacuccaucuuuuaauagcauuauuugauuccauugagucuaacuucuugagcucuuuguauauauuagauauuugcccucuaucugauuuaggauuuguaaagaucuuuuuccuguauguugguugcuguuuuguccuauugacagugucuuuugccuuacaaaugcuuuguaauuuuaugaggucccaugugccuauuguugaucuuagagcauaagccauugguguucuguucagggaauuuuucccuguacccauguguucgaggcucuuccccacuuucucuucuguuaguuucagugaaucuaauuuuaucuggagguccuugauccacuuggacuggaaccuuguacagugagauaagaauggaucaaugugcauucuucuacaugcugacagccaauugaaccagcauuauuuguugaaaaugcugauuuuuuuucccccauuggaugguuuuagcuucuuugucaaauaucaaguaaccguagcuguguggguucacuacugggucuucaauuuuauuccauuguucauccugccuauccuacaguuuguaucacuauugcucuauaauacagcuugaguucagggauggugauuccccuagaaguugagaauuguuuucccuauuuuggguauuucauuauuccaaaugaauuugcaaauugcucuuucuaacuuuaugaagaauugaguuuaaauuuugauggugauugcauugaaucuguagauuacuuucggcaagaugacaauuuuuacuauauuaauccugccaauccaugagcauggaagaucuuuccaucuucugagaucuucuuugauuucuuucuucaaauacuugaaguucuugcuuggauagagucacagcaagguauguaauauuuuuugcgacucaaaugaaggauguuacuucccugauuucuuucucagccuguuuauccuuugaguagaguaaggcuagugauuuguuugaguuaauuuuauauccagccacuuggcugaaguuguuuaucagguuuaagaguucucugguggaacuuuuggggucacuuaauuauacugucauauccucugcaaauagugauugauauguuguugacuucuuccuuuccaauuuguaucccuuugaucuccuuuccuguucuaauugcucuggcuagaacuuugaguacuauacugaauagauagggaaagaagggcagccuugucuauucccugauuuuaguggguugcuucaaguuucccuccguuuaguuucauguuggcuacugguuugcuguauauugcuuucacuguguuuagcuaugggccuugaguuccugaucuuuucaagacuuuuaucaugaagguguguugaauguugucaaaugcuuuuucagcaucuaaugaaaugaacuuguguuuuuuuuuuuccuuugaguuuauguaguggauuacauugaugaauuuccauauauuaaaccaucccugcaucccuugaaugaagccuucuugaucaugauggaugauuauuuugaugugcucuugcauucgguuugugagaauuuuauugaauauuuuuaauuugauauucauaagggaaguuggucugaaguucucuuucuucuuugggucuuugugugguuuaguuauaagcauaaaugucgcuucauagaaugaauugcguaguguuccuucuguuucuauuuuguggaauaguuagaaguguauugguauuaggucuucuuugaagguuugacagaauucuacacuaaaaacaugugcuccugugcuuuuuuggguugggagaauuuaaugacuguuccuauuuccauaggaguuaagggacuguuuaucugauccugacuuaacuuugacaccuaucuaaaaauuguccaucucuuccagauuuuucagauuuguuaaauauaggcuuuuguaauaggagcugauuauuauuuuuuuaauuuccucaguuucuauuguuauaucucccuuuucauuucugauuuuguuaauuuggguaaucucucuaugcccucugguuagucuggcuaaggauuaucuaucuuguugacuuucucaaagaaccagcuucugguuuuguugacucucuuauaguucuuuuucuuucuacuuaguuggacgcacuuagaccuaugaauuuuccucucauuacugcuuucauuuuugucuccuaaguuuggguauguuguggcuucauuuucauuaaauucuaaaacgucuuuaauuucuuuccuuauuucuuccuugaccaaguuaucacugaguaaagagaucuucagcucccauguguaugugggcuuucuguuguuuuuguugcuauugaagaccaaccuugggcuguugugaucugauaggaugcauaggauuauuucagucuccuuguaucuguugaggccuguuuugugaccaauuuuauggucaauuuuggagaagguaccaugagguguugagaagaagguauauucuuuuguuuuaggaugaaauguucuauagauaucuguuucuguuaaauccauuugcuucauaacuuauuugauuuucacugugucucuguuuauguucuguuuccauaaucuguccauugcugagaguggcuuguuaaagucucccacuauuauugugugaggugcaaugugugcuuugagcuuuaauaaaguuacuuuuaugaaugugggugcccuugcauuuggaacacagauguucagaauugaaaguuuuucuugguagauuuuuccuuugaugaguauguacuguccuuccuugacuuuuuugguaauuugguugaaagucgauuuuauuggauauuagaauggcuacugcugcuuguuucuugggacuauuugcuuggaaaguuguuuuucaggccuuuacucugagauaguguauaucuuugaaacugggguauguuuccuguaugcagcaaauucuggauccuuuuuacauaucuacuuuguuagucuaugucuuuuuauuggagaauugaguccauugauguugagauauuaaggaaaagugauuuuuguuacuguuauuuuuguuguuagaaguaaaauuauuuuuguguggcuaucuucuuuuggguuuguugagagaagauuacuuucuuguucuuucuaggguguaguuuuccuccuuguauugacguuuucuauuauccuuuguagggcuagauuugcguaaagauauuguguaaauuugguuuugucauggaauaucuugguuucuccaucuuugguaauugagaguacugcugaguauaguacccuggacuugcauuuauguucucuuagagucuguaugacaucugcccaggaucuucugauuuuuaggguacccaaugaaaagucugguguaauugugcuagaucugcuuuuauauguuacuugaccuuuuucccuuacugcuuuuaguaugcuuuguuuugugcauuugguauuuugauuacuaugugaagaaguuugggguuuuuuggggggcuuguucuuuuguuguuuuuuguuuuguuuuucugguccagucuauuuggaguccugaaguuuucuuguauguucaugagcaucuguuucuuuagguuagggaaguuuucuucuauaauuuuguugaagguauuuacuggcccuuuaaucuucacucucuucuaaaucuauuauucuuagguuucaucuuauuguguccuggauuuccuagauguuuuggguuaggagcuuuuuuugacuuuugcauuuucuuugacucuuauaucauguuuucuaugguaucuucugcaccugagauucucucaucuaucuaucucuuguauucuguuggugaugcuugcaucuauggcuccuggucacuuuccuagguuuucuauuuccaggguugucucccuugugauuucuuuauuguuucuacuuccauuuuuagauccuggauguuuuguucaauuccaccaucuguuugguuguuuuuuccuguaauucuuuaaaugauuuuuuuguuuccucuuuaagggcuucuaccuguauuucuuuaaaggaguuauuuauauccuucuuaaaguuaucaucaucaugaaaguugauuuuaaauccaaaucuugcuuucccgguauuaugggguauccaggacuugguagggugggagaacuggguuuugaugaugcuaguaaccuugguuuguguugcuuauauucuugcauuuugccucuugccaucugguuaucuguaguacuaccaggcucugacuagagccuguaccuccugugacccugguugagucagaacuccucagaguccgacugucucuugugauccugugauucugggaucauguguuccugagauccuggguguguuagagcuccugggagucaagcugccucugggauccuuaaauccugauaugaccaagcuucugagauccuggacuuguaagaguaccuaggagucgagcuuccucuggguguugaaggacuggaugagguaccagugcccaacuggcucagacuggaaagaacccaagcuacuggccaggcauggauugcugaguccccagauccuggggaucccaguuacuccuguuguuggagcagauguuguagccuucucaccuaugauccugggaauguuagagcaccuaggacuaaagcauccucuggguauugugggacugggugugaaccuagcacccaagauaugcucagggcaguggcucagaccagaagacaauuuuaaacuuucaaauagcagaagugacaagucuuuauuaaauuuuauuaaauuauauuaaauuauuaauugguuuguuuugcuuauauucaaaugaaaauagguacaaauguggcuagaauuuuuuaaagcuuuuuuuuguguauaugagcagguauuauuacagauguuuugugaaccaucauaugccugcugguaauugaacucaggaccucuggaagaacagugcucucaaccacugaaaggccaucucuauagcccuguggcuagaauuuuaaucauuuauaauaccgacaguuugagaaaacuaacuacauugagagaauguaaaauaaaaugucagaaaaguuuacacuacauagcaaaaaauaugauuaagauauaaaaucaaggaacaugucguauagaaaccgcuuauaauaacaugccauaucugagaaauauguaggagaguaaaguauaggaguuugauccuauaugugucuucugcaaggguguagaagcugauaccaaacuaaaaauacauagaauccagggacugaagaaguucagcaguuaagagcgcuaacuacucuuccagaagaccuggauucaauucccagcauccguaugguaauucauauuccaguuccagagaaucugauucccucuuuuguccuucauggacauuaggcacauacuugugcacauacauacaugcagacaaaaccacccguacacacaaauaaaaccuuaauagguugguagacagauacagagacagacagagaugugaggaaaggaauacuauuaggaaccauuugauuucuugaaauaauagcaguuaauacucugcaaugauuaaguuacuuauucuucuaaacaaccuuuuuaauccuuauauuaugcaagacugcaucauauauauaauuacaaauuaaaaugucuaaacuggcauacauuguuaaagaaccuuguguuaagauauaguauaauuauaacuuuugucacuacauuuauuuggcuucauauuaagaaauauauugagcagccugggaaaagggcucuuuaucauuguuuuccuauuuuauuagaaagaucucucauauucuucaaguagaucuugugcucacuaauugacuuuauuuauucucugcaaaaaguuagccccaauuccaccaaguucaagcauuuggauacucaccgauauagcacccaaaguauuagucuuaguuacuuuucuaaguuuuuguaagacaacaugaccaaaacaauuuauaaaagaaacugucuaauuaggcuuacagucucagaagguuagaaaucagugaugggagagccaaggcacaauagcaagaauaugagagaacaaacucuuaauggcaccacugcuuugaaaccuuauaucucucccauugacaaaccucuuccacaaagccaccccuuuuaauccuucccggauagucauacuaacuggggaccauguauucaaacauuacccaaugaggggugggggcaggucauucucagucaaaucaccacagcauuuuuuauauuaccagcacaguuaugaaaccaggauaaacaguaaaauacauuuuauucucugaguauauaccuccaaauaacuuauauuuuugucucuccugaguucaagauaguaccaauccuuuagauuugccuuuuaauuuccaagccggcaaaauuacucaaauuuaaggaacagucucuaucuuucugugguuguuacuacaaaaauauagguuuagcuuuuuggcuuuguaauugucuaggcuuuggauauuacuucccugguucccuuuucacuaugaaucugauuugacagauuuccccacagagcaauacaaaaucauugguagcagugggccucucauuuucuguguuucauguaaauuuuuuaagcccaagaucuugagcaguucauauugagaaauuuuaguuauuaucacagauauaauuaauuugccuuugaagaaaacugaguuauauguaagaacuaacuaguguauaaaauuugaaccacuuuacaaccuuuuuuauuucuuucuguguaucagcuacacuguuauauguuuuuguuaugaagguuacauaauagucagcagauaaguauuauaccauacaguuauuuuaaauguuaaaguaauucauuaaaaucccauuaaucuuauaaaugcauucuaaauuaaguaaauaguaaagaagcauguguguagugguaugggaaauacuuauaauuaaaauauuuguuuacuugugcuucuuuuuuucuuaacuuuuucagggcuauguucgaaguaaacaugaaagaaagagaugacggaaguguuaccauuacuaacuuguccuccaaagcuguaaaggcauuucuugacuaugccuauacgggaaaaacaagaauaacagaugauaacguggaaauguucuuccaguugucauccuuucuucagguuuccuuccuguccaaagcuugcagugacuuuuuaauaaaaagcauuagucuggucaacuguuugcauuuguuaucucugucagacagcuacggcucugcccaguuguucagucacacuuuauauuuugugcagcaucacuuucauuuguuguauaaauccagugacuuuuuagaaaugaauuuuggagugcugcagaagugucuggaaucagaugaauugaacguaccugaagaagaaaugguccuaaaggcuguccucacauggauuaaguacaacuuagaguccaggcaaaaacaccugccucacuugauuaccaaaguaagauuacaucaguuaucugaggacacacuucaagacuauuugcucaaugaagaguauuuacucaaaagcacaaacuguuuugacauaaucguggaugccauuaaguguguacaagguucuaguggccucuuuccugaugcucgaccauccacaacugaaaaauauauauucauccauaagacugaggaaaauggagaaaaucaauauacauuuugcuauaauauuaaaacugacuccuggaaaauauugccacaaucacaucugauugauuugccaggaucuagucugucuagcuauggagagaaaauauucuugacaggugguugcaaagggaagugcuguagaaggauucgacuucauauugcacagucuuaccaugaugccacugaccagaccuggugcuacuguccagcuaaaaaugaguuuuucuguguuucagccaugaaaaccccaagaaccaugcauacaucagucauggcucucaaucgauuauuuguuauaggcggaaaaacuagagggucccaggacauuaaaagucucuuagauguugaaucuuauaauccacuguccagagaguggacaucaguuagcccuuuacccagaggcaucuauuacccagaagccagugcaugccagaauaucauuuauguccuuggaucugagguagagauugccgaugcuuucaacccaucacuugauugcuuuuuuaaauauaaugcuacaacugaccaguggucugaacuaguagcagaguuugggcaguuuuuucacgcuacuuuaauuaaagcugucccaguaaacugcacccuuuauauaugugaucuuuccaccuauaagguuuauaguuuuuguccugauacuuguguuuggaaaggagaagggucuuuugagugugcagguuuuaaugcaggugcaauuggaauugaggauaagauuuacauauuagguggagauuaugcaccagaugagauuacagaugaagugcaggucuaccacaguaguaggucagagugggaagaggugucaccaaugccaagagcuuuaacugaauuuuacugucaggucauucaguucaacaaauacagggacccaugguauucaaaucauuucuaaaaguaauauuugcaugagagcucuaaaauugcaacuaguagaauugguuaaaaauauguauaucucagcacacugaaauguuccuuauauuaaagaaugacuauagauguaugcucucaauaaauagacaguuuccagaaguuuaaaauacaaaaugcauuuuaucaaaguuuuguuaaauauaaauucauguucaauaauccagauuacauaguauuuucuuauauaaauaaaaauuacagauuuaugcuuauuuacauuaaacgauggaaaaaagucuguguagaagggaaaauuuucuugaagugaaaaugcuuauauacugcauauugugugacaugaagauaaau

SEQ ID NO: 4914 - RNA, 10156 nt, Mus musculus
aguugggcuuaagaagguggaccuagaaggaggcagcagagaaccuacugaaggugguacagagcugugggaagucaaugaaaaugaagggucuuccgguccugcuguggcugugugugguugugugcucauccuacccauugcaugacagugcaagggaugaugaugcugguauggagcuucugcagguaaggggugaaaauggccucugggcuuuugguggggcacagcuuugcauuccacagccggguucugacugccuguguaaauguggcuuggcaauagagaagaauuagaaauuauugaaucucaauaucacaugauccuuccuguuauguaagaacaaaggccaggaauaucgggugauuuuuuaugauuaugcaguaugguggcagaggcaacacuggugcaggaggcacaugaacggcaagggaagggcacaugaacugugccuugcuuugguccaguguaauuuaguaaaauauuuguacuguuaguauaagagaggcaugucuguuuuuucccuaguaaacuaaauccuuaugaaaaguggaaaauugagaaaauuaaauaaaauuaccccaaacagacaacuauucgcacaaaugcuaauuuguucauuuugcuuuucucuacacuaaaugcuuuugaaauuuccccuugaagucauuguuuuaauggcaagcuaaaacuacagagacacuguguuucaaaacaaaguaaagauguagucacuacugacaaauuaaugaaguauuaaacuuaggauuucagcaaauuggaaaaagaggucaaagacacugaaaaaguaagugucugucaggcucgguuguccgagccuguaaacccagugcucagaaggcagacacagaaggguugugaguuaaagaaacuucuuggcuagauaaugagauccugucgaaaugaaugaggaaaggaaagaaggaaggaaggaaggaaggaaggaaggaaggaaggaaggaaggaaggaaggaaggaaggaaggaaagagaagggaaggaggaagggugugugacuguaaaaguuuacuauaaauaacaauagcuuaaaaaauccgaauuguuacuuaaacguuauauuuauuccauuagaaauaccuagaaaacuacuauggccuugcaaaagaugugaagcaauuuauuaagaaaaaggacaguagucuuauugucaaaaaaauucaagaaaugcagaaguuccucggguuggagaugacagggaagcuggacuccaacacuauggagcugaugcauaagcccaggugugguguuccugauguugguggcuucaguaccuucccagguucgccaaaauggaggaaaucccacaucaccuacagguaauggcaccagaguuuucacacagcauuauaaaugugucaggagcaucacagaagcaaagauuaccuucuuugauuucucuuauccaggauugugaauuauacaccggauuugccaagacagaguguggauucugccauugaaaaagcuuugaaggucugggaggaggugaccccacucacuuucuccaggaucucugaaggagaggcugacauaaugaucuccuuugcaguuggagguaaaagccaaaaacuaccugaaauacucaugaacagguggcauuuuacuaaaaauuacacacacacucauauauauacauauguauguauguauuucuuuuaagaacauggagacuuugucccuuuugaugggccuggaacagucuuggcucaugccuaugcaccuggaccagggauuaauggagaugcucacuuugacgaugaugaacgauggacagaggaugucacuggugagugcugcagcucacagcaugacuuaguuucauuucuuuucauauuuagggauguccucauaaccagugguuuuuuuauuagauauuuucuucauuuacauuuccaaugcuaucccaaaaguccucuauacccccccccccggcccuguuccccuacucacucacuccuacuucuuggcccuggcuuuccccuguacuggggcauauaaaguuugcuggaccaaggggccucucuucccaaugauggcugacaaagcuacauaucuucuucugcuacauaugcagcuagagacaugagcucuggggguacugguuaguucauauuguuguuccaccuauaggguugcagaccccuucagcuccuuggguacuuucucuagcuccuccauuggggguccugugauccauccaauagaugacugugagccuccacuucuguauuugccaggcacugucaaagccucacaggagacagcuguaucaaauaaccagcaguauuaaugauagagugcauucuggauuccaaugaaauacuuuguuuuacuuauugcugaauguacuuucagaugcuuagaaacuauuuauuuuccugauacuaacaacauaaaauguaucacuaagugucugaccugcgcaaauucaaugagauaguuuuuguuuuauuaauauuuauuuugcuaugcuuuguuguuagaagcuuguucuuuuauaaugggaacagaaagggaguggaucuggaugggaggugagguggggaggaacugugaggaauagaaggagaggaaacuauucagaauauauuguccaagcaaacaaccuauuuucaauaaaauagaaaaaauaaaacaaaagggaaaaaucauuaaauuuguaaaaguuauggaucucaugugauccaagaucaugauuacuaaaaucugcacugauaucaaauugcagauauucaagcaauacaacagggaaauauuacucauugauucuuguaauuuucaaacccggagccaaaauuaaauuuaaaaaucagaggguuuuuuuuuuuuuuuugguuugguuaguaaguuuuguuggucugauugagcucauauuuuugugauuucuauguuaagaugaauuuuuaucagcuucugaaagaaaagaacuagcccugaagagcaagggccaacuauguagguggaaaggguucuuaguucagaauuugggggauugacuuucaaaguuuucaaaaucguggcugaaauaaauuauauucuuuuggggacugaacagggauucaaaaagaaauuaugaacugauauccauagaaaauacaaaucuaacuuugcacugaauaaaacuugugguuucauaguauuagcaauuuuuuucagaagaccuuauugcagauacucaaaugagagcacccucaggucuacaauauucacauguaacauuugagaaaauuuugccaaucaugccaucccacaccucccaaugucagcacugagauguuuauuucaagugcuauacugagaagaaugugcauacagucuaagaucucauucguaacacguaggcaugucaugcuuuaauuuuauaaaaccuauaacaucuuucucauuaaucaucuuuuugcacuuaauauguaauaggaugaugaggcuggaaaauggugauccaacagaaagcacagaauuaugguugcucacaggauuuugaauugagaugaagaccuugugauuggcugacugauacugaaauugucaagugcuaacuacauacuagagcaguguuaagcuguucagagacaaaggauaugcuaaacaauaaguaauaaccuucauucaauuucugacaacugguauucaaacauucuugaagucaaagagaacuguuggcugugucuggauacuuuagacuuaucucaagcaugaauuguuaaauacacguauuucucuguugagugaaugaucaguucacuguucaaugaaacagcaaauaaggugaauaagagcuugugcauuuccaggaaguaaauaaaugcaaugcccaacuugccuauaugauauacauguagguaaggaauaaaaaaaaaacuuacuauguaugauuucuucaauagguaccaaccuauuccugguugcugcucaugaacuuggccacucccugggacucuaccacucagccaaggcugaagcucugauguacccagucuacaaguccuccacagacuugucccguuuccaucucucucaagaugauguagaugguauucagucccucuaugguaagagaaacuggaaaaaggaguacuuguggcuuugccaaccugcguaucugugauuaaauucagaguuccugagagcauuugggaagcauggaguugacaggcaggccauguuucuccuaauaaugccucuuuuaaucuguucccuuuaggaacucccacagcauccccugauguccucgugguacccaccaagucuaacucucuggaaccugagacaucaccaaugugcagcucuacuuuguucuuugaugcagucagcacccuccggggagaaguccuguuuuuuaaagacaggucagaccaaagagcucugaaucacuaucuauuuucaaggagaaauuucuuagaaaggacaauaaucaggaaauugauagauacauuuaaacauuuuuaaagacaaauucuagagcuaggcauccuugggaucuggcauuguccucucuguguguuccuaaaaugggcaagcucaguuuagaaggccuguaucauaauuugauucuugucccaaauguuuuccuaggccaggguaacuguuuuuagaggguagaaguaaucuuuauagucauaguuuucucuuuacuuucuuucaaaaugguaccaugagaagcauugaguuuuaucaguuaguuuucuugcugccggguaacuaugccugugagaaaacuuucauucugcauggaagagagcugagcaguuuacauucccagcucucucuguacaugaacaguaaguauucugagagcccagaauggccuggaaauugugauuucauaccucuucccaaaucucauggcaccacacccuacuucaagaccucuugugcaucuuucuagauuuuucugugaguguacaguaaaauauuuauacaucacauuccuucaugcaugcacaugggugugcauguacacacacacacacacacacacacacacauacacacacacagucuuuuggggaaauguaggagauauauacuguuucauauguauuacauuuaguuaaagcuuaugcuaaacuaauuaauugacacaguaagaaaauuugcuuucacagauauuccucuauaaaucuaugacaggagguaugcugcagacuucuuuuggaggagagggguagugggagagggagaggugggauuuucccaguaacaacauucuuauauuuugcacauccaaccccgaggauaagaaaaugaagggauuaugggugaauuuggaauuuggacaggagacauaauguuaaagacaaugguuguuuuuuaauugucacauuuuuaacaucugcuuuuaggcacuuuuggcgcaaaucucucaggacuccugagccugaauuuuauuugaucucuucauuuuggccaucucuuccauccaacauggaugcugcauaugagguuacuaacagagacacuguuuucauuuuuaaagguaauuauuacauaauaucgcuuuaacuuagugagacaagccucuggaaggaaaguaaacaguacuuuucucaacugugucaaauucuguauaaaaaauagccaaagagaauaaagaaauacauaaagccagcauguuuauaauuuagagauaaaaaaauuaacuugaggagagacaugguccaaguugaaaauucccucauuugaucuuugaugauuguuuccaugugaacauuuuuguugcaugcacaccacaaaccuaaggcauaaaucuaaaacuuggacuccaucuucaccacuaaagugagggugcuaagaauguguuuccagaaccgcaagccauaauuccuggacuuuuuaacacgaugguguuucuguuguugcuuuguuuuuguguaggaaaucaguucugggcuauacgagggcacgaggagcuagcagguuauccuaaaagcauucacacccugggucucccugcaaccgugaagaagaucgaugcugccauuucuaauaaagagaaaaggaagaccuacuucuuuguagaggacaaauacuggaggugggauucugugaggaugccuuagcuuagagacugaguggagaauuacuuucucccucuggcaacuaugggaagggcuuuuaaacagcagcagcugccaaaaggcaguuagguguuccuguuuagagacucaccuccccaccccugcccauccuaccuguuauuccccagcuccuuccuauucaguaaaguaggacuuccuucuccccuccugcugagaggccaucuucucuccuuuaccuguucaauccugcacauacacuuccaguucaggcuuaagucccucacuuucagguccagcuggccuuuacuuccucacugagagcccacaucucaguuaacugguccuuuaccagagccccagaguucucauugucucccaugugugcgucuuaucuuccucucaaggacugcagcugagcucacauucugcugaccucugcuugcauagagaggagacacuacagcagaccuguuucauggcucucacucaggacugcuuccuuauaggauuacugaguccuaggcaucagggcagaccauccaguguaaagcccaugagucaaaaccauacuuacaguacuuugcuucuuguucagucucuuuugcuaugggagcuuucauuaaaaaaaaaaaaaucaaugcacaggaaggaaaagaagauauaaacagucuacuuauaauggugaaauggaaaguguauuuaauuuuuaaaaauaguuuuauuauuuguguauaugaguauucucucucucucucucucucuguguguguguguguguguguguguguguguaugcaucacaugcuuacagugcccuuagaggcagaaaugugcauagaauuucucaggaauaggagcgacagaugguugggagccaccauguggguucuggggaccuaaccuggaacccucauaaaagcagcuagugcucuuaacaccugagccauuacugcagccacaauauuccacuucuaucuaugaagguauuucugugugagaauaucugcauguucaugcaggugcccacagaggcuagaagagggauccauuaguuucucugacccuggaauuacaggcagcuauaagucaccugaauuuguauggggauaugaacuccaguuauggggaaacaacagcaaaagugcucuuaaccacaaaggcauugcuagccauaggaauuguauuucugaucaguaacucaguccacacaugugugcacaugcauacauacaugaauacauaugguuguauauucauaugaucauguacuuguggaugaaaaaggaugaugauucucuaagccagauuuaagaaaaacaguaacaaacaguauuccuguaguaggcuguugucucuguucuucuuggagcuauuuuuuaaagacuauauuaaaggcagauuuauugggaagcugcucugggugccagcuaguucacuggcucuggggacagaggucugggaaguugccaaaggggaaguggggaggagagggagagagaaagagagaauggguagccaugcagagaaggaagagaagaagcacagcuaugguuuuaagagcuaaacuuuagcuuauuaaaaccacauggugcuaaguaagcuugccauguaugugcagaacuuggaaaggcuacuagaguugcacagcgcucacgaguguggggagcacacccuccaugcacugcugagcuguacuucugucauuuugggcagguuugaugagaagaaacaauccauggagccaggauuucccaggaagauagcugaggacuuuccagguguugacucaaggguggaugcugucuuugaagcauuugguaagaggacacuuauucuguuggcaauggggcccuugacauacucugugguaugagagaacagaagagaaauaauuuuaauaacacgguuaaaaaaacaaacaaacaaaccucaguagucuccuuccuuccaaaaauuucaaccccuuuguuuucguggccauugcagcucuccuugggugagcugcuuugacucaugaaggugauuaacaaaaaaugccucuaucuuuuuuuuccuuuuuaaauauuuuuauuagguauuuuccucauuuacauuuccaaugcuaucccaaaagucccccauacucuccccccccaacuccccuacccaccaacucccacuuuuuggcccuggcauuccccuguacugaggcauauaaaguuugcaugaccaaugggccugucuuuccacugauggcugacuaggccaucuuuugauugaaacacgagcucuggggguacugguuaguucauauuguuguuccaccuauaggguugcagaccccuuuagcuccuuggguacuuucucuagcuccaccauugggggcccugugauccauccaauagcugacugugagcauccacuucuguguuugcuaggccccagaauagucucauaagagacagcuauaucagggucuuuucagcaaaaucuugcuaguauaugcaauggugucagcauuuggaggcccuccagguccaaccauuugccuaggaauuucauaaauucauucuuuuuaauagcugaguaguauuaucuuaugcagaagcgaaagaccaaagugcugacaagucacugccucacuuugugagccuuucuuucucuuucuuuuuguuuuuauuguuguuguuguuguuuuuugggguuuuuguugguuuuuuuuuucuuuuugguuuuuuguuuguuuguuuugaaacaggguuucucuguauagcccuggcuguccuggaacucacuuuguagaccaggcuguccucgaacucugaaauuuaccuaccucugccuuccaagugcuggaauuaaaggcauggccaccacugccuggcuuugugauguucuuccaaagcucccaucagugguugggcccugguaaggccuucucuacccaaccuguuugaaccacucaaucucagacuuugucuuuccugacuccuuuaaugacagacaacuuugguuccuuguaaacauuccccuuuccauuaccuaaagcuuaaaagauguguuuccuaugaaaggguaagugaguaaaagcuagugaucuuuauugacagugcagacgguccggaagggguguggugacuaaucuucccuagguccugaaaagccuugggcuaggauaugacacaggaaggagggagggguuaggaagaaaggaaauagaucauagauucaaacaagaaggaauuuucuuccugaauagaaagcagaaaagcaagagaucuuccuccuacccuaaaggcagcaagaucucccuccugacuugcacaguaugaugggacaaguauuuccuucuguuuucaacuccuuuaucagaaagaugugauuagauuuacuuaacagagcucuugcccagccaaauuguuuaaauaguaguuuuguuaaaugcuugacauucuuccugucauguaguaaaaguacagagacucuguuguuuguucuugcugcugacuucucagaggagcaaggguuugaauccaggacauggagcacgcuaggcaagugucucuccacugacucacaccccugauucuuucugcuuuccacuuaccuuucacugagguuuuuuuuuuuuuuuuuuuuuuuuuuuaacuuucccaaauuuuuacuuugaagaaagugacucaagggcucucucaucuuuacauacaggguuucucuacuucuucaguggaucuucgcaguuggaauuugacccaaaugccaaaaaagugacccacauauugaagagcaauagcugguuuaauuguuaaaaagagauccaaggaaggcauccuguguuuuaacugaugcuuauaguucuucaucugagucuuugugaaaggaagugcuuuguucagcaugugcuauggcagaaccaaacaggagcuauggaugacaccagucaacgucaaguugucaaaggauguucagaagcacuguguagcuuacacugugucccaaggagaggagggaaggcacuccugggccacaaacaagugucugaacuguguagaugguuuguuuuauuuaauaaagauugugugucguuuauuaaau

SEQ ID NO: 4915 - RNA, 7903 nt, Mus musculus
uauggaaaccaggugcuagagaaggaucgguuuuuaaaguaaagacugucuguauggagccacuagccauccuggcacugcugagccuaccaaucugcucagcguauccucugcauggggcagugacacaaggccacccaagcauggaucuugcucagguaaucagucagugguggggauccgcuucaaccaaaguggaggcacagccuugcccuuuggucuuccagcagcaguaguugaguuaguuagaaguuguguuggaaaauauccaaguguaagagguagaaacuccaucuucaccgaaaagugaaaagggaaggaaggaaucgcaguuacuggggguaaauaacaaugacagcagccgaaguggggagacugggaauggaugagcucacuccugugcuggaauuaugcuauuuaagauacuuuaggagggagggcaugauaauauuuaucuccuacaacuucaagaagcaaagaauacucuaauuuuucauuugugaaaaaaaaugaauuuauccaacaacacucaacauugacagguuuguguuaauaauggaaauagaaaacuuagauacauccauuuaaugugcucauacauuuaugccgacuuccuugcuuugguagcaaauuaaauugcaaugaaauaauaaaaugagggauuuuugcaggaaaaaaaucaaaugaagcacuacaucuacuuguguuucacuaaacugggaaugauuaaaauagaucuugagauuuguguauguguuuacauuucauagcaaccucuuuaaaacuaugcuuguuucuccacuagcaauaccuagaaaaauacuacaacuuuaaaaaaaaugagaaacaaauuuucaaaagaaaggacaguaguccuguugucaaaaaaauucaagaaaugcagaaguuccucggguuggagaugacagggaagcuggacuccaacacuauggagcugaugcacaagcccaggugugguguuccugauguugguggcuucaguaccuucccagguucgccaaaauggaggaaaucccacaucaccuacagguaauggcuccagaguuuucacacagcguuauaaaugugucaggagcaucacagaagcaaagauuaccuucuuugauuucucuuauccaggauugugaauuauacaccagauuugccaagacagaguguggauucugccauugagaaagcuuugaaggucugggaggaggugaccccacucacuuucuccaggaucucugaaggagaggcugacauaaugaucuccuuugcaguuggagguaaugcucucaucugguguuugaguuauucaggcuacucaaacaaaauaucucacauuggaagaucuguaaacaacacaaagguaucacucagacuuccugaaucugaaaaauauaaaauaagggggugggaaaacucaaucugguguguucuuagguagcaccuguguuaccuccuauggcaaaagcagccaagaggugccuccaacuucuuucucauagacacuaauggacacuaagcauccaugaagacucacacccuuaucguauucuaaaggugauggcugccuagcauucccaucacacugaagauuacaucuagauuucaagagaaauaaacugucaaaccauacagccccugagcucucuuacugaaaagggauuggaggaaauucuaauacuuacauuucuguacauuuguuuaccaucagaacacggagacuuuuacccuuuugaugggccaggacagagucuggcucaugccuacccaccuggcccuggauuuuauggagauguucacuucgaugaugaugagaaauggacacuugcacccucagguaggauaaggucagauaugaguuguccaagaauaacaugauugucuagagcaagucucaaauggaauauucugcuaucuguacuuucugauucgcuguguagcaaccugaagcccuauuaguaaucuacccauuacaugguaaugaaccauguaagcugagucauucuuucuuugcuccaaguacaauauggugagugccauucaacuuucuuuccacaauucaggaucuuguacaggguuugaguguaaccucuucaacacuguguaccacuguucaccacuguuaacugcuauucaccacuguuuaccaaucccauaauagaggaguaguuuaaugaauguaauugaguaagacagugugugaucccaaggaugcccugugugugccaggcaugguggcgcaugccuuuaaucccagcacuugggaggcagaggcaggcggauuucugaguucaaggccagccuggucuaaaaagugaguuccaggacagccagggcuauacagagaaacccugucucaaaaaacaaacaaacaaaacaaaacaaaacaaaacggaugcccugugugguuggcaugagcaauguguguuuguuuguggaauaguaacgguuacacucugaauauuugugguuucucaaacagggaccaacuuauuccugguugcagcccaugaacuuggccacucccugggucucuuucauuccgacaagaaagaaucucugauguacccagucuacagguucuccacaagcccagcuaacuuccaccuuucucaagaugauauagagggcauucaaucccuguaugguaagcaagaagaaaaagaggcuuaggggugguuuuuguuuguuugcuugcuugcuugcuugcuugcuuuagucagugcucuuuaagaaugugguacaguaagucuucaggaaaacuuuuguuuuuauuacauugugugcucucgugugcacuugugugugugugugugugugugugugugagagagagagagagagagagagagagagagagagagaaguaugagaaagagaaguaugccugugcgugcgugcgugcuauggcauacaugugcaggucaaccuguagaaauaaguguguuaucuccuuucaccaucugugucuuacguggugaugacaugagacaucccaagucaucaggccugcagcagguuccuuuaccaccaacugagccuccucccuaaccccuggauuaaaugucuacauacuguuucaucucaaaacaccaugaagaaguuuaaauacuuuguaaauuguuauauguauuccugaccuaauaacauuugcuucuccuaaacuacucccuucaggagccggucccuccuccgaugccacagugguuccuguguugucugucucuccaagaccugagaccccagacaaaugugauccugcuuuguccuuugauucagucagcacgcugagaggggaaguccuauucuuuaaagacagguuagacaaaaauauuuuccuagcuacucuuuugguaaucaaugcucagaaagaaaaagaaacuuaagaucauauauaauggauauauauaauaaauauaauauaauaaauauuucuggcauguuuuaaaaucauccagcucugguuuauaguguauuuuuaaagaucuccuuagcauuguccagaacauuuuuuuagacucccagaagaugauuuuuggccaguauaauauaagauccauauaaccagggaaguuugucucuuauuuuuauuuucauuuuuauauaucauaacucauagaccuucuaaaaguacccccccaucuuuagaaccagacaaguauuuuuauccuuauuagaaaguacuauuauuucaauuaauucauuuuagaaaaccugguauaugugcaugcacaauacucaaguaguacaaaaagauaagaaaaaucccuuccauuugugcugucccagagcccugccuauguaaaucuccugucaccaaguuuuuugucccaucuuccaaggugcucacauuuagaaagauacacaacauuuaaaaaaauauuaguggauuccuaaaauauauaauguuuuacauaauuuugaauggaaucuuacuggagcggggugaacguuccugucacccaggcuguauccguugccuggaaucacaugugggacaauccagugcacaccgcugcaaacaggugaaucgucauugggcagaggacuguuccuccaugcuuaggauuuuuaaagagaaagacuacugugguuuuuguauauuagguacuucuggcgcagaucccauuggaaucccgagccugaauuucauuugauaucagcauuuuggcccacucuuccuucagacuuagaugcugccuaugaggcucacaacacggacaguguucugauuuuuaaagguaaaaacuauacaaauguuuaauuugcuaaaagaaagacuaaugcaaugucuuugcacuaggaaaucucuccauucuguuaaaauugagauguuuuauaagaaggagaacagauuggaacuggugaaugagcauuuuaaacaagucugaccaagaugaaucuuaugagggacguguuagaaguguagaccaagagguuauuauaagaaaugacuacaguuggcuacgauaacccauaaagaauaaguaaaugauauaaauacagaauaaauaaguaaaagugaauuuaaaacgauagugaaucuguucaucuguuugcucauuugccauuuacucauucaaaaaguauuauuucugaggcaaggucuaacuauguagcccuggcuggucucagacucacuguguaggccaggcuugccucaaacucccagaaauucaccugccucugacuccccagugccaggauuaaaggucuaugccaccacacucagccaggaacuauuguuuuaaauuccugugaugaccuaagcauagguuagcaguuaugaaaaaccaagacuuuagcuuucaucuuuaucacaacaauucacuauucucauuuccaaaaccaauuagccucacuugagcaaaauuucuugggugugguuauugaacaggaagucaguucugggcaguccgaggaaaugaaguccaagcaggcuacccaaaggggauccacacucucgguuuuccucccaccgugaagaagauugaugcagcuguuuuugaaaaggagaagaagaaaacguacuucuuuguaggggacaaauacuggaggugagcuacauugggaaacucugcauagagcacaauuacagaaguucguuuucucuauuuaaggauaccugcauacccucuaauguuuccaaaccucaaauuuucugauuaagcaaaagacgauguggagguucaacuugacaaaugcaaaggacuuuucuguugugcaucacuggccaugaggaacgguggaccagagggccacagacauauugccuucucucuccacugccucucaucaugagguugcugugcaaagccgugugcaacagacuggagacucuaacaaguccuuccuagugugguacaaaccaaaagucuauuuuuagccaaguguuguaacucagcuuucaucuucuguuuauauagauucuacucauuaugacagguagauccguggagacuguguguccaggcuuagaaaacugaccuuagguacauauauagaaucucuauagacuuuaguaugaugucccuguuucaagagaucauccauuauucuauaagagaugcuugcaaauccaggaaacaugacuguugucauaccccucccacacacacaaaauaaauauuuagcauugcacaauuugaaaaguugucauaggaccccaccuaggacuguaagccucacaucacacugugucugaugggacuuaucacaguguggaucugaauuuuuuuucucuuguuguagauuugaugagacaagacauguuauggauaaaggcuucccaagacagauaacagaugauuuuccaggaauugagccacaaguugaugcuguguuacacgaauuugguaagaagcacuucauguugucaauagcaagguuauuugggguauuuuaugguaucacauuuaaauauaugcuaagcucuuugaaauauucuuagacuccuauauaaaaguguuacaaaaaauaugugcccacaaaauuuuaauauucccuaaagcuuaccaaaguauacaugaaauugauugaucaaaacucgauaagguuauuaaugucaauaaugaagugagaaacuggaaagguuucuuuuuuuuaauauuuuuauuauuacguauuuuccucaauuacauuuagaaugcuaucccaaaagucccccauacccucccccccacuucccuacccacccauucccauuuuuuggcucuggcguuccccuguacuggggcauauaaaguuuacaaguccaaugggccucucuuuccagugauggccgacuaggccaucuuuugauacauaugcagcuagagucaagagcuccgggguacugguuaguucauaauguugcaccuacaggguugcagaucucuuuagcuccuuggauacuuucucuagcuccuccauugggggcccugugcuccauccaauagcugacugugagcauccacuuauguguuugcuaggucccggccuagucucacaagagacagcuauaucaggguccuuucagccaacacuugcuaguguaugcaauggugucaucguuuggaggcuaauuaugggauggagaaagcuuucaaaucauuugccuugugucuuuuuuacucaaagccugaaaauguuaacuuuguaacuggugcaaaauucgucuaagguuuuguuuuuguuuuuuuaacaaucuucaagacuguucuauaacacuaagauacucucaaagugaagucacugucuuucugaccauugugucaguaugagauacagccaacuguccuggcugguggcugauggcauucuccaccaugucuucuugccuuuuguaucgacugugucugggcuccuguugcagucugaaauuauucacauucuucauuaggaaauagauaaugggcuccuuucacauacuuaauugacaaaauuugauugcugguaaugauuuaugggaaaacauucacucccucugaggucauaccugggggaucugcugggcuucagauaugauauucaggacaccacugacauuguuauuauuaaagaaacuuucuccuaauauacaugaaaaggaaauaaacugugaauaaguuucaucauugucucuucucuuggguuaauugccucccacacugugaucuaagagcuaguugcuugaagggaggguggaaaaaauauuaaauuucaauuauuacaucaauauuaaaaucccuuggauucuguuuagaaauaguauauuaugguguuuuagcacagucuucaaaagcagagaaaugaaguuaaauccucacucugccauuuauuagggcuauugccuuagggaaauguuuaaacuuuccuaauuuucaguuuguccucauucacuuuaggcaaacauuuugaguaagaaacagucaacggguuaaaucaugcaaaccgugcggcucagugucaggcggagucaccugguacacucccuccugccucagcccguggcccuucuuagucauaucauaaacuuaauugauuuaagaaagugucaucauguuucucaucugugucuacaggguuuuuuuauuucuuccgaggaucaucacaguucgaguuugaccccaaugccaggacggugacacacauacugaagagcaacagcuggcugcugugcugaucaucaugacaagacauauacaacccuguaaaaugagucucaugacuucccaccuacuuuauuaugugucagaaugauuaguugcuccugcauguucuguggcuccggaugagcgcagcagaugucuuucauaaugagucacaaagcaucaccugagcacagaagugaaauuuucucacugcaguaggugagaggaugcauccauccccauggguauuuuauuauuuaauaaagagcuuuauuuuugaacca

SEQ ID NO: 4916 - RNA, 30625 nt, Mus musculus
cggcucuccucuuuucucagagccacucccucucuuggcccugcagcucuuccccgcccugccuccugugggccacgccccuccugacuuugccgaccacgcccuggccccgccccaggccgccuggccuaucccuauuuggucacuggggggacuggcggcggcgucugcaggggagcgguaagggcggaaggggacgcggagcggucgcgugcgcggagagcagcucugggcgccgggcgguugcugcgggcgcucaggggcccugggaacaauggcgcugugcgcgcgggccgcgcugcugcugggcgugcugcaggugcuggcgcugcuaggggcggcgcaggacccgaccgacgcucaggguaaguuggcaggcgcagaggaagcgcacugcggcggccugccucuccauguucggcguccgcguggaaaguuccacgcguccacgguagacucccaccccaaccucauuucccucuucgcccgcgggccaccugcggagcgagacuccgucucuccccugcuuggggacggcaagccggcguggugugcagaacuugcugaguuucccugggauggcccuucagccgaagacucaaguugguccucuucacuguaguucuguggcugguagcaagaccuguagauugaaauuuguucgcuaacugccgcaaaaacaggucugauugucuacccacacagcuuccugcugaagguacucccagaauucaaguuggauuccagggccaguucggcugagugggaaccuuggguguacgcgccuuguuccccugcgcagaugaggcuugugcucggacuguagucacuacugcugcauacgcagcagccuugaggucccugugguccagagccuacgacgucaucauuaaggucauaacaagaugauguugacagccuucuguguuggggauuuuguuucucuucgaaaccuugacguuuugaacacuuugagaagaacucugaguuugugaaaauucuauugucccuugucaucuacuagaguccagucgcuagggaaauaguaaacuaggauaagaaacuuuaaaugaccaaagucuuugugauuuucagcucagucaucuguuguguuuuucagucucaucuaugaagggauaaccagugaguuuacuuaagcagaugauuuaggcccaacaccugcuuuggcuggaauaaucugggugaauuaaacaacccuauuucuguugugcugaauuucacuguguuuuguagagucaggaucucuuguauccaugaagcccuaacuggcuuugaacucccuauguggcugaagauaaccuugaacuucugauaugccuaacucuacuucggggauuacagggcuucuucacuucgauugguuauguuuuauguuugcucuuuugacuuguaccagugacaaacuggaauugcaggacuacuucugagaucaguuaaggaaagaauguugagacucugucuuagagcaaauauuagacugcuuaugggaggaggccuuuauccuacccagcugcuugccuuguguguacagauuuuuuuccucucacgaauuacugauugaaguggagugcccuuuucuaucuuuugcccucaaaacauuuuuguuguuguugcuguuggacuuucucacuaugcucugauugugagugucucacuagagagguuagugcuauuuggaaaaccugaaaugcucugaugccaugauuucaugaacuaauagaaccaauucaguucuauagagauaccuucaaacugugcuaaaagaagguguuguuaagggagugucaggaccaggccucuggcuaaucugaggcacuuuuuaaggccagccagggcuacuuaaaggagacaauaucuaaagauuuuaacagcaagccaaaaaaaccaaauaacuaauauuuguagucuuuauguacagcauguaauuaguccaauuggcauuacaauacauggugauuuuuaacaguguucugaaacauagcuaauauuccagguucauuuucugccauuguuccgcaccaccaccacuaugcuaaauugagguuuguaaaucacccuuagaaaccuuaccagccaucuccuuuucauagcugagaaauccuagacuucaugcaguaagcuaacuuauuuaaaguaaaacaaguauuacaccuuugacuucagagcagaauccaaucucaaccauuucaucaucaugccacaccugcuguccaggguauuguagaaaagaggaaauaaugccauugaacuuuuggcuuuuuaaaauacuauucugcuugacaugguggcauacauuaaucccagcauuccagagacaaugcauguugaucucuaugaguuucaggccagcuuggucuacauaguaccagaauagcuggggcuguauaaaaaaaccucugucucaaaacaccaagauaauaaaauaaauauauuauuaauaauaaugauuccagguguggcggcacauaccauuaguccuagcauuugggaggcuguuaguauuuuuugauggcaaauaacaaauucauuuucaacaaccuuaggagaaugaaauaauuuuucauuaacuuguaacuaaaguuacaaaacuuuaacuuguaacugaaaguguggcaaugucuguucaaacauucaaauauuuugcccagaaaugcugucuugggagugacaguaacugaguccagacacagguugaccaugcuauagagaugugcugaguauuguagcagugggacacauugcuuguuaauagcuuguucaccuugaugccagaagagggaggacucacgaugacuugguugaggaaggagcagcugaugaugcaacagcaggacgauaugggaggaagaacauagaucuaugcuggcuuugcagauaauccaccugauccacauccagacucacuaaagaguugaauaguuuuuuucugggccucaguuccugucacugcaaaacgaugcuccugucauaaaauuaccaggaggcuaagaugaaggaaacuucugucuauaagcacuuuauauuguuggccccaacuugauaccugccaaauacaucugcauugauccgaccuuucugaguucugucucacacugaaugauuaucccauccggaggaagauacaugagaaauagauugaacaguugcuaaagauuucaguuauuauugcuggcuuuucuuugcauuuuaaagguuucuucgguuuguuuugagugaaggggauuguugggagugaguuacguuagaaacaacaccuuugugccucuuuacacaaggaguaucucagaguaggacucagccugauaucaacaggguuggucucuaugacaaggaacaauaauaguauuauuugagcucccuuccuguguggguuguagucuuuauucagauuccaaaauaaaccacugaaaaguugcuuaccugaaaagugaauccgcuugaccuacugaagucuuaaggcacuagcuuaaaauuacaagucauacugagauugucacugaaaagugagaagccuacaaaucucuuuacacugauugacacugggguugcuggugguuuuaagaccaggaggcacccaugaacaaggagggccuuuccagaguguccauaccacccagaacagcugacaucacuucugcaggcaccucaacagagcgguugucaccaaaagguggcacaugccaguugcuaaguugcuagggaaggaagcuugcuguguucugugugaaagaucuaacaaugcagccucaaacucacugacagcuccaggauguuucuuagcaacaaugguacaagcagaacuccagugguauuaucuccccucccccauaccacugccauccgcaggccaugcccaucugcagcugcaaguuccccucccucucaucugcauacaagcuccagagacucacaauaucugggguuaggggagugggauguaugcaugauggauucacauaaacuaaaugggucucucauuuacuucaagcucacaguuccuucuucaaaaugcaaagcccuuguccuucccacuguagcccaggaagcagagacagccuggcuguaagcauguccaauggacugcucaucaaccuggugacucugccacaugggccugaacucuuccucagggcccccaucacacugucuuucuaugguauagcaacucuucagaucucucacacaaagacagucagacaguuggcuucaauguguacaccccuuggagccccaaaccuuugauugaagguuagagggcuccugcuauguuccaaguuaaaucuucaguaugcuuuaauaauggaugucuuuauuuuuguaggcucugcaaguggaaaccacucagugcugaccuccaauauuaacauaacagguaaauaugaaagauucaagguuuccuuccagguagcuauagccauacuggccugguaaguguauuuaagcugauauaacaaccucagccucagcugagguucccuccucccagaugacugaagcuugugucaaauugacagaaaacaguaaccaggacaggccaagucucaaacaaaaagaaaaauacugcuuuuuuuuaauauugcaggaaagaauuuuauauucugcauguggcugaugaaugugugagucuucagguccucuaaugagcagaauuccucugcaccauccuggcuguuucuaaaugcaucucucucucaucagauuccaaccugccauacuuagugaaacaguuaggcccucagcucacacuuaguuugggacaaaugagcuccuucuuggggcugugcacucaguagcuugcaaguguuaucauauugcauaacagggcaucuucucaauggccuuguuuccaaggcugagucagaaacuggaaaagguuacauauauccuggucuuccucaguacuuaacugcaugucuaugauacaccaucacagccugguugcuuggggcacaaagugggcuacaccuuaaccucccucaaguguuuguguuuaauauucuccuggcaaaacauagaugagauaaaauuacugacuucuaccacuuaaguuuacaguuccugccauuaugugcauucauucacauugugcaacuguauggaguugucauuguuaauuucuucggaccaugccaaucaacacagcuuaggcuugccucaaguucacugugugaaauacaagcugguccugaacuuguaguccuccuggcucagccuuguggguacuaggauuagagacucucagcaccucccuggucaugagcuucugucccaguggguccccuggagucccguuuguuucucccucacaacuuugugcuuuguucuccucagccccgccuuuccugccugugccuggggagacauagcugugcuccuguuauaaccauuguaacagcugugcugaguuuccgaauaugaagaaauauuacuaaauacagaagacuuuucacuggggagaagagggcuagaaagaugaccccaauaauaguauuuauuccugaguaguuaaaacugcuuuacauauauguuauuugacuguuaggagggugucuuuuccuauugaccuauuuuagagggaaggaagacgugugugugugugugugugugugugugugugugugugugugucaguguguguguguguguuguaggagaugacguuaucagauaggagcuuauauuguucuuaucagcagauaacgugagcucaguucccagcccccacaucagaggacucacacacacccgaaccacuaaguccagggaauacaauggcuuuggccuuagcacgcaccuguacucaugcacacacaggcacacaugcacauaguuauaacuaaaaugaucucuuuaaaaacaaaauagagcuuuaaaaggugugggggaguuacaggguggggggaggacuugauuugggcauuccuaaauuuccaugaagagccacuucacacuccaccuguucaguucuucaugcuguuauuuacauucacauuugugugugugugucuauauacuggcaucugaagauugcugguaaugugugauguccauagauuucuccucaugggguguggaguggaguaaucacacacuguuaugucuacuuacugagcauauguauuuuuggauaacccacuugacuuggugcuauuucaggcacaaauagaucuguguuugcagucaugaauguuccaucaagggaugggaagggagcauaaggaaguaaggaugacuuuggaugaugcuaacaagugagcagauuaaaauacaugcaugcauguguucacacgagcgcaagcacacacacacacacacacacacacacacacaugcagucgagaccuagcaaggucugcuucagguucuucuguguggguugaccuguauaaggcuggagggagccaguccuacccaucccagaggaaagaauguuccaugcaggagaagucacuagcguagacaccuuauugcuggugcucuugagacuggagugagccacuuccaagaguaucagcagugaccaccuggcacauagaggcugucugcucuucaguuaugguaucaugcacaggagccagagaaaccaaacaauuacauauuagcugucaaaaacauaggugaccagaagcaggaguccuggccacucaguuagcucuucagacaagugagagcucuuuuuuguacaauaucuuucagugagucuaaccuucugcacucucucauuuucaacaguuaaaaugauguaagcagccuggcuuuguuuccaugugucuauaauacacuggaguuguagucgggagccuuacugcuugugauucaaccaggguuggcugcuguacuguucuguggagugcacaguaacacuuucagcuuuuguaacugggguucuuuuuguugcuguugcuggcuuaucugugccuuuccccacuuuaugguuauaaagguaauucuggguucauguggaaauuuuguaauguauaauaaauagcuaacaucauuacuugagguauuuuauuuauuuugugugcauguguacauaggaaugaguucucucuguccacccuguggguccuggggauggaacucaagcuguuagaauuaguaacaugugcccuuaccagcugagccaccuugccaguccaguaacaaugcuuuacacgugaaaauugcuaaaagaauagauugugaggucuuaccauaaaaaaauaaaugugugagagaggacaugacuuggccauucccagugggugaaaacguguuauacauaguaaguguguacacaguuuuacucuacuuugguuaguuuuggguuucuuugggguuuuuuguuguuguuguuguuuuguguguuuggguuuuucuuguuguuuuucccagcugaaauucaugagcacaguauuugaaacauggggcuacagaaauucauaacccuauucuuacaauagacuucuguaugugacccacuguccucccuccuuccuuucuuucuccuuucuuucuucuuucuuucuuccuuuccuucuuucuuucauucuuuucuuucuucuuucuuucuuuuuuuaaacaacagaagcaaaauuacguuaucuagagaaaagcaguaguacauacaguucagagugggcuauauagucaaguauagucaagaugaccaguaggccggccacaugaacaagagaacagucacugugugaggcuuccuuucugggguucaggaggcggagauugcucaccaggggaugagcauggacacuguucugugguuuuuauuuuuuauuuuguuuucuuuuucuuguuuguuguuuaaauuuuuuuuucauacaacaucucaucacaggcuccccaccucuaacucucaccagauacugauuuaugaauuuugcuuugaaucgaguuuccuuucuacuuugccaagaaaggaaaagaggggaggaaggaaagggaaaaaagagaauuuaaaaaaaaaaacaacuaauaaggugugcuucugcuccgagacuggccugagggcucugggaacugguuuggcugcuuacugucuccacuaguuuuuugugucuacccauaguauguauuucauguuguugguuggcuaugggugguaugcagucucucugagucuuuccucucagcugggcagcacaggguagauggagugguauauaaagccccugacacacagcaccaaaaaaaaccuagaacucaagugguucuguuuuuacuccuccuccuucucuagacucccccugcuccccugcuucagggccuuuaccuggacuguucuugauacguaagguacuguccucuccugucucugccuuugccugccugcuguucacuugucacacagagugcugaacucugaaugcucaggcucuacuccuuggugaacaguccaugaucucuggugugugugugucugugucucugugugugugacccaguagcucacuagucuaacuauaaauagugccugaaggagcagugcugauuucagucaccaucuuuuaccaggguccagagcaggaccuggcacacauuacuguuggaacaguaagcaauaagcaaguguucugcauggaagaaggcaguagugugcaggcugcuccagcccugggugccaggagucaccaagguguagccagcauaagagcacagggcucuugugaucauggauuugccauaauuagauucuguguagaagcaaccuugacucuugcuucuuccucagaucaggcucuguccugcuguauucuggguaaggccuccacagcggaugcuggcacccggcagcuucuggcucugcucuguguuucugugagcgcauagaaaagacuggucccaaggcuuccuaaguggacagagacuugcugaagucuccccuggcauuugaaguugauuguguugauuaugauucaacagaagccacagagaaacacagagcugggcaaucccaugguuugauugacacuucaaagagcaagguucaugauuaggaaccugucugcugaguacaaauggcucugagccccucccucccaguggugggaagccauaugcaggugcucugcugaugaauuggguauagccagugggagcaggggcuucaagcugguguuuugagcucagauguuuuguuauucgggucacacacauuuggagacuauuucagagggagaaguuaagauggaacacuggcaggucacaacaaaccagacagacccagcaggcagaacugugcgaggagggaaaaagacuuggccuacagaagagagagacucccucuugcugugccuccuugucugugcaaggcagaagugacagggguggucacauguggaagagggcaguguagaguuucccauugagaaggguccacguggaucaagggaucccugaauccuggaaaguaucuggcaguuggcuuaucuaucacuuuuuaacuugugacauaaacuuuacaacuugcugcagucuuuuacuucuguauuuacauguggauuugucugugggugugggucagugucugugugucugugugucuugacacaugcaugcaauuaccauggaaaacagaagagacacacgugguggugagccauucugugagauuugggaacaugauuucucuaaaagagcaguaagcauugucuuagucacucuucuguugcugggaagagacaccgugaccaaggcaacucuuauacaagagagcauuuaauuggaagcuuguuuauucauuccucucacagcaaagaguguggcagugagcagguguggugcuggagaaguggcugagagcuacacacugauccaaaagcacagauccaugcugagccagguguaagcuuuuugaaaccucccagcccaccccagugacaugcuuccuccaacaaagccaugccuccacacguguucucagaaccuguucccggauuagccaugaaauuucgguucagggcaccuacugguucacaagcaccuacaacuccagcgugaggggacccaaugcuccuucuggccuccguggucauugcacuugaauguaaacacauaauuaaaaacaaaauaauguuuuaaauguugguacuauggccauugagaugagacuggaagguaagugggugggcacuaagacacauguagguuguccuggagauucugagaacauguguguuaagcugaccuaaauggacuuagucaugauggggaccccucugcuauucucuguaacggcucaugauucaguucggaaacuugaacaaaguuuaacuuuccuggagacuguucccuuuccucucuugacagucuucugcaagaacaguaaccauuguuugggauuugaguggguuuuuucuuuuuuuucuuuuuuucuuuuuucuucuuucuuacaaggucuguccauuuuuccugauugugguuucucguggucuaccuuacuguaggcuggcggagcugcaggugcucaccaccacacauggcguugacagcaaacucuuuagaguucucgugugugugagcaggugcuguuuugcucaguuucuaccuugugucacauauugugaugauccccagccuauuugugucacaagauggccagugucauucuccuuugccugcucugcgcugucuuuguucagcagcggguggacagugaggccguuugcauuuugugcugaucgugacuagcugcaguaagugggugugcagauacucaucagcaggcucgcuuccucuccucugcauugagacccaggcacuugugagcugcccgaugcugaccgggaaaugcuaaaguggucaacuaauguugaaauuuuaucuccacaagaccgacuaauguuugccuucggugucugggagcuccgguguugaguauucagagcccucacuuccucuugcuagcuagacugaacucccagcauugugugauggucauauuuauuuggacugcuuuuguauuaacauguauuuuaucuguaaggucuuuuagguuccauuuucaugggauguugucuuccaucuuguaaauuccaguuuucuuguccccaaacaguugaacuuaguuuauuauaaagaccguauaggaaaccccaaauuuagugauugccuuuuaauuggaggauuuaaugcauucacauacaaaguuacuguugcuagaaugaaucugagucucgauauuuuacaaccaguucucuaguuuugcugcaucucuuccuugcacauccuuguggcuaagugacucauaguaugcuuugguuccuuguuuacuacauuuagguuuuaacuacuacucuugauuuguguuccuuuuuuuccauguagcuuggaagaaaucaaccuugauuauaauuagcuguuucaaaaugaauucacugauuaccuuagcacuuagggacaggaauagcuagcugauuacuggugugccagugggagacuaucaccaacgaucuuacucagcugccauauuacugggaagauuauuuuuuuaaacaugccaugugcucucuuuaucauccuuuucuaguuuaagaaaagaaaggcuuucaauguuacauagcaacaaaaaacacagcacaauguggugauuguaaacauccuucuucauauuauagagucaaggugguucuuguaauuccuuaacagaguggaaacuuaagguuguagguuauuuagcaccauuguagagcacuugcuuaguguagaggaaggagugcagugccagaguucuauaccuggcacugcaaauaaaauaaaacauagauacauagaugaauaaauaaauaaaacaauuauguauaucauaaugaacucuuuaguguggaauaauucuaguaaagaaauugauucuagauucauuucuacuggaguuuggguuaaauuuccuacuugugagaguucuuguuuuacuuggcuucacuuguucucaucuuccccaaugcugggauuacaggccuuugccuccagcaccucacuaauccuguaaaggaucaguuuucugaaacaggaggccuuugauguuagggguugucuuaguuaggguuuacugugaagagacagcacaaccucagcaauucuuauaaagagaaauauucaauuggagcuggcuuacagcucagagguuuaguucauugucaucgugguggggagcauggugacaugcaggcagacacggugcuggaggagcagagagugcuacaucuggauccacaggcaacaggaagaggcagugagcuggcuugaaaccucaaaccccagugacauacuuccuccaggguuagaccuacuccaauaaggccacaucuccuaauagugcugcuaccuauugggcuaugggggccguuuucuuucagaccaccacauuccacucccuggccccauagacuuauaaccauauuauaauggagaaaugcauucaguucaauuucaaaaguuuccauuaucuuucagcgucaacccuauuuagaaguccaaagucuuuuugaagacucacagcaaugaccuaacuguaacccccuauaaauucaaaaucaaagcgcagaucagauacuuccaacauauaauggcacaggauauccauuaccauuccaaaaaggaggacagggagcauagugaggaaauacuggaccaacgcacgacugaaaaccagcuggacaaacucuuuaucacugugucugaucucaaugcgcucuucagaucuccaaccccuuuuaacuuuguggacugcaacucacuucuuucucuugggcuguuuccacuccuuacuagcagcuuucccacagauauccacagauauuacuagcagguauccacagaucuggcaugucaagcaucuugagagcucuaaggcaauccauccuucaccuuuccagcuucacacaauggccuuucuaggccuccaugcagggacaugccuagccucagccauuuuccuuacucacaucaggagauucuauaccccuuucuuuuauccugacucuaaagccagaacuauguggccaaagaugcuaaguucugcugcugauaaagcuugaacaugggcccuucuuuuaaaauagaccuucuucugcucucuguuuucagugguuuccuucauugccuaagcuugcuguccuggaacuugcucuguuaaacaggcugcccuugaacucugaaauccaccugcugacucuccagcacugggacuaaaggugugcaccaccacacccacugcuaaaguccccuuuaaauccuucucacagguuggaaguuuagcagggugaggucuuguccugaggucaccgcucccuuuauucccuuuagcaucaggcuuuucuuuaaacuucucaucuauguuuuauauuuuuccuugcugagcuugcucauuuucauuauagauaugcguaagacuggccacuaauaacugugccacauaggcuguuuugaaaucacuucuacuaaagcuguuaauccauguuuucaguuuagccucaggcagauuuuuuggagaaggccagaaagcagccacauuuugcaugaaauauaacaaaaauagucugugguuucacauacuaaaaucccuuucugaaaucucuugagccagguccucacauuuuagaucacccccaggacaacuguccuucaugcuucuauuaguaugacccguuaagaaccacuuaaaagcauucaguugcuuuucuaauccaaaguccacauuccaacaacaaaaaguauggucugcccuguucuagcaaugccccauucccuaguaccaacuucugucuuaguguucuagugcugucaagagacaccauggccacagcaacucuuaaaaagaaaaaccauuucacugggcuggcuuacaguucagagguccauuauugucauguugggaaacgugguggcagagugccagacauguugcuggagagauagcuaagaguuuuacaucuggaucugcaggcagcaggaagagacugugaagccacuaggucuagcuugagcuucugaaaccucagagcccaccccccaaguggcuuacuugcuucaacaaagccacaucuaauagugcccuauaggccugugggugguuuuuuuguuuguuuguuuguuuguuuguuuguuuguuuuuuaaaacaaaaucucagugguucaauuuuaccgaugaaaacucaggagccagauguuaagagugaaagccuauagcucagagaggcaaagaaagcacccagcugaccuuccuccucaggucuugucccagaagcaaugccccucucucuugcuccaaacugaaugucccuccccucuacuuccugugugucuguccauaauccacauucccuacucucugguuuaauaauaguauguucacuucuugucaacuaguuguuugcucuaacucuugaccguugacuuuauuuaauccuguuuacaauagucaagcagaaaagucuuggauuaaaggugugugcuaaggcugagccacaccacaacuagaaacagauuuuuuuuuuccaguaaauaacacaaucucggguuucaagguaugaucaaauacccuguagcauaaggggccauuuuauucaagccaucacagggggucagggauccagcccagguguucugccccugagguuuguccccagacauuuguuuuuaaaauaucuuaccauguaugcuuuggaagucugcuaguuacccugaggcaaggagagacagagcucagccaaugucugugaaccugaaagcuuugcuggacuuugacacuugaugcugaaguugcucauagaggguuguaucagcuccuuucagucacugugaugcagugucucagcaacugcagcuaagggagaaaggguuuauucuggcuugaagguuagggggugcagagcugcaggagcauggagcuggcccagcagucaggaaacaggcggguccuauuucaucugcacacaggaaguacgggggacaagaaaugggacacagccuguccuagugacuuacuucuuucaucgaggcucuguccugaagugcuaccagcuggggaccaaguguuccagaacaaaggccugugggggacguuucucauucaggucacuacaaguguaggugguggaaaccuccugugcuucugagcggugagcacccauaugcaugagaggagguucugaccacagggagggccugaaguucacgcaggcagagcgccugacuugacuguaaggugcagacaguguuugggauuaauaaauucccuuuggauccuguagcucuuagacuuuuacugucuguuccuggcuuugcccccuugccuccuacacauggugaagauggaagccaggccucacacugcuaagcaagaccucccccagggaguggcacuuuacuguguacuuaggaggagggaaguuacuguacagcguuagggucugugccucaguuuccuucuaguacugcuucuugggguuacaaggaucagaauuaguacaggcaaaugccuggagcagcagcugacacgcgcagguacucugaaccuacuagcauccuuguuaggauggaguccagcaugcaggaguggaaaagucaagguuggaguuagggcaccauggcuacuuaagagucuuaaagcuacaaaucgccagcugccuuagugauguuugcuggcaguucugcuguugaacuggauauucuuuuguugguggcaacagagguucauuuguaucccaaaugacauaggaaauuuuucagguccauaaaggcacagagacguaauuggacauagauaaaaacugcuaggaugccucaggugagguggaagguaggaagaaggaaaacuguaauaauggacaagcauaaaugugguaaugcagauacagguuauccucaggucagggaggagcaaauacugggagaagcaucuggcacuggggccauguugagggugaggugaaaaccuagugcaauggaaucuacaagacuccuagaaauggggacagggcccucuccucagaguccuaccuugcagcuggagagauggcuccgcaguuaagagugcuuguucuuaccaaggccccagguuagauuucagcaccugcauaguggcucacaaccauucauccaacgcccccuucaaacuucugugggcaccaagcacgcacauggugcaauuacauacgugcaaaaaaaaaacauauugauaacacucuaaucccagcacuuguggggggaggggauagaagcagguggaucucugugaguuugaggccagccuggucuacagagcaaguuccaguacaaccagagaaacccagucucaaaaacaagacaaaacaaaaaauacaaaccauauauucauauaaaauaugucucuuucaaauucuuugaagaaaaucuuagaggaaauaguccuugaacaggccugacaggagguguggcaagguaggagggaagugacacaagucuuuugaagauuagagcucagcugaggggaagcaagccugagugcuccccagggccaagcugaucuucccuguguguucacagugugagugguagagcccgcacugcauggugcugccaggcguggcacaaguggucuugcauccaauccaaugcaguaaccacagagguuacuuuauggcaggaaaagcuacacagaaaaugugccaggacagagcucagucuauuuuuuauucuauuuuuuauuagauauuuucuucauuuacauuuuaaauguuuucccaaaaguccccuauacccuccccccgcccugcuccccuacccacccacucccacuucuuggcccuggcguuccccugaacuggggcauauaaaguuugcuagaccuagaggccucucuucccaaugauggucaacuaggccaucuucugcuacauaugcagcuagagacacgagcuccggggguacugguuaguucauauuguuguugcucagucuauuucuaaugcgccuggcccuuggaggcuuucauguggcugacugauaaggaugugguaugcccugcuguucuugaccaugaaaacugauacaaccaggacuucauuuccucuuguagaguuuuacaaagauggauguucugccuucucgguguuucucaacacugaugaugaacauguccuuugccuuagaaugcuguguuucuaagcaggcuuccugguguuagguaggauguccaggugaaccucaucgacugguaugaagucuggaaagcaguaguguuuccaaaaaugaaauuugaauucucaggaaaggaauccagagucuucuguguccuguuccacauugauuuccauucucuaggaugacaguaacagcccugcccagggucacagaaggugagcucugcaugcauguacagugcuuccuaagacaucccucagucacagacaucuguaggggucucuguucccauugucuaauagcuucaaauagcuuaaguuagcugucugucuguuagucaucugucuuuguaccaggauuaugccuccucugauugcccacuccacccucaauuugccucuuauaaucaguacucagccaggaaaccacauaauagagcuugcucacaaugugucuaaaguuaaaauauuuuguacuuuucuuuuacaagaguagagauucaguuguuuuaggaauacauaagccaggaggagagaaaacuggggucagguggucugggcacucaguggagacacugcagcccuggaggcucuguguguuuauuauauagagcuauugaauagagggaugggucguugcauaucacuggacagucucaguaacuguagucucuguaggggaacacucuucaggcuguaaauauggggaaggggggggggagcucugguggacauuuucugcacacacugucaacacuuggguccaagaaaggcuuugccaucccucugacucugaggcuauaaggucuuagacuuggcugugccauucagacagggcuccccugcuccuugcagagugugucuuguuuaaaaucuuucuaggccuuuggacaauuguggacauuaguaauguaugcauuuauucucugaagugaugcuuuagcaucuaaaguaaaaacucgaaaggaucuuggccuccucccauuccuuccaguaacuccuagauacagccaguguucacuggagugaauaacagagagacaugccauguuauuggcuuugucucuaauauaacugcaaguucagagcucugagcgugguuguuuaaaaauaucccauuauguggcauccauauauaucaggaauuaguaacuccaguagggccaguucaauguuggcagugauuauauaggugugaccaaguaggaguccccucucgggugacugacauggccagcuuauacgggaaagguaaguaguaaguguccccaacagccugcuucuggagggagcuguggaagcuagccucagaggcauggcuuguaccauauucucuuucuuagaagauaaucucgagacaagggauguuuauaacaaaacaacaacaaaaaucccucaccuuuuggaaggaaacauagcaaagaauuugaggguauaguguggggauagggauauaucacacacugugcauguguggaguucagaggacaaccugcaggacccuguucucgccuuguaccaugugaguuucgaagauuaaacccaggucaucaaacuugacagcaagcaccuaugcccacugagccauauugcuaauuuuaaauguuuccuauuuuguacuauuucauuauauauaggugguauaaauccagauaguuccuuagccaaaccccauagugcguauuauauucuucuaaguaguucugcagugaucuuacauaugcaucauuagcagcuugagcuauaauugacuagacuccuagaugugggauuuuggacucaguaguuguuagauucuaaggaccauggggaauaagaaaaauaccugauuauauaacaaaccuauguaacaguacagcucuuaggaaaaaaaaaaaaagguuugaauacuuuaagaaaccaguuguguuuagugcaaagagcagaugucagaaaacauacugucauggaguaguuaccuaaaauuuaagccacagagaguaguauuauaugucauagaaacauuaucaagugaaguaguguaaugaaggccucaguuuaggacaguggcuucugagauggaagcaguugugagaauaugcucgcacuugggcggguggaggggguuauuggcagcacugucuuaguuaggguugauauuucugugauaaaacaccaugaacaaaguaacuuggggaagaaaggguuuauuugguuuccacuuccacacugcaguccaucauuggaagucaggacaggaacucaaacaggacaggaccuagaagcaggagcacagaagggugcugcucacuggcuugcuccuccuggcuugcucagccugcuuuuuuauagaacccagaacuaccagcaaugggcuggguucucccccaccagucacuaauuaagaaaaugcccuacaggcuuaccaacagccugaucuuuuggaggcguuuucccaguuacggcucccuccucacagaugccauuuuagcuugugucaagcugacagaaaacuaacacacagacugaggcgaacacagguguuucuguugcuggcauuauagaaacauuaucaaguaaaguaguguaaugaaggccucaguuuaggacaguggcuucugagauggaagcaguugugagaauaugcucgcacuugggcggguggaggggguuauucuuuguaugcgucaauauugggaggugggaaggggcuguggcuacagccagcuggcagguuccaccuccaccagaaaaacaacagcaaucaaaguugcgagacucugauuuuaaaccugugcuuuucuaccucagguauuugugacuaaguaugcacacguauuuguuccugcugccuguggugucuggaacauugucagugggaagucagugucugggugagcacuucacaggacaacguggcauccgcugggcguucgcuguugaacagauagugcagcugcggcaggcgcagcaggcuuggaggaaccaugaggguuagcucaguucucucgcugucacuccucugaggcugugacaggaaucauacagcgaaaacaugaacaccuggcauggccucuggcucacaguagcugcugcugucuaaaaugcaguauuccuggagaacaauaagcauguguguauuucacuguugcaagguuucauuuuccauuugucuuucuuuuuuuuuguuuuuguuuuguuuuguuuuucgagacaggguuucucuguuuagcccaauuugucuuucaaagaaaauguuggacauuaaguauuaaauuuucuagugcuagagccaggccagauggcuuaugcaguagucuggggcuacccuuuacaccguguagugaccugaaacacacuauaccauguaaaggguaguuucagacuguuggcaauccuccuccucgugaaggcugguuacacgcauaggccauuaaccuggcuggacauagagaccuuucccuguaaucucaguauucaggagacugaagcaagacgauucugaguuuaaggucagucugagcuacacagcaaguuccaagucagccuuaacuauguaacaagacacugacuccaaaaaacaaaaacaaaagcugugguaccuuuccacagugagcugaaaccaucugcugguuugguucagugcaguuguugccuccaggggcuucauugcugacauuugagcagacacuguuuugcugaccgacucuuuguugugggcuugcuuuaagcuuguggaugaccacauucuuuuguggcagcugcaggguugcacaugccuguucuguguuuaggccuaaaucuuuuguaacugagugacaggaccaucugcauagccuaugaaauugcuaguacagcuuuaauaguguuaucucaggcauaauuagcccugcaaagacagacucugguaugaggaaggccacugucaaugcaguuuaguucccugauagagaugagcugguguuucuucuaugcagauucaaggaacauuaacauguuuggugcgcaccuagcugaaacauguauguuuuaaguaauucugagcauguuaguaauuuuuuaaccuaaagucuauucacaauuuuccagccaggagcaugguaaugguuaguccugggcaguagucuaacucuucacccuuuccagccacggcuuccagacgucauggugcugcugcugcuucguguaacauggccaguuggugacucaggucaagggcuuuucaaucaaaucgccuaacuuuacuggacaaguucccaucuguauguaugccuuuaucuugucuauaagugggaguaacaggaguaacagcaucugucucaaaaaccuaugaaaagugcaaauguuuauaaaauauaugagucuuaggcacaguguucacuagggaacgcuggcagcuguaacagagggcauggggucagcuuugccagcacacuccaggucccacuucaguuaugguaacuccaugugccucucgggauagaaaaugcuggcaaugggauaccugcccugcucucaaauggauucccaaggcuugcaggcacacucaggccguuccaaguaccacuccacagggcccagagcagccagaccagggugggccuugggucccauuugugccaguuucuacauaugaaucuucuucuauagccuuguaguaugcuuucuaauugucuacaggaagaaguugcauucagcuuguaaaaaggaaaguaaaaauugccuaaaacauacuuccacauuagaauaccaacaccuaaaaagggaagaaaccaucuccuuccuucuugaucuagaaaagccaucgacagugugggagagaauguuuuaauuauguguguguuuguguguggggggguguguguaccaucaugauggccccaagaaacauuacauucuaagguaauacuauacaacuaagaacuaucauuaaaacccauauauuugauugaaagggagauaagacgcuuuggaaggagagaaaggcugcccucaccucuagccuggcuuguaacugcacuguuuccucucugucaacuccacugugaaccccuuacaguaaggccuucuaugucaguggacaucuaagcaucguguuugguguggagguagcacgcacguaagcacauguauagacagaagcaacugaggccugaucugcuguguagcugguguguuaacagaguaggauaggucuguagugguggugcacacuuccagucccagcagagguggggguggggacagaggcagaagcaggcagagucucaaaacauuuaagggggaguugcugagaggcuuggagggucuggagcggggacaccgugcagcacuggugaucucgauuccuucucacugucuugggccuucuagagcuagauaggcuucuugugagcguaggaugugguugugggauguacugagcaggcccuaaggagccuagcuaauugaaucuucagggcagccucacugcccugagcagccaggccggcuacccugcacuuugcauccugcugugcagggaacagcgcuccugcagaauuucucaacagacuggauggaucuugagaugacugcuuugauugaaauaagguucauaagcuacuugguguuuaggaaauaggugcucccugugcugaugugauucuuaaaaggcccaguuuucucagaggccucacuuucgguacagauuguucuagguuuuuugguuuuuuugguuuuuuuuuuuuuuuuaaucuagauuuucaguucuguguucugucaacuaauuugaauuuaggauuuuuagaacgugccuguggacuugcagcaagaaaaggccuuuuugguuuuaagcaguaauuaucucugaguuuguuuacccagccagcgaucgcuugacaggguaagguuuaggcugucacucugaaaagugguucuaaggguuccucucuaucuuccuuccuuccuuccuuccuuccuuccuuccuuccuuccuuccuuccuuccuuccuuccuuccucccuuucuuucuuucuuucuuucuuccuuccuuccuuccuuccuuccuuccuuucuuucuuucuuucuuucuuucuuucuuucuuucuuucuauuccaggaacucaccauuuuaauuuuauuuaaguauucaagcuacaaacuguucuuagccucagccuucugaaccuggcccucaggcaucagaacauuccaguuguguuggaaauaguucuauuuuuuuuuuuuuuuuuuuuuuggcuacuuuagugaauuuagaaggcuacaacuucauacugaagaauugaguuuuuaaacccaaugagaauguuuuguuuuguuuuauuuuguuuuguuuguuuuucgagacaggguuucucuguauagcccuggcuguccuggaacucacuuuguagaccaggcuggccuugaacucagaaauccgccugccucugucucccgagugcugggauuaaaggugugcgccaccaugcccagccccaaugagaauuuaagugggcauuugauacccucccaucuuuugggacuugguuacaggauaagggagauuagcuuccuucauaguagccuccccguguugagguaguugaagccauccaaguauucaggucagcgagggagacagcuucacagagaacaucauuggcucuguuagacaacaguggcugucuacuucuuccuaagaugaaacucgucauaaacugugacggaguuggcugcuaacagcuaccaugaacaguaggagacaggaaagcgcccccuugcuuuacaggggccuuuuccagagcagcugucacuggugagcuaaccguaccucagcgcauacccaccugugguacaggacuuugcaggcgcuggcucucaaggacuuuaggugacuucgaagcucugcuccuggggcagaacuaaucggguagaggagugacguggucagacggcuggaggccccagacacgagcgugugcaugugcucuuuugcauugcaucugcuguagguauaugaggcuguuauugaaaaagaagaaaaaaacuucaguaaaggaagcaucauaaauuuuguugaugcauagauuuaaaacaaaucaccaccaacaaauaagaacuauaccugagccagccucccuuuggacuugaugucaguccuuggcccuaucuuugaacagaaagcugucuggcucuucagagaguugcauuuaggccuucaugucuccaugagaaguaauauucuguuacuuucucuccccgagccaaggguagaagagaacacugcucccucaccugccuuuucaaccucagcuuagagcagugcuucucacccuguggguugugaccccuuuggaugacacaacccacccaaugacccaauccuuugauagggauuguauaucagauauuuacgauucauaacaguagcaaaauuaguuacaaaguaguaauggaaauaauguuauggucggaggucaccauagccugaggaacuguaugaaaggguugcagcguuaggaagcuugcaaaccgcugccuugaagccuagaggagaaugaggagcucggcugggugaugacagcugguggcuggccugccuguccuagugauauccgugcaggugacaacuggguacucaucagucucugaacaguaaaaagagaggggaacaccaggcuuaauaugcugucauucacauauuacauuuaguguuuauacuuuauuccauuuauuuauuggggguauaugagucugcaugugugugugacguagcacgaggcagagguugggaguggcuuacgugaguccucuccuuuuacugugagggucucggggaacaaacugcuucucaggcuucacagcuaauaccuccccacccguuaccguuuuuguugcuugaagcaggaucuugcauuuuaacucuggcuagccccaaaugugcuagcuuccccugcuuccgccuccuggguguugccuuuuuccaguugugugccugauugcccagguuuguaguaauucacagaaggaaaccacugacguuuaauuauacuuccgauuagaggaguuaagagagcaaguauaaacacugaccuuacagacagcguccuuacauucagugcuuguguuacgcucuuaacagcaguuuucccuuuggcuuauuuuaccaaugaguaggcauuuccagcuaguuguuuuucuagcacguuugacuucccaaguagggaacuaauauuuccuguucuguuuuagcagugucacuuuacggggucugaaggcugucuuagugugcaguugaauggaaagcaguguuguugucuccugcagaggccacucuggugagcaauaggauaggaagacugccuuucauuguggcuucuuuauaauagaauucauacagccguuuuaaaguguuauugcauguuacaguauucaagauugaguaauaaaaggcuaguucaaguaugacaccuucuagaauaaugauaaauguucucuugagcuucaaaaaaauagcuaauacugagugggagaacugaguagagaggcuagguuaaaagcagacagaugcaucugaaauguacauauuaagagcugggguagagccccuggaaaccagucuguacaccugagcuugaaagacaguuguagaugugacauucagagucaucauuuggaaaauaaggacuauggugcugauggggcaagaagucugugauacuaauuuuuugcaucuuacuauuuaugagaauaaaaauggucaacaagggaaagcaauacgcuuuuuuguuucugagugguggaaagccaacacagaaauaaaccacacaaucuuagagagucagaggcacaguccaggucuccaccccacacaugucuaugcuguaagcagcugcagagcuuccaaguggauauuguuuggacuguuaauguacaaggauuugcuuuuggucacauggaguauuuuauagucccucgagggaaaugccuaccaaguaagacaugaagaagacauauuucuguaguugggaguuuuauuuaaggacugaccucucucuccacuuuccaugcacauaauauuuuauaccaaaaauuauuuacugggcauuagcugaggcguuggcagcugucaagcagcucuguagaacuggcuuugacacgggaggcguucagaaagacauccuccaucugugggcagcugucaccaucacacaaugagcacuuaacugaggcaguuagcccauagccaccccaagaaguuguuucaccuuaggacaguuccaccugcuccucgccuacugcacccguggauguccucaaaguucuugaaagagugcgacacagaaccugaaacccuuuucauacucacaguuuauccuucuagacaugaaauaauuugcugcagguuuuaguggccuguguucucagcacucaguugugcaaugggauugccacaacucugaggccagccugggcuacauagcaaggcccugacucaaaacaaaacaaaacaaaucuuaaaaaagucuaaaaugugaaaggaagcaaggugcaguuucaucaucagagaggccucaucuuagaggguugucugcuucaucucuuuacuaagcguccucgcucuggacuuggcuuugcugguaguuuggguguggcacagcaauguuaucgccagcacagcuuuccugcuaucacccugauuagacccguucuguguggcaccaagacuauuagcguaugugggaucuuuuaccauagauccuaacgacaauucuuauucuggcacuuuuucagagaauaccaaccagaccaugagugugguuuccaaccagaccagugaaaugcagagcaccgcgaagccuuccguacugccaaaaacuaccacacuuaucacugugaaaccugcaacuauuguuaaaauaucaaccccaggagucuuaccacaugugacgccuacugccucaaagucuacacccaaugcaagugcuucuccaaacucuacccacacgucagcauccaugacaaccccagcccacaguaguuuauugacaacuguaacggguacguaauaaaaucacuuucuuuuuuccuauacugugaauuagcuguuaaaugccacgugagagccagcauucuauucuacaaaaauauaagcuuuaugugccuaaauuuuuuuucucacccauacuucaguguucuuaccuagaaauucggacuucagacuauuucaaacaaagcacagauaucuguuguaucuucuuaguuucagcaacuacucaucccaccaaaggcaaaggauccaaguuugaugccggcagcuuuguuggugguauaguguuaacacugggaguuuuaucuauucucuacauuggaugcaaaauguauuauucaagaagaggcauucgguaccgaagcauguaaguugggccauuuugcauacuuuaucaugaccaauaccauaguuaggcagugcucaccuccaagauagacuuaggcugugcuugagugcgggcuagugaguguggcuacguacuggugaacccgucuguacuuuaccagggaucaaacacuguuuuaccagaguuuagcaagcuccuuuuguuggcuuuuaccacucucauaaaaacugacaugccaggucucaucguugucacaacuuaguacaugugcccuggauaugucaucagaaccaaagaguauuuuugcuacaaacauguuuuguuuugguuuuuuuauuuuuaaugacaaagacacauacacaaaagaaauuccucugacugcuugaauuucccugguaguaguaguacuuacuguaaguacagacuucuauaagccagguguggcgguccaugacaguacgccuggcucuuuuaguggccuaacuuccuaauuuuaaccuuucugggcuaauuuuccccucaugugugcauggccugugcccuguggaagucagaacagagauguggcuaugcaccuguuuggcagucuuaaccacuacaguauggcggguaugcacagaacuuaaugagcagugauaauuuugauugcaaaaauuaaaauuauucuguuaccuuucuuacaaaugacaauuuuacaauaauuuuaacuuuuuauauauuucagugacgaacaugaugccaucauuuaaaguacuucaguggucaaggaaagaagaaagacugcagccuuaucaauuauuuugguuuauauuaguuuaaacuauuauuuucuuggaaguaguauaaacaagucaugcauauaaugagcaguguauuccaugaauaucuggaaauuucucauuacuauagguaaaggguauagucuggguaaaaugaauauugggagcuaacaggucauuuauccagugauugcauuuccuuuagcaagacaaguccuaucuuuuggaauaugugcauggcauugauuggucauguaggaccaacaucacugaguagcagggcccaucugcauacaggugaggagccugucacagcaucccggaucucaguaucuucucugcucacauaaagcacuugagugccagucagagcugggugauccuaauuccugccucagguuccaugguugcgcuaaccagcuuucaagugcaguugaaguaaguuucaguauuuuaggguuuagauuagaguucaucuagaaguagaacuugcaguccaaauacaucccccacgaccuccuaugcuaacggccaccgagcacugggagcucagacuuggcucgucaucucccuucaacugucaggauugguauuucuuccuuuguacauaauuuaggcaagcugcagugcacacccagcuucucaaaaggcguagcacaugaagacugcugccaugcugcuguggaaaccugucccagcauugcaaacuggucuucacggucacuugucagcugaguucuagugaaugucuuuuaggcaauguggagcugcuucccauaguuagaauuuuuuaauugaaucagaaaugccauuuuuaaaaagcuccgugauaugacgucccacccaguguuuagaagucuauauugaccggcauccugcuuguuaagccaggaauuguaaagcccaggccuuugaacccacaggguacaaaugcaguauuuuuguacacugucaacuuagucagauuugagaaaaugacuuuuuuauacuaaaguguauuuuggugaauucugguuuccuuauccccaagccuacuccuuacccuuggaaagagagcugcauccugauauuuccagggaagcagccacgcugucuguggcacuguaaguucuaaaguuuauacucaggucaaacucagggccagguuuaacaaagaaaguguuuaguuacaaaauacuaauauaguaugcuauuguaaaaggacaaagugaauuauagcaauuucaaaaaguauagaaauaagccaaaaauaucugaaugagcacacaucuauguuagaauuaaaaauguaaguauaacuuuuguaaucugcuucugguuuucaaaacaacaaacuaccaagaauuuuuuuauauauaagaaucauuucuacuugcuuuacaucggguccaacugacauggugaggcauggacugcucagguuauguuaacacggagagagaugcuaggaaauggaccauggaauuagacuaguuucaaaugagggcugcugagaaagccacacuucucauuggcuuucagccacugcucugcuuucuaugugaaauacaguucagggccugggggcaacaggguggugaaaguuuaacuuuguuugucuguuacauucuugguacuucaguaccugccagagauccucuugaacacuuguuucuuuagcacuuuggagauauaaaccacuuuauaaaggcacuguuauuauuugccucuuacauuuccacugaguuggggguuaaaaguaauuuacuuauuaucuuuucuaauuuguuacuuucaaauaccaggacuuuguugaagagacuucuuuuuaauguauaaaaauugaauguuuccuaagcauaaguugucuuccaagucucacuuaagcaaaugcuuaccuuuccuagcuuuccuagagaauguguuuauuaagauaaaacaaugaauaaauccauaggaggacuaauucaaauaugacaguuggcaacauauuuuauggugugguaauuuuguaucuugagaaagacuaaagcaaacccuuauugcccuuuuucuauuuuaacgaccaauuuugguauuucauuguuacuaagaucuauuuuuagaauaaaauuuguucuccauucaaaguguuuaguguuuuguugaauaugcccagaauaugccucuuuuauuuaucuaguauauaauucuauugaauacacaguaacuaagcuuucacaaugggccagcccuugaaugguuccauuucaauaacaacguccauuccuuggcacaggcuugggaaguuugccauuguguucucucauuucuucaauauucuucagucucuuuugcaacagcugagcagccauccauuuauauccga

SEQ ID NO: 4917 - RNA, 11169 nt, Mus musculus
ggaaggucuuuggagacuuuauuuggagacucaugaaucuugaauucuggcuuuuguucucagcucaugcuaugcugacucugucauuuucuguauaauaaaagggggaaaaaucaaauugugagcuugggagaaguggugucgauugauauaucauuaugaaaaacguguugauuuggaggggaaccaugugacugaagauuaggguuucugcccacacauuuuugagcacuuuaccgacaacccaggacuuugaacuccagucuuagauuuugauuucugacaauacugaaaaacuuaccauagaagaaaaguguauaaauugucucaucuuuaucagagaauuaugcuaugugucucucugagcccuugagaguucuaaacaguacguggugaguucauaaaaggauuggcuauggucucagaacuggagcuguaggagcacuaggcuggacuguauauccuugcucuagaaucaguaaagcgcauagguuucccuggacaagaguguccucuagcacgugacuguaacuaacauuccacucuuucacaguguguagguuugauaagguacagggaaccucccuagcacuaccacuagguagacgcucaacacacaagcagucuucacagccaguuucaaaaacagacuugcacguuuucuaaagucagggucucccucccuauauauccuucaccagauuccucgccggccuggaacucacaucuuuccggguccugggauuaauggugugcgcuaacacaucaacccuaagucaacuuuguagucaagucagucacuugacuucucauuagacaauucacuagucuuauauuuaagugcagauuuucacacuuuucuauuaaaaacuuguguguacaugcacgugcaugcauguguaugugugcgcgagugccugcucauguuaucugcuucucugcccauuuuagucuuccauuucacccacagccggccccauugugagauucaggguaaugguguaaucuauaaacuugaugaauacaaacauuuaaaacacauauuacauguuuaauuuaaccuggaagucacuuucaagacuugcuauuaaagaggaaaggaguugcacuguguuugggguagccugcucuggcagccugcaucucugugaacuaagcuaucucuuuaucgggcuaugguagggugcuuuucaacaguuaaaacuacuuauauuucccaauaaagauaaaaugauguacacauaggaugccagaacuauguacauaucuguguagugcaucacuauguagaucaagcuggugucaaacucgagcucuucuugccucugccucccaaguacugauauuaaauacucccacuaugcccagccuuugaggguccaccuuuacaugugugggauugaacuuggguugucaggccuguguauguuuagcccccugagccagcuuacugacuccaaaaucaagauuuugaaaagcacuaagaguuacugggcacaucuuuugauugguacuugcuuauucuuugccuugauuugcaaauugaccauguuauguuguaagcaagaacucuuuguccaggcuggagagaugcucuucuagagaugcucuuccagagguccugaguucaaaucccagcaaccacaugguggcuuaaaacuaucuguaaugagaucugaugcccucuucuggugugucugaagauagcuacaguguacuuauagauaauaaauaaacaauucuuuuuuuaggaaaaaaaaaaaaaaagaagaacucucuguucagagguuuccuacaguuacuauuuugggauucuuucugaggagacaguguaucuguguuugcuuguuuuguuuccuagcucauaguuaauucuaagcuugauguugguugaauuaauugacuagaaacuuucuuuuagguuuguuuauuauguauaucguacucugccuacauguaggucugcaugccagaggaggccaccagaucucauuauagauggugcuaagccgucaugugguugcuggggauugaucucaggaccuuugguagaacagccagugcuccuaaccucugagccaucucucucuagccucuagaaacauuuuuacugaaucuuuguguuaucacuuuauccccuaccaggugacagccaucugaaaccucuagaccuuucuaucucucuuacaccuacauuauucuuuuuccuuuaauaaaagauuuguuuuuaaauuugugugugaguauauguaugugcccacagaggccagaaaaacaacagaauucugaagaucuguaguuacagucguuucugacccagacugcuugauagauggguacugggaaacugguacuuacuaggugaacuaggcuggccuugaacucacagagauccuccugucucagccuccuggguccuggaauuaaaagugugcaccacuaugccaggcucacagccuuuuauaggagccacagguccaguggcuuuuaaauaugaaguugauucucaaaacucugggaaguaaauaaaacagucuccacuaccccuuugugaagauuaagcagguugcccaaacauacccacguaauccagauuacagucuuuguuagggcucuuugggguuuugaauuuugugugugugcacuauacuugugaauguguguucacaugugcacucuugcauguauggaggaggccagaguugacauuggaugucuuccuccauugcuuccugucucgagacagguucucacuaaguccugaucuugucuugacuggacuggcuggccacugagcucuagggaguccgucuguuucccucccucaaguauggaggucagaucuuuaugcuaguauggcaucuccccuguccccuguagcuuggguuuuaacauagagacuucuaaaaggacacacacuuguucagugguaaagcacucagacaucauaccaacaaauagaaauuaccgguaauucagugacuuguccagggugggaaggcagagugagcucugauucugcugaggauucagccauucucuguaugaggcuucuuaggggugacgguuugacuuuuacucugcuuugucucagucacaacgaucagacaacaacauggcaggacccccggaaggccaugcuuucgcaacugaacguuccugcgccugccagcccagcggugccccagacgcugaugaauucugccucaggugagcaccacccuguugggagagccacgugcaugcuguuuguauccuugucuuccuuucuacccagagccaguugaaguuaaaguagcaugcauuuagucuuaauccauugaggagacugauaauuggacaggaguuuucuaaagcucaggcuuccuguagucaugugguuguaaguuguuugguguuuuuacuuuugguuuuugacaucauauuuguuuguuguguguguguguacuuacacaauggcauaugacaacagcuuuagagagucuguucuccuaccaucacgugacacucaaggaucacacucaggucgguagacauggcagcaaagcaccuuuaccccugaacgcccccuuccccaaagcauuccugagauggucuaauguagugauggcugacccagaagccccgcuccuccugccucuaccacccugugaguuuguguuugagugcugcugucuuccguccaggaucuaugauggccuugacucaugcauuuguaauaugaauagaaagcacguaguuuauuuuaaugcuuuaaggaugagaagagcacagcuguauggcacgauugccuuagggguguuagaguccaagcuuugguauucaaaacucccuuuuuauuuguuugguuuugagaugggaucugccagaaacuagccucaaacuugccugccucugccuguuugugugccaucuugcuagauucaaacucuuuuuaaagcagauguuuguauuaccuugacagaaccuauaaggauacugugugccauaaaccacugagcaccuaccccucuuacuucuagauguagcagcaugcauugcuaaaccgucuucacugcugggugcagugaggggacccuuuaaucccgguacucaggaggcagagcucugugaguuugaggccagccuggucuacagagugauuuccagaacagccaaggcuccauagugcacgcugucucaaccaaacaaaagcaaacacaguuaugugacuacagcuuuuccuuguuugcauaaugagcaguaauccuacucacuagaggagagauggaugcuacaggaaguuaucgauucauuuaaagcccuuauguguuuaaguuucuuuucuguauaugagauuuuuuuauuugauuuuuaaauaauguuuuuaguugaaauguauagguuuugccuguauguauguaugacauaccauguacauagguggccauggagggcacaucuggaaacagcaguuagagaugguuauaagccaccgcaugggugcugggaacccauccugguuccucugcaagagcaguaggggcuuuuaaccccugagucaucucuccagccccauagaaagaaagcuuuuggcuuaaaugacagguaguaagcaaaagccucuuccuugcccccaaucaggugcagugagccuuucucuuuguugaauggguccaaggccacacacagcugccuaacuggagcuucuaacagugggcaggaaucugguagcagacuugacuggaggguuugcagaugugagaccuccuccugcccuaaccucacgccugcuuugguugaaaacaagcuuuaaaaggugauggcugaaaaugaaaguuaggguagaaugugggguugagcaaugcuaauuauaaaggugacuugcugaagaauaaggucccacagcuggcauagacuuuggcacucucagaaucuauuugauuuaaauccuagaguuuaaaaggugaaaaugacguggguauuuuucacugguaguuuuacuuugguaacuuuuuuuuucuuuaacuaccagauuucaaauaaaagucaguagcagacacuuccuuacuguggaagaugagggcagccuguguucacugaaguugguugacuccuuuuagaacacuguuuuaucacagugguucauccauuuguuuauccuuacccuuccauuuuuugguuugauucuuuugaaagaguuucuccauggagcccugacuauccaaacucacaaaguuccaccugccucugccucccuagugcugggauuaaaagugucugugaccaugcccgucaauaaaaauuauauuuugauuguuuguuauuauguaugggggagaggcuucagugugucagagcauaagguuugggguuggauucucuucugccucaggucuaagaguugagcucaaguaucaagcuugggaggcuuuaccagcugagcccuauguucuccccugcagccucccacugagagucagagguguaacagcagcugguuuucaggugauagaagucuguauuuagaacuugcuaggagcucuuaagaccccacuccuagucucuaaaccaugugauaaguggcagaggggacaaaagaggacagggugacauuggagaccagaaacuaugguuugcucauagagauuuguuucuaguaauuacacuguccuuuaaggaggacuuugugguuagacgguacagugagcuaggaagagauaggucuacagcugugcugaaacaaaggccuuaaaaauauaaucaccaacuacuucagaaggaagcuguguaaugacacaugccaggaagccaacacugcaagagcagaggcagggggauggcugcagugagaccuagugcucccuacacacacacacacacacacacacacacacacacacacacacaauuguguucaagacuccagggauaccaagucagaacuguccaggucaccuauagaauacaggaguguuuuaaauggcaagcuuuaaacuagugugugcuguaaauggucucuaaccauguaaguaguugguuauacuggauuacugugaaguaacaaaauaucuauacauuuuaauauacaguuuuaauuuuuuauuuaauuuuuuuuuauacauugaugguuuaaucaaugcaccuaaaacuuggggaucgugggagccuauuauauguggaagucuccagaauaaaacaaauuuuagccagagaccaugcuacuuggucuauucagugcugaugacacuggugguguguguggugugacuaaaucuggagguuuuuuguuuucucccaauagagaauugaguuccuggccucacccagaugugggaaagacucuuccacugaacauuguccccguguccacucccccagcccccgucuuccccuccuccacuuacacuggggcuucagcacauacauacauacucucauuugagaucaugucuuguguaucccuaccuggccuuguacuaaguagccaaagcuggcucugaacuccuucaucuucuuccucucaggugcugagaugugagcuaccauccccagcuacuucacauaaauuaaagaauauuuuaguccuucuccauguagacauuucagagugaaauaaauguuuugaaaugaaaauuagaagagcuauacaaucuuggaccaggagaucaaaacaaaucccugcucgugcccuuacccugagcugcaacccccaggaagcuuuaaucucagcuaaccuugugcccacguaaaaugaugggcauaauggucuguuaaaauuucaaucuagaggcaugugucuuugaaaggcaacccugauugggguauauggggauuuggagggaaagggguaaugauauaauuagauuaucucaaaaaacaaaagguauaaaaaagauuaauauuuuauaaacuauuuguaauuacugguagcugguuauuacuucauuuaaaguaauuuaaaacaccugucaaccaugacaaagaugaacuguuucuuugaagcuuucugugaucaaggccuuaagcuuuuuaguuaaguagugagcuuauuuucuacuuuaaucagacaguacaguguugcauauucagauaucuuuuuuccuuuugguuauuuuaagauaaaaucucaacaucguaacacuauauuaaugaguguaguacuaugcuaacaagacuguauuaguaaaaauucaagcaggaauaauauuugagugaagcccacagucagugcaauaaggaaccaauuuauuugucuuguuaguuauuccugacaucucacaaauaacucuucacaaaguuuuuaaguaaaauggcuauguuuuucuuuucauacaaggcaauucagauaaucugagaaaugacaaguugaaaugggaaaaguuuugggguguuuacaaaagaggagguaggaagacagggagggaagaagcguggucuuggggagcuacauuagcauaaacauggucaucuguaacccuuagaagugguguucagccuguauaaccaacccuuuacucugcagauggugucaggaaggucaggcauuaagacuagcucagccacauaguucagaugccauccuggauuauaugagaccuaugucgaaaggcggcagcgguggugauggugguggugguggugguguguuuguguuugggggggauuugguuugcuuuaacagccuguuuuauuuuauuuuauuuuauuuuauuuuuauuaauuuauuuuuugugcuguggaucaaacccaagacuucauuugagccaggcuuagacuuuauugcugaacuggaaacccaaccauucaugcaccuugguuaguaauuuagaacuaaccacuauucuuacauaauaaugugggucaaggauuggacuuauuguacuuauagaaccuugcucaagauuuuauucccagcacugacccccccagcucauccuguuccugcucccaacccccauucuauaagugcaaauaagcagcuugaaagaagcacaaagauuuucaaacuucuugcugaaauagaaacugucaaucacccaaagauaaaauggccagucaguuugcagauggccuuagucuccaguaccaggaauccugaagcuuguuaauccugacacuagccagcacaaagcugacuuuacucugcucagagcugcucaugcacucuggaucagggccuuugacauagcccagugcugcuacucaaguuuucuuuucuccuuuuguacauaccagaguaguuguauugaguugaauuuguaaguaacuuucuuguguuuuguuuguuuuuugaugcagauccaacugcagcaccaagcuggccucaaacuuggaauauaucuugaccuggcuucugaaugcugggguggacacugguuaauuguuuuucagugucuuuaauaaugcugcuuucucccucucuucuaccccuucuuccucucccuauuuccccuucucccccucucucguccccuuccaaaauagggggggggguguggugcacagcuugugggaaucauuuuccccuacuaugugggaccuggggaccaaacucagguuuuaguuuugacagcaggacccuauuuacuaaaccauccugcuaaucuuuuuauuuucuaaucaacaguuuuaaauuuuuguuucuugacuuacuaugugugugugaguguauauauuuguaucacuugcauacaaagaggcccuggaucccugggucuggagugggugcugggagcugagcucagccagagcuuuuagggucuaucuagccagccuugauaggauuuuauaacccagacuaggcuuggacuuuggaccuuucucccugugucccaaguaucaaggguuauaggcuggugcuagauaccuugcugcaggguuuuuguuugcuuugagaucuaacuauugcaggugagacauuuccaagcuuugaguucaaccaaagggagcacccuugaucuguccugggagcacgcaucagcaaugcuuuccauauauuuaggaguuauuugaacucugauaguuacuguuagguguaaauucugaucuuguaaaagcaacaaauguaaacuuuuguuaccuggcccuccaggggaaagagcagagcaggagcaaacucagagaacgccaggggaagcugucccuguguuaauugccauuagccaauucuccugaggaaaacaagucguuaaauauuaagacucgaagauagaaauguccauguuaaacuuauucuccaguauuuuuuguagauguuuuggaaacuuuguggaaagagauuaaauuauuugcauuugaggaccaaaugaaauccuguuuuauuuccucccucgguuaguccuaggauuuuauuuuugucuuuuccaccgauuuuuaaauccuucuggucacuauugcuccaacagcuuuugugacucauggaaggaguauuugugaaagauuuaagauguuaauuuuucaaaaauggcaucuagacuaccauauauagacaggaauguaagugaaauggauuaaauccugcaguauauuacauauuuuuuuacauaaaaaccauuuauguaagaauaaucaguggguaaaacuuuccuuugguguuaacgaaagagauuguuuuacuuugccaguuugaagucuacaugagcgcuuugagaaaacugaucuuaccaaaucacugagcuguugaauuaaguucaaaacugauacuuaaugcauaacccuaagugggacauacauaacagacccauguccucuuaagucuuguggaacaucauuuaagaugggguagaaaaacuauaagagccaaaagaauagggaggaguguugugaaaugcugcuaugcugugagcgcuguggaccugacauggcucuuaaaugcaaaagcucacacaacagccuguggcaacuugcagaagaugaagcccguucauauuccagcaugggugugaggaggggcacuggcaguuggcugcuggggaaggagucauuuuucuucauugguguggccccugagguuguccucuccaagccuguacccaugcccacucaacugggacucaagucacuuuucuuuuuuaaaaugaguaugguauuuuaccugcauguaugucuguguaacaugguaaccuuggaagccagaagaggcuaucaaucccccagaacuggguuagagaugguugugagccgucaucuggaugcuggaaacccaacccagguccucuggaagagcagccaguacccuaaaccucuaagccaucuuuccagccccuuggcgaguuagcucgugaagggaggagugcugguguggacaaggucaggaugccaugaguacagcaguguuuuuaucugagccugaguuucgugaguggcaugucccaggugcucugguauuccaugauacuaauaugugagauuugacaguugucacugcugucccuugagacuagacacugcccuuccaaagucauugauucaacaaauaccagcaaauguugccuuuucuguaacaaaaucacaacagaguuacacaggugauucccuugcugagccagcagagcaaacgcaggaagcaguagaugauggcugucgcgaagggcucaccaaggggagcagaguuucauucccacccucggccauuauucaagcccuuccugcaugccagccacugcuuaaaucacaagagcagguuauagacagacacauuauauuuuccuguuguuaaaacggcaaaggggaggauaacuaguuacaaccuuaagugaugaagggcuggagggagauagccucucguggauuuuucuguagcuccuguagccgugggccuagguagacucaagggggagccccccaucuaugcggaggaaagggaaagaauccaagcaggguaugguuuucccauugagccauaugcugggaaaacagugacgucaacuggaggagccagucaaaguuagcaaggaggccauuuggagucauggaggauggcaggguguaaguagugaaugggagaaggagugcuugauuuuggaccuggugaacaguuuagugagagggaaggaaagguagguuaguugugagagcaccugcugagaccugaaacacagcagaguccaggaacagacagaagacacgucacaauaccugggaggaguuuggagucuucugaacauucugagaauuccauuaaaacca

SEQ ID NO: 4918 - RNA, 739 nt, Mus musculus
ugaaagcuuccuccagauaguguggacuuacaugccuucagcugcaggucaaugguggacauauugcacagcccacagcauggugacacuuggccucuugcuggcucugucuucagagagaugaaaacaucacuguuuugccuuaacuggaacuccucauaaucucuccccaucugaagccuaaacaaccaaguccauuguguuaccugacuacuaagucgacucuccugcagguccauuguguuaccugacuacugagucgacucuccugcagguccauuguguuuccuaacuacugagucgacucuccugcagguccauuguguuuccugacuauugggucaacgcccuucugccuccuggcaacuuuggaccuuaccaauccucuauuccauacuaaaucugccccccagaaucucaguauguugauggaguucccuuguaauguaaucuaugcccccaccaggauccgagcuuguuguuugcuuuccuucuaccuucuuaagaauucagccuuccuaucuaugcuaccauguagacaccuccuuuucucaugacugugacaucaaacucuguccucuaguccuuuccaacaaggucucuugugaauuaauguggaaaacucaguggaggccucacagacagaugccucacucugcuauguuaugcaggcugaaauccauuuacaaggugcauagacuugcuguuaucgugcauucuggagaaaagacaggaaugg

SEQ ID NO: 4919 - RNA, 2302 nt, Mus musculus
uauaccuuuuauacaaaaaauaaaaugucacgauaugucacugucuguguugaauauuuacaaauauuuucaaauccugaaaucuuuacaacaacuuugcuuuuuauaggguggggcuggcaugcuucuuaauucaguacaaauucugauauguuuagauuucuucucaaagcaucugauauuccagguggaaucagacuagugaguagcuggaauuccaacgccagagauuuagaucuagccagugauuggcuagggaggggcuuugggcgggccuuccuagagcgccaacgcuugcuagaaagcuauggagccagucuagacugucacuaucagucuuuguaguauuuacgggugcgaggauucugacauucugcuaacuucucuuagcuuuacuagagcaaccugcaaccagaacucgcugggauuguagagaaccuagggagccauagagacugucgcugcaggagaacgaguaagaaugggcuacgucuuagccccagguuuuuggugaggacuguaaagcaaacuuccuaggaugucuagguuucaacaaacauaagaaguccggagauagcgggaguccuuuuuuucagcaccggccacaccaguuccgggucucccauucaagaagaaacacgaaaaaaagucucucgaauaacucccaguucucagaccagaccagcuugcuccagcuacuucuuccuguccucaccccaccgcgaccgggacagcgcgacuaccacccuuccucugcgucuggguggaggguaaggacaggagcugaccaagaccgccccucccaaccaggagguggagaucccacggguccugcgacucuacacccacuuccuccucccucugccccuauaucaccggcacccccuccuccuucccuuuucccuccucccaggagacaggggaggagaaaaggggagcuugggucgucaugacugagcugcaggcaaaggauccgcagguucuccacacgucuggcgcuucgcccucccccccacacaucgggucccccuugcuugcacgcuuggacucaggucccuuccaagggagccagcacucggacgugucgucuguagucucgccuauaccgaucucccuggacgggcugcuuuuuccucgguccugccggggucccgagcucccagacggaaagacaggggaccagcagucgcuguccgacguggagggagcuuucucugggguagaagccacucauagggaaggaggcagaaauuccagagccccggagaaggacagcagacucuuagacagugucuuagacucguuguugacucccuccgggaccgaacagagucacgccagcccuccagccugcgaggccaucacuuccuggugucucuuugggccagagcuuccagaagacccccgcagugucccugcuaccaaaggguuguuguccccgcucaugagucggccagagaucaaggcuggcgacagcuccgggacaggagcaggacagaaggugcugcccaaaggacugucaccacccaggcagcuguugcucccuaccucggggagugcucacuggcccggggcaggggugaagccguccccgcagccagcugcaggggagguggaagaggacaguggccuggagaccgagggcucugcagcuccgcuucuaaagagcaaaccucgagcacuggaaggcaccggcagcggaggaggagucgcagccaacgcggccucagcggccccaggcggugucacucuggucccaaaggaagauucacgguuuucugcuccuagggucuccuuggagcaagacucucccauugcccccgggcgcuccccacuggccaccacagugguggauuucauccaugugcccauccugccucugaaccacgcacuccuggccgcccgcacccggcagcugcuggagggggacagcuacgacggcggggccacagcccagggcccuuuugccccgccuaggggcucgcccuccgcgccauccccgccggugcccugcggugacuucccagacugcaccuacccucuggaaggcgaccccaaagaggacguguucccucuuuacggcgacuuccagacgccuggcuugaagaucaaggaggaggaggagggcgcggaugcugcugugcgcucgccgcgccccuaccugucggcuggagccagcuccuccaccuucccagacuucccgcuggcacccgcgccgcagcgagcgccauccuccaggcccggagaagcggcgguggccggcggacccagcagcgccgcggugucgccagcguccuccucc

SEQ ID NO: 4920 - RNA, 7454 nt, Mus musculus
caucgcaggcccuagcccagcuguaagacagauaggaguucguggcacacucugggugccuggugagguguggaagcauggcuaaaaugucuugaagcuguugucagugguucuuauguucauagcaaguacaagcugcuugugagcccauugguaagcagugguguuggggaaggggcaguuggacucuagucagcagguguuggguucucacuucauuccugggauggcauaaguaaaggccuacuguaaugugcuggucagugccgccacucuuacaccaacaccagcuaaucaacucuccaugaccucuucaaaccaucuguuugaaacaguuuguggcugccuuucuauaacugcaacccuagaugaaccauuuccuccuugguuaaagaggcagcacuucucagagugaagggacaaaagcgauuggugcuaaggagcaaaacugugauuggucaaaaacacaagcauuaaugacugugauuggugcuaagaggaugguggauccaaacaagugauagguccaaacaccccuugggaaacauucucucgugcugcuugcuuaugacacgaggcccagugaaggauggaagcuugcuggcucacccugucucuucucccuccacccuuccuucaccucuuuccucuacguucuuaugcaggguaggccuguaguggagacaguacagauggggcaacuguggacuugacagcuuauaaagagguagacucagcagcugggaccauuaaugcccagucuuuaguccccaucacugugcuuccaaauaguagccacugcuugagagcugaaaguccugcaguagguggcucuccugcuguguacccugccuguccacuggagacccugucugcuuuccugaauccuaccugauggccaacaaucucacuaacagcagaugcugaugcccacuuccuaagcagucagcuagcuguuccaguucccaaggaguaacaugugccuggcucucaugcacaaucccagggauuagccagcuucucugcuaauccagguagcagauacagaaggggucaggaugccuuguuaauaacaauuccagagcaaccagguagaaaaugaaguguguguguguguguguguguguguguguguguguguguguguguguggagagagagagagagagagagagagagagagagagagagagagagagagagaaugagagagagagagcgcgcacugaggagccagauaggagaaccugcaggccuugcuuaccagcagagcugcagagagcuggccacuauaaacuggccacuauaacacuggccacugccaggagucuaguguucugauccugaggccugcaaaagugcuacaauguuuguaggacuaaggauccuaguguccaagcugacacagggacuauuaaccaugcucccccgcuggcugccaccauuucugucagaccagcauuuaacaaccaucuugcucacccuggauccuacccagguagagcagagcucucauccugcugauucuuggcacuuggacucuuccucacgccuggagcccacacaaagugcuacaugaugggcccuuaagggaacaaagcccuuggcgaaagcaaaaauuacccagccagugugggguauaucuuagucaugccaagccaacaccaaugcaaagauaacagugcuugccacggugauuuuuaugcuaagacagucauaugcucacaguuacugagguccaggccaucuggauacagccuaaccaauuuguuaguugucugaaacguaccucagacuaaaucuugauaccgauucagcaaggucaguuucagcugcacuuuaguucuugagaaguguggucuuaugugcacagucccaucuaacugggcacaugggcagcaaggccucaagguagugagcuugugccaugugacaaagcugcagagcccgagcccaccucaaaugccagcucugccaacuggcucagugaccuuggggagacuguguucauuacauuaauuccuuagagcucuuaccuuccuucuucagcuugugggagcaagaaaaagucacagggucuccaccuguccacuggagacccugucugcuuuccugugaugauccagcccaugcguucaaggccccccuaagcuauauggccccagugcagaccuucaaggccccccuaagcuauguggccccagugcagaccuucaaggccccccuaagcuauguggccccagugcagaccuucaaggccccccuaagcuauguggccccagugcagaccuucaaggccccccuaagcuauguggccccaguauagaccuucacuccuccucccugcaaguaccuguccucacccacagcugcagucuucugucugccucugaccacacacccagcaccucagcuuuucuugaagcugccaugucuacugaacucccacuuguuuuucagggugcaaagcaaaugucaccucuucuuugaagccccuacgccccaccuucuccaagaaguugcucuuuucucugcacccccacucuuccucuaccucccaugugugaauaauaaauaacaccaggcacugaggguccaccaggaacuuagagaacaggcuuugaagugagcccaaucuuggaauagaaaacacaagacagagugacccacuugcucaagggcacacagcccaucacuggccaagccaggcccucugacaccaugugagugcucuggaccacuaugcugagcugccacugcacucaggcccaucccguccacuggggggcaggggggacagccagggguuggauuuuagccacuuccacaguuccuagcaccuggcacaagacuggauaccagguccugucuggcagacacuaaagcaggaggacugaaagaaaacuccuagcccaggagaagccuuccccgaccacaugccagucuccucucugaccaugguuuccagucucuucauugcaguccuguccacugggccuaguauugucucuuugaggugggcuuuuaaaagcacuacuuccauucuaucugguugagaaccccagguuuauccuguggagcucugagcucaaugcuacaacaaaggcuauauuccuguggaauguagaacggcuauguaaagagaagaaacggggcaggauuuagacagcaccagacuugcagaagagcccagacuggccacagaguucccagaggcagcugugauaucuagagagaagaaagccuugaagagggaguucuuugaaggcacagcuggcugcacaccagucuuggagcuggcagccugccuugcucagaccagccagaaugucacugggagggucaacaaaucagagggugucacuuuaaaaaaccuucagagcuggguucuaaucagcuuuacaugaaacaucauuuaagccaacacuuaaaugaccuggguugaaaacgcugacuuggaaacugcuggaaaccacaguugggaggggacaacugcugccaggaaggguugggauggaggcaucccugaucugaugcuuugucaccacucugcagcugaugagcuugugaguguucagaccccugguaaauauacacuaagcaugacauggacaacaauguuucaaguggcauuuaaaaacgcacaagauagggucaugacccuuaccuaacucugucacuaagaagauagaagacagaggccguggggcauggucaagucccuuagggcugcuccucuuaggacugcuggagagaaagacucaaggaccaucaaagcugcccuagacagacagggcacucugaccacagaaagggagggugcagggaggggcauggauggccugcauagcaggagcacuaccgugggagcaagauggcugugaggggugaacauggucaguggguagagaaaagcuagggcagggcaggguccauguuggacaguagugagaggaaaggaggaaagagcccagacaagagucucuaagcacaauccaagugacuuggcuuagcccaggcuucugacaagugggggggggggcuagggggaaggcgggaaggauaaguauguggggguggcaguguguguaugugggggacugagauguggggguaaguauauggguuggcaguguguaucagggggagagauguguguguugguaaguauguggggggugaguugggagguauaaguaugugggggugacaguguauauacgugggaggcugagguggggguaaauuauguugggguggcaguguguuuauguggggggcugagguauggagggguaaguauguagagguggcuguguguguguguguguguguguguguguguguguguguguuuuccuuauuugagauucauuguauagcuuuaaaaucuacaugugaaugaaugucugggauggggaaaugguuguucugugucuaccauuccuucaaacgcacacuguaucuuuuguuaacuaccuacaagguucugagcuccuggcuccagcuacagaggcaacagggaccacuggaagaauucagaaugauagaaauggaguuuuagaaugguugucugcauaggagguucccagguauaaauacaggacacccagggacaggugaauuccauaugagguaaauuccauuuuuuauuuuaaaaauauacguaagugugggucauacaauacuccccccccccaaagucuuaauuuaagggaguaucuauuuucccuuuuuaccaacccuugcccauguaggacauggcaaacaaaugggaaugaaucaaggaagaaguccaauggaguggcguugagagguuggcuccgucggccguggaguaggcagguggggugcugugagcaguucugaaggcagcugacuaggguucuguggcacaggccaagcaguagcccuagacagagaugcaacuccugaauuagacaagggacuucuguccccccaugacuacuauuagucgaucaggaggacaucucucuacuccuaucucugaguguaacagugagcccuggccacgcuaccugccaugcccaugcugggaaagccaugucccuuccuuacugccugccugguuauuuugagcaaagggugauagaauaccgauuuugccagcaccgcccuuuggccuacauggcuugggcuuggacaaucccaguuucucuacauacuaauggcucugggauagacuacccaggcuuuuuccccaaacagaaggcaguuugugauuugcccuucuaaugcauuaauguuucuacaugucaguuuuaggagugaugcuuacacaaugucuaaacaguuccuuuugaaccacaaauaauagguguguaaaccaacucgagggcagugguucucagcuugcugaaugcuggggcgcuuuaauacaguuccacauguuguggugaccccugaccaugaaauuauuucauugccacuucagaacuguaacguugcuacuguugugaacuguaauguaaauaucugauaggcaggcuguccaauccaacucccaaagggguggagagccacagacugggaaccacugcacuagagcguggguuuccucaaguuccccaccaaucacuguggucuugaaaguccuuccagccccacauaaguauccuaacagacucacuuuccacuuccagccagcccugcaggcagcuaauugcuuuaucaaggguuuuaguugcuuuucacaagucucccagauuaaaccccuuacucuccuuuucaaaguuuuuuaaucuugguuagggccaccgcauccuucucaaagacauucucgauacacaugcucaucaugggucaggagaucuuuuguuuuugguuuuugguuuuuuucgagacaggguuucucuguguagcccuggcuguccuggaacucacuuuguagaccaggcuggccucauacucagaaaucugccugccucugccucuccuucccaagugcugggauuaaaggcgugcgccaccacugcauggcucaggagaucuuuuauaucuagcauuguucucaugguucaaaucccuucucugucucugucucugucucugucucucucucucucucucucacacacacacacacacauacacacacacacacacacacacacacacacacacacacacacacacacacacauacucaucacuacucaggccuucagcuuuuuccaucugcuccucaaauacccaagaaaggcucugugcuacucacacauuaaaccuaccauccaucaugcccguaucucacauuaaaccuacuguccaccaugccuguaucauacauuaaauugucccaugccugaggagcccuagacaacugcauuuuuccagcagaguuugacauucaguaucugaccauaggcccaauaguguauccuuaacuggaacauaguagguuccacucugcacaaaggaagucacucucacgugcaacacacacacacaugcacacacacacacacacacggaugcacacauguacuacauacagauuuucucuguuccucuuguuggagacuuuuuagcuacuuaaaacauuaacaguucuuaaagguaaggagggacagaagaacaguccccuccacacaggcaguuugcaccaggucugcuagugagugacaaggacaguaacuuccuuuuggagaccaucaccuguuacaaccacugaaggaugccccaugcugaccugagaaggggaggaaagagaaaccacguagaaaagauggagauggagcuuaaccuggaagaugcccaagucccaccucaccagugguaaggggaggagagaugcccagguacacacuuagaaacuuggaacaagcaugcccucugcaggcaagccuaggaaaugcacucacuguucaaggguguagagaacaacccuauggucuaggggcucccagguggcacaggauugcucacgcuccacaguaaaaaggacacuguggcauuccaagugaugucuggccaccuuggaagaaacuagcaggcugccaaacuguucuuuuguuguuguuguuuuguuuguuuguuuguuuguuuuuuguucguuuguuuuuggguuuuuuguuuguuuguuuuugcuuuucaagauagaguuucucugugcaguccuggcugucuuggaacucacucuguagaccaggcuggccuugaacucagaaauccaccugccucugccucugccucccaagugcugggauuaaaggugugcagcaucacugcccggcuugccaaacuguucuuuugcuacaaagaauauaacugcaccuuugcuacaccuaacuuuugggcugagagaacugccuucuugcuucuuucccccagggcuugccaccaggcagaccuguggaccaacgcuagaggcacuuucuagaugcaauuugcaagaagccuuugaugugguucccaccaccagccuucuuagg

SEQ ID NO: 4921 - RNA, 2923 nt, Mus musculus
ggucaaugaaaugauucugcuauacucauagaucagugccuggcgcuguugucaucagagaggguuccuccagcagcugauggaaacagaugcagaaacccacagccaaacauuaggcagagcacagggagcccugcagaaggggagagaaagaaguauagggguuauaggggucaagggcaucaggagaccuuggcucacagaaugaauuaagcagggcccaaaggggcucagagagacugaagcagcaaucagagccugcauggucugugcucuauccucuguguacauccugugguuguuuagcuugggguuuuuuaggggacuucuaacaaugaaaguaggguugucucugaaucuuuugccugcucuugagacccuuuucuucuucuuagguugccucauccagccuugauaugagggcuugugccuagucuuacugcaucuaguuaugcuguguucaguugacaucacugggaagccugcucuuuucugaagggaaauggaggagcaguggaucugggagggaggagaagaggggcugggaggagcggaggaaggggaggcugugguagggauguaguguaugagagaaggauaaauaaaaauugcaaaaaaaagcucaagcaauaaauuauagacaaugggacuucauggauuauauauacauauaugucaaguuuauuuacauaggauuaauuauuuuuuuaacaagucuugcuuucugaagaucugccccacuccacagaugaggaaggagacaacuguucugaaggcagacaggagcuaggaggguaauaggaaaggcaaugaaaacaggaggcaggaaagcugugucuaacccuuccugcaggaacacgcuuucuacuugaacaccuggcuggcuguccuugugucaccucuaauggagugcugugcgugaugucaauuaacuccuauugaugcaacaacauaccagagaaaaucaacuuacaaccacaaguaagagguucauuugcuuucaaaguauccucucugcaguuggcugguaccauugucacaguccugagguaagacuucaagguaacaggaaaacacggagcauccaaggggcugacccuguggcagccaggaaacagagagaaggaagagaaagugucucuggaacacacacacagugacuccacugucucuuacuaggcuccacuucugaagugcucacucagcucugaauucacagacggagcaacuaugugacguuagcucucucucaguccagagccucugugcucuuuaaggacacaaguucccuuccacagcccuacuguuugucuucuccaccacaaccagagcaggcuuuugaaaccuaaucuaauccugccuugcccuuucccuuaguggaaccuuuggcuuugaauggacagcucagacaggcccuauacaucggcacuggcuuucuugcaagcccauucccacccucauucccauucuaggagacacuccagcccccaccuaccacucuggaccugaucaguccggcuuccucccaucuaucaagaugaaugcgugagugagcgagcuucugaccuuccugcuuuagcacccacgcugugguugucagagauguccugaugcucccgucacuucacacugacccuuucggaaauggcccauucuuuaaaauaaucucaauuuccuucccaaaauuucccuucauagggagaugucucccuaugauuaaaguguucucugagcaagaaggagggccuacgcuuagaucccagcacucacaaaaacugaacacagcaacacagucuguaaucccaaaacagcagggaggaguuugcuggacaccgggugagagcugcagguuaagugaggagcaauacaagaagauaccccgaguugacuucuggcucccacauguaugcacaaacaggugcucauguacaugcucauggggaaagaaagggggagggugagggugagggugagggugagggugagggugagggagagggagagggagagggagagggagagggagagggagagggagagggagagggagagggagagggagagggagagggagagggagugucugauauagagggugcaggccugggauuuagcucccauguagcucaacaaucuuuccuccaggagccacugccaugaggcgcuccaggacugcaaagugacuguuccccaugugacugcagcuuagagaauagcaaaaagguugugauacauuuccaagcugccuaccuuccugaccagcccagggcucccuuugucccuuucauagcaggauaggaauguggcacuccucaggagaaccacagcagagcuugucccagcugcuaggcugucaggcugaugcaggggugcagcagggugcuucaccuugcuccaucugcuaucuuugugacagcccuaugagucaggcagacagguauugcuguguccaucuauaacuuccgcaaccaagcuaaaaaaauguggaaauacugguuccugcuuucaggacuggggucagugccagauucccccaccccuuacacugucugugauaaacggaggauucaugauguaacuggcuggguauucuaaccccucacccaccccuuuccuuucuuccugccuuuuuuuuuuuuuuuuuuguaauacuaggaacauaggcaagcucagagguauggggcuuaaucccaugaugacagccagcuuugacagagauacagacacacaagagcuagaagacaggacaggcaugucucaaaagaauauacacaccuuauacacacacgugcaagaggguggagcgaccaucgcccacuucuaagaagaaagagcuucacuuugcccaccugccuuggacucuauucaaauucgaugggcagaguuccugagagccagacaaacagggaggcccccauuccug

SEQ ID NO: 4922 - RNA, 52474 nt, Mus musculus
auucaaaaaaaaaacaaaucuuuauuagauaauucuuuuguaauauuuuaaugucagcucuuaaaaauccucaaacuacuaauuggaauuaaaugucugacagagacaaaaaagacacccgcucaguuuggggaaauaucacuuuaugccaggagaugacuauuauuauuuuuauuuuuauuuauuuauuuauuuagguuuuucaagacaggguuugucuguguagcucuggcuguccuggaacucacucuguagaccaggcuggccucgaacucagaaauccgccugccucugccucccaagugcugggauuaaaggcaugcgccaacaggcccggcuaaccaggaaaucauuuuuacuucauuuuucuaguaaaaguuuuuuguuuguuuguuuguuuuuuccuuuacguagacauugaacuguugauucuccuugaaucuuuacauguaaaacguaucacaugagccauccuauguaauggguagggacagguaaaauacgcagccuacacguaugauggaggauaguuacagcuuugcugacuagauucucagucacugcacaagacugugcggagauuaucugcuguaaccgucuaagugcauacagcagcagaaccagagugcgagcucugaacugcagccaugcaugcuccucaggcauggcgagcucgugccacuggcuccugcccaagaggacucccugcacagguuaaggcauggcuuuucuauaguuacugucaccagcaacuuugaagguuuauaaagauaacauucacgugcuccuaaauuaaacucugcuugcuguucagaggcuugccaggcaagcagcuggagguacagugcgcucgcucuccacgcguacucacgggaugcagagauggacucuuugguaagcuaaaggacaaaggucuccauucaucguggagcuaucacauccuuaagagcaaauggggcgcucaaaaaucaucuggaaggcuguugggagucaggccgaauccuggccuucucaagauggcccaugagaggacaagagagcucaguccugugucguccucacacaacgcacacuuggcaagcucugggcuggggccuugauggaguuaagauuuugguuccugagaacuuaucuuuucccucugaagagacugaauucaucaguuccaaggccacuaugugcucagucuaugaugcccuugagcuaccaugguaccuugugcaacauggcuugauuagcuuccugggacuucaucccguuguaugguaacuuucugccugugcccuauuuccucacaacacaccauguaagauguacuucuaaagaaaccugccuggcauaaagucagcucugcaagacuuccugagcccagcguuccuauaaucuuuauuuuccgaaccugugcacucccucucagaaaccugucacuaaagaacaacuuguuccaggucccaagacuucauccagcugacacucacaggccugaaaacugucaccaaagaaccaaugucagaucugucuaaacaaaccccagagaacuuugugguacacugauuacacaaugaccuucaaucaacacuauuuccccuuuguacuucccauacugccagguuauacugcaugcugcucacaugguagauuuccacacugccagggacucacuuccccuagcagcuagcagcaucauuuuauacucuagcugagauuuuuuguuuuguuuugcuuuuuauuuuucgagacaguguuucucuguauaggccuggcuguccuggaacucucuuuguagaccaggcuguccuggaacucagaaaucugccugccucugccucccaagugcugggauuaaaggugcgcaccaccgugcccggcuagcugagauuuuuuaauggaggaaaagccucacuaaccuuuccaggagacucucagggacuuuagugaccaaccucacugucacucaccuaggaucaucucacuggcacacagacaaggcaccaccuaaugcuggcuauaccucagugggucagggaguaccaccucccacuagccuccaucucacagagccccucacuucaucuccauucaauccacuucaaguuuaaugugauugagauggaggguggggagaacuacccgaagggaucucacaggaccaggccuugugcugucaauguucccugcugacaacccugugcucacaucaguuacaaagcuuguucuaagcagcucauuagcacugaauuauaguucuaacuuaaaccacuuggugauuggugguaccgucaggugcugggcuucaaaaacuuggcaaguuccagacaggcacuguuuagcccaagcacuggugucuacaacuaugaagaacaucauguugucaugcuagaggguucagauuuuaucagagugacugaacacacuugccuuauaaaauuaagaccagcagaaguuuuuagagugugggacagggaaugagauuauuuaucuuaucucagaagggauaacauuuuuauuuauuuccuuccuaaaacaaguaaaaaaauauaagugugcuguuucggucaguucugggaucauccacucagagauguuuacagcaacugaagccagugugcugcugguggaggagguccggcaccaacaccggcagaagcuguacugcugcaguauggcagccugaacuaaccacaaggucagaugcugcuuugccuaaaaaagcuuuccgguauuuuuaagaaaacagaaaaauucuauuagccuuuucuuccugacaaguauacgagaaagaaaaagagcuugucauuacugacagagccaucaagaaaaugaguccugcccaaugggcacaggaucugaaucucugcuauaacaugaauaaaaaucaaaaccaaaacagccaaaauguucuuaacaaaaaccuucuacuaauuauuuaaauauaagacccuucugguccuaguagacgguccucuagcaagcucugauauccacacuugauaacaagcagggugcugggugccccccacacaggagggccuggcuuucuggagaucuaggagaugguuacagcacaugccacucaagucuguaagcuuucccaucaacugcuagcuguggcacagaggcugacagccucugaucaugaagcagaaaugaacaacggagggguuuucucuaaucaucauuuaagaaugggauuuuagccaaguucuuacaagcagaaaacacaguucugucaggaaguuaauguucucgauauggcagagcagccccagacaauaacaaccagguuaaaggcuaagaagagcugcaaucuccuuaucauugggcuaggaaauggcuuaagggagucaccguucagaaaacgauaaaauauaagcccagacuuaaacaucuucagcugugaagucaguauguggugcuuugauuucuuccugcaucaugcaauuucuaaguuccauuaaaaacauuaucuucgguuucuucuugggcaacuacugcucaugaaagggucaucgucaucauccugaaaugacacaaacguuaugcuaugucagugaccacucaucgucucugagcuaagaaagaaacucuuacaauuaaaaugguauuagcaagucacauuuaucacaucuaucccuuuaacugugaaauauaaaggcccaagucaguucucugugcauuagaguaaaaaucugccaggcaggacuugucugucacugcacauaucuauaacacacaacacauacauuuucccagucacaaacauuaaucaaagcaaaugagguguaggaaagcaaggacagaaacuauccaagacauuucuauccuauucguucaguuuccucauugacauuauuauuauuacuaauacuacuguguacaugugugcccucacaugcagugugugcucugcugggacaacuucauggaguccacuccuccaugcuaccuuugugggccucaggacucccacuugggccaccaggcuugugcagcagucacuucacccacugaguguguaccaauggcuucacuuagacuuaucacucuauccgcccucuuggaaauucagccaacagacaggaaaggcacagugugcagggaacauuucaccaagucaaccugaaaugcuucuacaccagcaucauccaacucuccaaauaugaacgacagaagcuaaauuaaaaaaagauuaaaagccccagcuuugauccauuaaugggagaagugagaguugagugaacagugugcuuugaaaggccuuuauaggcaauugcaccgagggcacucacuuacaggucacagcaaggcuaccagagagccuaaaaauauaacuugcagagccuagccaguggucuccauuuacaucucauagacaguuagguaagaaaaagccagugacaugaugaucaccucaucugauucaaagucuaccccuuuggcugucuggcucugggacauccguuugcuagauguugugcccgaccaccugaggaagaaagaaaaaccaaagacaaugaaugugaacauuacacaagcauucaauuccauaauaaccacugaguacagacaauacauagcucccucuaauauauaauuucguguaucuauguguacucagagauaauauauuacauacacgccauauguaugcauccuaugggcucuguuucugaggaacccuaagagcagcacugucuguuuuucaguuauugaauguuuuuauaguaaauauuuucuaauagaaaaaaagccaaaaccauuuccuaucuaugcuacccccuaugcaccuaaauuuccucaucugucaaauggggaaauguuuguucuuuaaagagcuaugugcuaaucugcuugagcacuaagccauggugugagagcaccaccaagugcuggcucgugcccugcuguaggagcagcucccgccacagcuacagugcugcagugcuuucccuuccaccugcagccgcucaggaguggggggcaagcucggcacucuccagguuucuccugccauauccuguuugcucuuuuucaugagacucacaaucaagagccuaaaucacaacguuuugcacacaguuaugagcuacuuuacucauccuuaauguaguuaguuguauguggucaaccccuuauagcauaauuaagucaccgaaguugcagccuaucagaucuguuauacaccaccagaccuaguagaaugucaaaacugaaaguguuaaaaaacaaaagggggcuauagauuauuucuuuuuaaaacgauuuuuauuuuauguauuugaguguuuugucuacagguauguaugugacaagguaucuacaaugcccagaggccagacagauacuuuuggaacugaaguuacaaauggcugugagguacuaggaaccaaauccuaguuuauccacaggaacaccaaguacacuccacuacugugccaucauccugggacccucaauuauguucuuaaguagaaauugucauuaaguuuaaaguaaacaguauuugcccaaaauguuaauacauaaaagaaaacagugauuuuaaauaaauuuaguaaauacaccaaaguaagccaauuauuacucuagaauagguccagcuugccauauaaguaauccagaguaaguuuacaaaaggaacagaggaaguccagacagccacauauguacuccaaaguucagccacuucuccuauuuaguaaaguacuguguauauacggcagagaauaauguagugaaaaauaaaucugaaauccagaauuaagaaaaacauuuucagccaggcagugguggcacacgccuuuaaucccagcacuugggaggcagaggcaggcagauuucugcguucgaggccagucuagucuacagagugaguuccaggacagccaggacuacacagagaaacccugucucgaaaaaccaaaaagaaaagaaaagcauuuuccaucuugaaggggacuggguaauaaagacaagcggacaugaaucagagacuguuuuucagaggaaauacguccagcaacgcugaaucauaucuguuuuucauuucucuacauaauugcuagaugaaaagaauucuauuuaucuucucuaguauagaacaauguauugccauagaauuccgcauaauuauauuuuuguuuucaaagggugucccuagccuaccuuugaucagcccuggaauugguaggaaaaaugucaucuucgucagagucauccaccucaauggucuacagaagggaagaaacaaagcaacaguucaucuugacagacaaauuaaauaacagaaucucaagacacaugcacauauguguccagcaaaucacauaaacacuugugauuaacacaaauccagaagugcauguggcucagugguagaggaccugccuagcagugaggcccuggguuugaucuucagaccucaaggaagaagguaaaggcagacugacccccacccccacccccaccaaggucccucuccuuuacaaauguuauucuuauccaaggccugucuuuccuggcaguucccaagcuguagccucuaaaauacacaggaggcugagugacucgugcagugcagugcagcgcagcccugccgagguucugcccaggcucugauagggcaacagacugucagugcuuucacuucaaguuuucuuuucuugaguagcacaggcuacuuucaaacuuguaaucuucagguuucugcccacugagugugaaaauuguugaucuguacuaccaaaaucaccuauuaguuccauuuuuaaaagaaaaaaucagcuccaauuuuaacuuauuuaaaagguauuggauuacaugggaagcagcagauagguagauauuugguguuaagagccgacagagauauauauacaauucuaccauguguuuuguauuaucuugacccuugauggguaugugcuauguuuucaccuacuaaacuguuaaugaggaagaagccaaggacaaaauuccaaaagagcaucaugcgaggucacaggcucugcuacacauccugcagugcacaggauauaccuuuaccaagcaggacugcccagcacaggaagaguccugaccugggacuuaagauucauggauuauaacagugagacaguaagucagaacuauccugaauuugcuuguagaaucccaaguggcagaaaggcccauguuaaaucuuuuuuuuuuuuuuuuuuuuuuuuuuuuuuuuuugguuuuucgagacaggguuucucuguauagcccuggcuguccuggaacucacuuuguagaccaggcuggccucgaacuuagaacuccaccugccucugccucccaagugcuggaauuaaaggcgugcgccaccacugcacggcaaaucuuuaacaggacacaaggaucccgagccucuagucuucucagucuuuaguucacagaaguaugaaggaacaccuccacgugaggaacaugccucccaccacacgaggaauauacuuucugaguugggguuuagaagucagggcucuaggucaguacggcugucuuuuaaaaugcuaccagauacauggaacgaaugcacuugaagagaaccagggagcuuuguuguuggcuucaagagucugaauaaccaucaaguuccccccgaugcugauguucacaccacaucccuauuaggaaguccuaacacacaaagcacauuauucaaaucaagucaaaucacuuuacuuaccucugaguaauucuuaggggcuacauuucuagaaggcuguugucggguagaucugaaagcuaguaugaaaaagaugaaaugccuguuacauaguucuuaaaguaacuaaaaaaauguauucacuuccuaagcucaaggauuuuaaaauccuaccugcaaaauccuggaacgaucaauuggaaaaccauuuguauacucuuggagucugaaaggauguaagacuauauacaguugaagcccacagucuggcuagaacucucaugguuucccagcuuguucaaauauaguagcaagcagaauucauacauacacucauauuaaaauauuuauaaaacaggccugaaagauguaguccugucacucagccaaguaaacuacaguagcacuccuagccuucccagaugaccagacauccugggguuuccgcagccaucucuauucucucuguagccacacugggcacaugagaacacaccagaggggaauucugcaaaucauacauccuugacucccugauaaagcuuucuguaaacccucacauuuuugcuuuacagacaccuaagcuuuugcuaaccuugccucuucucugccauuuaauaucaaacugugcaauagauucaaacaccucggcaguguuugcuuucuccuauguaugaucaauugcuagcaucagauguagcuuuuccaagacaaccuccacucuaaacugggcaaagggagacaguuaaauagucagacgccuaacaucccuagucuggagccuucagcaaucuuucuacacagcccaacuuuaucacugcucccauuucccgccucagguuucuguguccgaucuggugaugucugagaggaagaugaaaggcagaagcccaggucucaucugcccucucacucacaggccucacccuacuuucuacaauggagaagaagcaggucacaugaacagaaagccagagagcgccgugcuuucagagaaugcugucggcacuuacucaugauuccuaaauccugagguacuggaaaucaaggaaacuuucuuuugcucccuguggacagccagcaaugaaggagugcuuaugaaagaaggcaacuuuuaucagaagacacuguuuugucaggaaggccccgugccuugguaggucaggggucugcuucuagaacuggacccacucugacuuuuuagcuagcagccacugccaaguugcuuggcuuauucaagucucacuuuccacaccuguaaagcagugccaauauuucacacagaaaacuguugaaaggguaaagaggugcuuaaugcaaauugcuuuggcaagugccuggcaggcagcaggcacucucacacagaaucagcaugaaaacgaauggagugacucagggaaguaaggcacgugggaaggcaguggccacaaggugucuuuucucugcucagucaccauccucugcugaauaacuucaguggaaaaacucuagcugucaacuccuaauuucagcagcuguuggcuacucaagugacaauaaugguguaauuauuguaacucaaaaaauaaaagaaauaauugaaaaaaacaugaaaagauaaaaauagaaaaaggaaaaucucuugaaacguacuauaauaaaaucauuuuguguauucacacuaaaaaaaaaaaaaacucagggcuggugagauggcucaguggguaagagcacccgacugcucuuccgaagguccagaguucaaaucccagcaaccacauggugccucacaaccaucuguaaugagaucugacacccucuucuggagugucugaagacagcuacaguguacuuacauauaguaaaaauaaauaaaucuuuaaaaaaaaaaaaaaaacucaguccacguuuugggaacaaaggaaacuaaugggagugaggaggugacaagaggaugggugggaaaccggcaagugguggcgcaauccuuuaaucccagcacuuggaaggcagaggcaggcggauuucugaguuugaggccagccuggucuacagagugaguuccaggacagccagagaaacccugucucaaacaaacaaacaaacaaacaaacaaacaaaacaaaacaaaaaaaaaggauggguggggacaugucaacccagacagaaguucaagagcacagcagagugucaugacacaccagugcacauaccucuacacagcccaaugaguccuaaacaggauaaccaccaccacgaccaccaccaccaccaccaccaccaccacaaguaagaccacagagaguaagcugagggaaaaagagguuuuacuuuaaggaaagguaacagcugauaccuuccaacaaugaaaacaggaagaguuccuuuaauuaaggugaguauacacacugguaucaaggaauguuucacacaaaaccauuaacccugaaugagaaagggcaggcugggcugaggcacugguuuagccacugagccuaguaucaugcugagcucacuggggcuuuggcagggaagcauacacacuucaacacucuguuuuuguaguccaccauuuccuauuuuuuauaguaauaagcucuugaaggugccuccugaugcaccagacauugggaucuacuuguuuuauccauggaauuacucagcucagcucagcucagucccccacgcacacugcaaagcugccucuccaagccuaagaacuauuucuccagaguguuuuagccugacaucucaauggcugcuacuacagugagugcaguuaccagggaggcgccuucaaccuuccugggauggaaaauauaagcuacagcucuguacucaccgucuauaauggacauguuucuagauguugaugagguggccuuugagcuccugccucgaguagugaucuccagcccagugucugcaagaggaaucacaguggucaggaaccucccucugcacaaugcagaagggagagcucacuaacaaacagugcacagaaagccagcagcacauacaaaacagagucugagcgucagauuucagacuguccuuagucacccugguccucgguuacgcuuuaggacacaagcuguaaguguaaagaugauaaaacaaccacagacugauucuucagagcucuuuuuugauuuguuuguuuuuccgagacaggucucaccauguagcucuagcugcaugggaacuuacuauguagaccaagcucacagaaaucugagugugcacuaccaugccuggcucuucaaagcucuuauaguaagucauucuuuauguuaccagcucagguucccuaggauaaaauauucuuuuuacauuuuuuaaauuuuuauguguaugugugaugaugcaaguuuauggccucacauguaugcaggauccuguagagcagaaacaagcauaggauccccuggaacugaaguuauagacaguugugagcugccauguaggugcugggaauugaacccaggucaucuagaagaacagcuagugcuuuuaaccccagagccauguacccagcccuccauggacaaauauucaaugaagaacaauuccuacugaaagauuuauggacuauacuaggaaaucacuggauggcaaugcucugucaucuggaccauccagaacuacaguaccagugaugacagcagugcugugacagccuuuagaagguaagcuguuuaguguccuuuucacucuuaaacaagcucagagagacuaacauguaaguacuuuaucuccugauaguagcaauauuucucugaucuagaauugugauuugcuagccacuuccuucauucacauuugucaaucauuauuccuccauacaugagagaauauauacaggagaaguauacagugaggcucuuaauuauaacuuaaaaacaacuaaaacccuauggcugcacacagccaguuacaaacuguccaaguucuacuacagguagcuguuacacaucacaaaaauaacaacuguuuuagaaacaaaaccuccuaauucaauucugaccaaaggacacaacuuggcccuucucuuguagcuugcaaguuugcauuguugaaagacaaagaugggugcugaccucggccucucugagagccuccucuaggugccgagcucugcccucuggcuccucuucgcccucggccucggccucggccucugcucggcacugcugacaggcugucaucagagucauuugcugucugcuccgauguaucaaagcucagguccucagcacuaaaggcugagguggaggucucugacugugaucugagggcccgggcucugcucauggccugggcagcagagauggcacaucagcagacagcaucauacccaccucucauucagucauaucaacccacuaacuaacucagugugcuauacagaugugggaggagugucucacacugccuuaccuuaccugugcugccacccgcaggagaccucuuacgagggucuccaagaaaacucggguuuguacucagcacuucuagaaccaaagaagaggcugaagaucacucagcaucccacacaauguuuguaaaagacagucaugagcuucuuuuuuagaaugagcucuuaauuaaaaagagaaagaaaaaaccaugacauuuuagggugcauuuauuuucuuucugauuuuuaaauauggcaauuuccucuaaaauaaauuuuauauccagaaacacauggauaauaaguuguuaucuuguuuuauauauauauaacaauauauauauauauaacaauauauauaacaauauauauauauauauauauauaguuauaaaaagacugagaaaggagcuggagagauggcucagugguaaagagcacugacugcacuuccagagguccagaguuuaauucccagcaaccacaugguggcucacaaccaucuguaaugggaucuaauguccucuucuagugugucuacaguguacuuacauaaaaaaaaaaaaaaaaaagagaaagaaaaagaaaaaaagacugagaaagaaucuuagaacuaagcauaucuacuuucuuuauuuuauaagaaaucauuuacaaaagacaaauuugagauuuagccaaacacuaacucuaaacggauuuuuuuuuuaaauuaaaaauagaaugaaagcaaaugugcccugaccucuucacugagaucugucaaaacauaaaagagagaagaaaccccaaacagguuuuaauaaaacuagaaaacaauuccaccccccacccccaccccuccuccccgcuucugaagaguaaauacaggcaucuggggaaagccgaacaguggggagucacaaugcugaggcacagccccacagcagacauaaggcaaguuauaaagcggucugauagcaggagaccagggacuccucaagcucuaacaggaccacuggcaucaagagagguggggagcacuaaaugagauggguagcaaguaggcaagcuaggaguggaugaggacugaagcuguaggauaugagguacaaaggagguagguuaauucaguuuccaaaaagcuagggaaaaguugaggagauagcucaguagacagagugcuugcuuuggaagcauaaggaugugaguucaagcccagcacccaugugaaaggcacguacagugaucccaacuuauaauuccaacacucgggagcccaaaaaggcaggaucacuaggcucauggccagcaagaugugcugucucggggcgggcaggaguggcuagggagccgguuugauggguaaagcgcuugcuguacaagcaugaggaccugaguguggguccagaacccacacuaaacgucugggugccacucaugcgucuacuaucacggcgcugggaagaggcagacaaucucugcagcaugugagccugcagcuuagucuaaucaguaagcuccagguucagugagagacccugucucaaaaaauaagggagaaagccauagaggaagacaccccacauugaucucuggccccacgugcacaaauaaacacauguaaaguagcagcaucuaagaaaaacauucaagacuguccucugcauacauguccacacacaaacacauacacacauaugcacauaaguagaaaauaaaugaguuguaaugcagguccugaaaacaaccuagagccccaaggaaaaaaacagaugccaccaacagucuaaucauccaagacuauuuugugaaaauugcuuaaaaauacuacucuggagcuggaaagauggcucaagguuaagagcaccagcuguuggugcagaggauuuugguuagauuccuaacacccacaggcagcucacaaccaucuccauuuucaggaaguucaacucccucuucuggucuguuuggauacuaggcaagcauguggcacagacguaaaugcaggcaaaacacccauacacacaaaguuaaaaacaaaacaacauaacaaacagguaaaaaucccaaacaucauccagauaccaagaaagcuuuacaguugagcugagcuaaauuuccaaagaacaagcucacugccauugcaguagugcuguagcccagaacaagcaccacagccagccuaaggcagagacagcacugaacauauacagagaagacaaccauccgguauucaugaauacagcagagccaaggaauaccugcaaggcuggcaugcaggugacaggaucugcagagugauagcaggucagggacccauacauacuaauauaccucacaugaacagaacacaaggacgaggccccacauuuccccucucuagacgccaaaagccuuaacuccccacuaccccuuauuuaagcaacaggcuucaggaauagguggagacuucuacaugacuacauuuuuuuuuuuuccaagacaggauuucucuguguagcccuggcuguccuggaacucacucuguagaccaggcuggccucgaacucagaaauccgccugccucugccucccgagugcugggauuaaaggcgugcgacaccacugcuuuacaugacuaaauuugaggguggauggaaagagaaagaggaggaggaagagagcacacagagaaguaggaguuacccucuagcccacuauaaguugguacgucacaugaaugcuuuacauacauuaaaaaacuguucauagagauagagaauuuagcucaaugguauaacacuugccuagcaagugcaaggaccuggguucaguccucaguucuaggagcaggguguggggaauguucauucacugcucaaaaagagaagcaucaaacacagcaucccuugagauuccuaaagaucaaaccucuaguaucggaagaagcugagggaugauggaaauguguacucagaccccagggaugagaaggcaagcuagcacagcaccucuauagcagcagccauggguaacagcacuuaagcccugucccacugugaugcuuauuuguaaguaauaaaccaccauuuccaaauggucuauuuuuguuugucuaaauaccaucuuuauuuuccuuuucucaaauguuacagucaaacaauguucuaauuuacuauuucugcacaacagcuuuaaguuacuggcuauaggacuuauucuccauccuaaacugaaacucuacccauucucuacucccaagucccugggaaccccaguucuccuccaucccugugacagaauaacacaguaccacauacagaugaaauauuacauuaguccauuggaaucuggcucucucccacucaguguguguucagauuccaugaacacuggagcauguguuagacuguaaugaugugguaacauuucccugcaggaagauaccacauuuugcucauccagugaccugcugugucugacuuggcuacugucagucuuacucuaggagcacuaacagcugaguauucauuugaggcuccaccuccaaucccuuugcuguuuacuuaagccugugcuuucucuuucuaggaguggccauguugcuuuguaccccagggcaucaggucccacuuagaccaggaauuauggagcuccaggcugcacaauaggugccaaucccgacccuuguucugcucuguucacauucucauucucucccugggucucacaguugcuucucuaauguguguggugucaagucucugcauugugaauacuuagaauccuuaagugcugacagagcacuugaaaaccucugaaaagaugacaagccaaggcuuuuguccauuuucaaguugcuguuacuguugaauuuaagaagccauuuuuaaaugccauguggacaccaauccuuguauguaugauuuguaagcccuuccuuccacccugugaaucccuucacucuggguuaggaguggcaucacauuuugaaaggguguaccaaccccgucuaaauucagaaaggaccuaagaauuuguaagcuaggaaaaaaaaaggagcgugucagacuaagaacuaagugcuuagaacuaagugcuaaguguuuauaggaccauaagagaaagcagugcacaggacggagaucauggcagccgacaaacccaaucuuuacuggcuggucuuaguccuagguuuccaagucaacuugugccuaaaaaaauucugaguuuuccccaugugaacaaguagcucuaugguaugcauuuuuuaauuugucuguaaaaauaacuaauguauaguaauaggauucauauucaaggcucagaaauucugacaaagcuguguauuacaucuugagaaaugucaacucuauuacucaaguugaguaggacucugaggcugaaaacccugucagcacccacagcauucuggagcuguuuauugcuaugauuuaauauauuuuccagacuccauaugcuguaaacuuuaugcagaaagccacaccuaucaagaguauggaguggccacugcaugaggaaaggccucaugaguggauuaaucuauucacgagaucaauggacucaaaaguuacacaggcaggcaauggcucuguucugaaagaaagccaggucgcucacuccccaccaagccaugagauuugacaagucagagcccuccaggaagacucuaacuagaugcuggcaccaugcucucuggccuucccagcuucuaguacuaugagcucaaacauuuuucuauccuuuaugaauuacauggucucaggcacuuugauacagcaacagaaaaucgacuaaaaagcccaggaaauccuguuaccugcaaauguuuuaaaaauauagcaaaguuuuaagcuuugaaguuugaacacgaaacguuccauuuccauauaaaauaugcacaauuccuuuuuugcuguuuugguggugauaaggaugcugagaaggcaccugaccccugagccaugcccucagcccagcucuuauccuuuuaaaaagacuaaugagcuuaaugaggagacuccuguggucaaagaccauaccuguccauacucuucuacacuuguacuccuagaaggauacucauaacaaccaugaaaaccauucagacaaagccucgggagucauuaauaugugaaauaaccacaaaacagugacaaugaucaaaacacagaacacacaaccagaaaacaaacgugcacauuucaauguugaggugaccauaaccgucagaaguccggaacgucaguaaacagcuucaaaucuaccucucuugacacuugaagagacucaagaggauuccgacauuuuaacucagaaauaucauguuauuuucaauacugaggauuucucucugaaucugugcucaucacaugugcaaauacauuuuaacaagagcagaaaggagaaaagcagugacagucacacacuuguccccggaggugaccugagcuccaaucagccaauguuagucagaguguucacuucuagacacaacauacccuugggcagucugucuaacuguacccacuggcacacaccaaccuacaaacacaguaugcugcagcugucaauuaccucucgaacuucaucaucuucuucguugguauuucucugucugcuuucucggaaacgucggaccuagaccacaacagagaaagucagacacuguauauucuaccagcagagcaccaucagaaucaggugacagaggacagacucacgggcaacuugaugguuuucaguccaugcaaaucaaagccuaaagugcccauagaacucuccuagaagagcagggcagaaaaugggaguuuugcuugggagaucugugcuucauacucgaggaacaggccauacacugugcaagucugcagcugagaaaggaaggcuuuggaggaacucgugagggagggucaccaccaaagccaugaagcugggugaagcuagaaaguggggaugcagauagaugggucuaaggacuaaacucugggaaguccagcuugagaggauggagagaugaaaguuaccaggaaagggaauacuccaucaaggagggaagaaagcaugcccaaugugugggaguccuuuaagaccuguaagauaaaagugucucgagaaguuuggcagcagucacagcaggucccugacaggagugcuggcaaaaggacucacuggaaaccuugacaagagcaguggaacuguggaucaaaagccaguaugagagccaggcacagugguacacaucuuuaaucccagcacucaggaggcagaagcagcuggaucccauugaguacuaggccaaccuggucuacauagcaaguagugaguagccaagguuacacagagagagagagauccucucucagaaaaaaaaagguugacggaguaaggcauggugcuuuggguaccaaaaaugcuguucacacagaacagcauguggagcaagaagauuacaucagguaggaggcaaacuggaagacacuguuuuaauccuuacaaccguggaggaguauuacuccauuuuacagauaagguacugagagcuuagagaauucaagaaucaacacacagauaaggcuucugauuuugagccucgauagucuagaggccaugcucuuggcuaccaugauacagagacacaaagacagaaacacacacuguguaaagacaaaccaacugccucaacacaucuagagucacagagugaguggcacugaguccauggagcugcucugacugaacagcacugggcaaugaaugauccuauuuacaccuaacacagcaggcuuuaggagggccaugcuaaacacacuaagaugagagguaagggacugcaucuaugaaauaguguuuuguucuauagagaagguaaccucauggaauacagaucuguaaccaagauacuugccaguguguuuggaaccucaaaguaucuauugacacucauucaugauaugaaacuauaaagucacugugugcaucucugcauccuuacaguccgguuugccuguaacguuauacucaacauacuuuuccauggcuuucaaacacauacuuuguguuuauuuaagacaggguuuucuguagcccaggcuggccuggaacucauuauguagugaggaugaccuugacccccauccuccuccgucuaccuucucagcucuggaguuaugggcaugccauugcaccuggccaaaaucacgauaccuaauagcuuauucucacauaauccuuaagagaaguccuuagacuucuagauuagggggcaguguucaaagaagcaaccguuuccuagugucccccacugagcacagcacuggcagcgguuaugcuguguaugaaugucugcuuuacuuacuauuuccucgggacaccccggaggaccaagccuuacuguuguuaggaagcugcuucaguacaccuccaacagugcacugacugccaauuuucuugcguuaaauuugacaaacaaaauccauuuaaagucaaugcccuugguugacugugguuaaauaucaccuuccugagcuuauuagccauguauaguucuugugaacuccuuuuucaugucuuuuguuuauggcucuacugaaauguuuaauauuuucuaaaguuuuccaugagccuuugaauacuacacugaaaauguuagccuuuucuucuguacacguacgcacacuuucuccacaguuaaacccuuuuccuguugacauggcaauguacuccaaugcaaguuuuucucgucccuccuugguaugcaaagggaaagcaugcuuuaggugagaucaaaagcucagucaaaacuaaugaaaaaacugaaagagaagcaauucugcgcuacgagcuucauucugaagccuuccuggaagcucugaaagacgcucucucuaggacagaauccacucagcaccagucacaugucagacucuacuggcuucugccuagacacugccuuauauauucgucauuuuauccccuuaacuuuauagaugaggaaaccaaacaaaucauauacuuaaacagucgugggcccaaaaccaaaccaaaccugaggacaacucuuaaaggcugucagacagcagcucaccuccucaucaaucuugucuuccagagcaucaauauggcgcuccuuaagaaaccgcuguguuuucuccagcugguacuucacuaauuccucgauggcaucuuucucuuccuuguccacaaacucuugaacugcuucgcccaucccucuuucugucagcagcgagagcugaacauucugugaaaaacaacacauuguguuugaugcacaaguccuaucuguuccucauccagugacuaccuaaggaugaaaccacaaucugcuaugggaaaggauaagcugccgggugugggaucagcagacagcauguuaauauuaaaggggccagaagaaaagggaggggagacaaagacagguacagcuagcugcagagaccugaauggcugccaauaccagagaggccaccaaugauugcuagagaugaggauaaaccauuggguuaggcaagaugauggcuguaaagauguccccagcucacucuggaagcucugacuaugcuauauggugaaggaguucaaggccacagaugauauuaaggcuguucaucauccagcuauaaacuacucagguugucacgggcuguccaggcagccccauagaaucacaggguuccagaaagaacaagugacaggcagggggagagaacuuagaaaauggccagggauucaauacugcuggcucugcacauggagacuaagugaagguacauagggagcgcuaguagcuggggaagguuaagaauuacacacucccuuacgauuuccagaaaggaauauggaccugcugauaccuugaucugagcucagaaagaccagugcuaucucugaccuauacaacugccagguaacagauuuguacuuuuaaaaauacauaauggagcuggcgagauggcucagugguuaagagcgccgacugcucuuccgaagguccugaguucaaaucccagcaaccacaugguggcucacaaccauccauaaugagaucugaugcccucuucuggugugucugaagacagcuacaguguacuuacauauaacaaugaauaaaucuuuaaaagaaaaaaauacauaauacaacuagagaaguccaaguagcuucaguaucauaugacuguaucaugaaaguaacuaaguaaaaaaaaaagcuacauucaaacauaagauaagaucaagacuuacagcagcaauagaggaggaacaugacuucuguuaauuguauuaacaauguucacccaauacuuggauacaaacuaccucacacugguuacaucacagaugcgccaaagagucacuuacuugugaauuauacaguccacacuaaaaucugcugugucacccguucuuaagaaaccaugaguuuuguugauggcuagggaaggccccacagacuccugugugugagugccugaaccacacggagcggcacuguuggaggaagggcguuacugugggugggcuuugagguuuccgauguucaagcuccauccagugugaaagacagcccccuucagcugccuguagaccaagagcucuuaguuccucuagcagcaagucugccugcauucuaccauggugauaauggacuaaaccucugaaacuguaagccagccccaauuaaacauuuuccuuuauaagaguugcccuggccauggugucuccucccuccagugaaacccuaagacagugagcucugaagaguuaccuucucugcaguuuggaaauacugcuuuacgaggucuucuacucuaagcguugcuccuucugaagcagguuuugugaugagcaucccaaaguugaucucuucuccuacagaaaggagaccagaaaaaaaccagcagcuucuauaacacauuaaaauagucaaacucucaccaacuccucagugguuccucaugaauuuuaaggaaaaaagaaagcuguauuugcuaauggcccugggguuauuuuagauuugcuucuuuuuccacacaguccacauuaguuuuccucaucuuaaaggaccauggcucuugccacugcuaagauuguccccagagccuuccuuucaggaaguaugagaguuaaaacacacucacaauaacagagcguuccacuauguggccaucugcacuuauaauagaaaaguggugggcagaacuuccaggucccagaacuaaucagggcaguaucgaaaagugcugcugacaucacaccacacaccccaguucaaaauaaaggaagacaguuuuacugacauugccucucucucuuuuuuuuuuuccuuuuuccuuucuguuuuuuuuuguuuguuuguuuuguuuuuuguuuuuuguuuuuuucgagacaggguuucucuguguagcccucgcuguccuggaacucacucuguagaccaggcuggccucaaacucagaaaucugccugccucugacuccuaagugcugggauuaaagguguguaccaccacugcccagccuggcagugccucuuacagacagacuguauuaaguuucaacugugagcaccugucagcauucucugagaacacuaacaggaaauuagauuaauguacuucuggcuaagucccugugccgggcaguuaacaaugcccacugggaaggaggucagcaacaggccccacauuugcucugcugacaccuucaugggcuaauugaauauggugccaugaacagaaugugaaaaggaaaggcuccugaccacgagagagagcacacaauggcagugugaggugcuacagaggacgaggcacacugaggaggcagacuccaaaugcagcccucaaaggccaucaucugaacacagagcgaagaauagagaugauaaaccagaggaaagccauuuuccaugagggcaagccuaggaaaugacuggauggcagagccaccggcuagcucagugugucuugccagguggacgauaccuuuaggagucccaaggcagaggguuuaguacaacuuuacaaaugcaaugccugcucugcaucugccagacacuguuagccauuuaaaacacaauuuugguuucauaaaugaggaauuuuaacaguggagcugauacucauuuauacaauggcacacacauauuaaaguauaagaguggcccaaauaagaaacuuucaguuaaggcacauauaggugacaucauuuccaccaagcaacucaagucuaaauaaaaaaguauuacccaaccaaagucugcuggagauaaaacucaaaccgaguuaagaaguaacugauuaaaacucacagccaaaacaaggcucuugcacauggcuuucugaucucuauccuucaguaucuuguggggaauugcaggcuggucuccaguggagcugaggucugacccugauggucauaauucaccuacaugacgugguaggcguucccucaugcuccuggaacucuggccccugccuaagguaccaccuuccacagcccccacaagagaagcauggucacuagucacauaagcaauggcccaagcuucugaccgucaggcuaaacuccuccccaguuaccuagcaacagugaagaccauaacaaguggugcucagcccccaccacgaccucucacuucucuaucuucuuccuuuucucuuuguccucuccucuccucuuucucucuagccuccccccacccccuuucuaccuucucucuuucucccugcauuucuauaauaaagcucuuaaaccacagagagucucugcuccaucaaggcccacugcacacucuggucaguguuggaaacuucuccccuauucccucucuccugcaacccuggggcuuuagcaagguagcuccgagggggggggaauccccagucgggagcugccccuuucuccacccaccccccaccccuaccccacccccacccccugccgcaugggucaggcaugcucaccuggggccaaguggaaaagcgccuggcagucccccugcauccaccuguccggaguacaagaacucuggccggauguggcauauuuuuccucccccacuuuuccccagggccgcccccuuuauuuuguucccaauaguaucugaaucauggcuucagguuaaauucauagcauucuuaacuuucuacuuuuuuaaauucuauuuuauuuucaucuaauguguaugaauguuugccugaauguguaucuaggcaccauguauaugcagugccuagaggcuagaggaaagcaucagaucuccugaaacuggaguuacagacauugugagccaccaugugauugcugggaaaggaaccuggguccucuggaagagcaggcagugcucuaacgacugagcccccucuccuaaucccaucauucuuaauuucuaccacugcugaaaauucucuuacuagcuauaaagggaagggcacucuauaacaaacauaauggauacuucuuaugaaaaaacauuauuuuaguugcugacuuaaacauaguuaacagggcacuaggagucuguaaaauuuaacuggaaaugaacuauuaaucaucaaaauaccaaacuacagaacauuuuuuacuucaaaagucugaagucuuucuaaagcacuguauacacuaaguuaaaauacuuaauacugcaaaaggugagagcuugcacucugaccguucaucugugguaggaaauaaacacggauagugaaaaccacgugucucaagccaugagcgcugucacucgcagacaacgccuuuccccaagccuacauuaauugucacaacuuuaaaaaaccagaauguagcuggguggaucgguacaugccugcagucccagcacucagcacacuaaggcaagauccagugugaggccagauugggcuacauagcaaaacugccucuaaaagcaaguaaacaagaaaauacccuaaauguucagaagauaaaauauucacuuaccuuuuuuuuuaaucuaacauuacaaauacuaaaaucgucuauuuuguauuuaucuuaccaaagacugguuuauacaaauacugccaguuaaauuccuuaacuuucuaaaauaaccaguuuaccuguuuuucccuuuuguucccugugccugaaaaaguggaugacaucuuuuggguuagcgacucgauccacaaacuucuggcuaaaacgaagaacguugaaagguucaaagccuccacuauaguccaccuggaaagacagaauaaacuauuaaaccaggaaacagugugccaauuuuugagaaauacacauuuuuuuuuuuuuuggccucuauagucugcauguauaauauuuaugucagucuaaaagcucaauauuuuuacauuuccaaacuuauguucuguguguaauaaccgugaugauguuaaacuauuuguccuauuggcagaauaauacucaggugauguuuacauaaacagacuuccuguucaacagaacaaggaaauggcaucucaggauggaacgauagccuaggcacacagcaugguaucagccagaaacaaggugcaucuuuuaagucaguuucucaacuuucaaaauagagggauaaauccuuaacaaaacaugcuccuuacguaacucagcuuauucaccugggucccagggagacagcugcagacuggacaaagacaaugccaggaaaauccagacagugaaaaaugucaugucuguggguucugagcaauggcuacuuacggucguuugaaugagguucccccaucgucugaggcuuagggcgcauggccuucucacagguaggcuuugagaguaaaaagcaucaucuacugcugaccugcacucucuuucaugcuuauggcuaaaaaugugagcccucggcuuccauaccagccacggugccuaucuccugcugccucugauccaccagcagacuuuaacccucugaaaccauuugucuugauugccuuaacuguuguggguggcaucucgcaguaagagcucacuugcccuucccccuugcugcugagcuagcuuauccugcugccaccgucuauuccuucucuuacauuacaacgagcauuuccaggcuuuguccacagacuggggacacaguggcucuccugaucugugcacucaccgaguuuuuggucuguauagugugagacugugacuacucugaccaguaaagcaccaaccuccuggacugagcacuaucaaauucucagccccucagguauaucccaggacuucucaagcgguaaugcgcacacaaaucucuugggaucuugucagaaggcaacagggucaaugugggaccuggaauuccacauuuuaacacuggggaugccaaggcugcuggcuuuaaggccauacuuccugagcacaggacuuacaaaaaaaaaaaaaaaaaaaaaaaaaaaaaauucaagacucacuacuaccaaaugcuguuaaagccagaggcuuagaaugaaaagauggcuaagagacaggaggagcuggagauagcucagaguaacugagggaauucaguggcgaaaccugaagcgaacucaaaauuaccggucaccugcuccaucagaacuugaugacagugacuguaggcucuaucugucuuaggacacggaagauaaacacucagcagggcuggugcagagggagaagcagugggacaaaugaagauacuccacccuguauucugucagagugggaaggaugggcugacucacaggacagugcggcucacaguaaccaaaauaguaaugggcacacguuacauacaagcauuuguacuguggacagaaaggacagcaggagugaaucagcauggcaggagcaccacaggccccaccuacagcaccaggccgcagggagugcugggacagacucacagagacugaauacaugcaauuccucccagcagcuucagcaagaccaaggugcccacaggggagcaagagggcugagcaaggacagauuagaaaugacagaaauaugaauauacuaccaaucaauaaaguucaccugagauuagaccaagcccacagcuuccagcuucccauuuuugccucuucccauugcucuaagcacuuaccuuacuaauuuucaggaaaguauguuaggugugcauuauuauaaagccuaacaaggguugguuaaugcacacagcgcuuacccguagucggauaagaggcuuccccggcugcugaggauuccccagucguucccgcucagcacugucaagcauuucuucaaucucagaauaaaaaugccaaagaauuaaacuucgugcaaacuggcugaaauaguuuauauuccugcaaaguucugcacagacagauccucagccacccuggucuccaucucgcugacugcaucauuuaaagcuuguggcccuaccaaccucgucccuuaacaguuuauuuuacaaacauucugaguaauuuguccaucucaaucauaacuccuucacaagaaagucuacaauauugacucuguuccaauuuccuacucaaguuucaacauggguuacccuccuuaauuuaaaccaauuuucaguggagucacguagacucugcaggaaucuauaggaucuuggauugucuaccuuggaaaagcucaaguaaacaagaugaguguuuccacuauguaccagaucaagcuuauaaaaucucagagauccacaaacaaaagcacuuauccuacacuguuccugagaaagcuaagcuaagggccaagaaggcagauuuuauuuccaacacaucuucccaauggcugcagcuguuugccaaucuagucuuuuccaagugugagauuuuauaaugcugcccugauuugccugccuccaccugccaaguacugggauuacaggaaugcagcaccaugccuguuccucagaaauaauaucuaccuguguaguaucuggggcuacugccuugaagcacauguggacauaggguacuugaaaugugguuagcacaaucaagaaagugaacucugaguguauuacagucgacagccacuggugcuagugacugcacuccuggauggaagagagcuuuaggagaucugcucagucaacucccagucagccagcaugcacauggcacccaugcggcaggcaguagcacaagugcuaaacagaaagguaggaagcugggcaugguggcaccugcacaccuggaacccacauuccaggggcagaaaaaaggcugagcauuugaggccccagugagcuccaagccaauuuagcaacaaagcaagacucuguuucaaaaaccaaaauaaguuuaaaauacaaaaaaacaaaaaaaacaaaaaaaaccaaaacuuaacaaguaaaccuuguccucacaggcaugaagauaacaauauaauuaaggaccauaucaaagagauaucagaaaugaccaaauuacgcacagcuuaaaucacuguugccaauaaccacucuuccugucuggauucuuaugucucuccuaaggguggggcauuccaguaaucuaggcacuugggagguacaggcaggagguucacagcacacucaaguuccaggcuagucagggccucaaaccaaaaaccugucuuaaaaaagagagagagagagaaagagagagagagaagaggaagaggaagagagaaagggaaagggaaagggaaagggaaagggaaagggaaagggaaagggaaagggaaagggaaagggaaagggaaagggaaagggaaagggaaagggaagagaagaccagauuuuagguacaggaacugcagcagagcucaagcagaggugauuucaacccuugaaacauuucacagucuguuguaucgugacuguagagaaagggaugugcuggcuaguuuuuacaucaacuugacacagcuagagucaucugagaggagagaacuucacaugaggaaaugcauucaucagaucugggcuaaaggacauuuucuuaguuacugguagggauggcccagcccacugaggguagugucacccuaggcuagugguccuggguucucuacucacuccgaucugugcggucagucaugcuccuugcaggagggcagcaguugacauugaccaccuaugcccccuuuggcuuggguaccuguuucacaguucccuugaaccagauuuccugcauggcucacagaggugaaguuccugcuaugcugccucugaaagucaaaggccggugcuucuacuuccuuuuggacaaagcuggacacuuucccaacacucaacucuuugauaacacugugggugccuaccggagccugugaaaaauggcuuacccuucucagacgaugcaaaacccuuagggaugaggagacuaccaggacaauaaaaaggugcccagaauucacuaacagccaauaaaucucuuccaaaaggcuugauacaugccuacuuaagccauuuaaaaaaaagaaagaaagaaagaaagaaagaaagaaagaaagaaagaaagaaagaaagaaagaaagaaagaaagaaagcaagcaagcaagcaagcaagcagacuuagcaagucauggaaagcaagccuccucccuggccucugcuccugccugacuugaguuccuguuuuagcuucccaaaaagauugugauugaggacauacaagccaaauaacccuuuccucccuaagcugcuuuugguugcagugcccauuacagcaauaguauacccugacuaauggcaguuaguggcagauccuguaaggcacagaaccccagcugcucccacagcagagaauuaccuggucaaaaugccagcugugccaagccugagaaaccuugggcuggcugcuguagauacaucauacaaagucaacacagggauuuccuaccugccugaacucaggaaauggucaccaauaaaacuauuuagggauauuuggagcuagugggguaacaguuuuuucagcugcaaagacaauauguaccuuggccacagcugacaucuuucugauagugaagaguaacaaggaaaacagagcugguagagacaggccuauagcccuaguaagcuugagucugugacagcagucaccuuggaacaugcacacacuaaagcuuuucaguuacgcaagccaccuguugcuucuucaccugugacaauggccaguuguguaaucuaaggucuaguuugugggggagagaauggauuagaaggcuaaggcacucaaugguagagaaauuguauagcaucuguaaagcccuggauucaauuccuagaaacaauaaggaggaggagagaggaggaaguaacagaggaagauggaaagcaggagguagaaccuuuccauacacaggcgcugcaucuugggacaggcagucaguaugcaggcaucagugaucaccaccaucacccccacuuccuacuuuacaugagaauaagagguaaagucaaagcuggcagaguguggacuaaauaaugccagcaaucauggcuaucaagcugcagccuauaugauaaaaaugugcagcuugacuacagcaggagagccagaaccucugcacaggcugagggguggcagcggucuacaaggucuauaacagaaaaggaggcuaagauucuauuuggaguaguuuuuagggugggaggaauguguaauggaaauuagaaccacagugucuucucaucuccaaagucagcaucugcuuucacaaggaaggugagccauuaucaaacgcagaucaaagugaggagauuggaugugugugcucuuuaaaaguucuggagagauggcucagugguaaagagaaccaacugcucuuccagagguccugaguuuaauucccagcacccacgugguggcucccaaccaucucuaaugggaugugaugcccuuuccuggugugucugaaggcagcuacaguguacucauguacauacaauaagucaaaucuuugaaaaaaaaaauagaagguucuaggagaguuaacugaugacuucucuauauccaucauucuucuauguaagaaaaggcuuugcaguuggacacucagcccuacaaguccaaguauguguuccccucucaggcucggaggacacugagaaagccaaggcagaaggaagagccaggggagagaauggcuguggagccucauccaggcauggcauaaccacuacagucauaaauucacgagguugcauggaucuugcacaagaccaggcaccaauagguuccaaacccaggggcacacagauggcccuguuuuaaacucaaugagucauaaaaugaagacacaaauaugaaaaagacuucauaugggagucaagggaaaagggagagaaggggacauuauauacauguaugaaauugucaaagaacaaauuucuucagaaauaaauaaauaaaagaaagaaagaaaugaaagaugaucucauguccugagcaccagcagugcagcuucgugagcaauaaacagacagcuuccuucuacacugcucagcccuguaaccgaggggcagugaguuuucaaacaaagcagacuccacuguugccuuuggaaacaguuaccuucuccagacagaagcucuggauggccugggucaccuuaggauugucaggguugaacagguuugggugguuagccagaaccacgucuucuaugaagaaccgccgcacggugcggagaggcagcuucugcauguucaucuuucucccuuuaaugcgcagcaagccuacaugucugcacagaagacaagagcucagacaucuagugggcacccucaggaagaugaacaagcauagucaaagcuaucaacaaggcuugggggcacaugccugugauuccuaacacccaggagacugaggcaggaggaugacaaguuagaggcuaguugggacccuguuuguaaauaaaaggcuccaucuuuucuuaguucuuauaaaauauuugcuuauaaaacaauacuguuaaaaauagauguuucugccaauuuaauuuuaauuuuuuaauaguaaaaaauaacauucuuccuaagaauaaagugaacuccuccaucauucccucuaucucuccuaucugaacaaauacaguuucacaaagggacaacccugacuauaguauaauaaagacuaugcagaccaugccagacagagagagccacgcaagcacacagcucguugccaugcucuuuguacuguugguaccauaaccaucagggccugagcagagcugcccguaaaacuuucuaccaaagcccagcucacaaaaugucagcaacuuagacugcauuagaaagcuaggcaugaacaauaugaacuaaccaguaacuccagagcucccugggacuaaaccaccaaucaaagaaaucacauggagggacucuuggcucuagcugcauguguagcagaggauggccuagucagccaucaaugggaggagaggcccuugguccugugaagguucuaugcccaaguguaggggaaugccaaggccaggaagcgggaguguguggguuggggagcagggggagaggcagaggauaggggauuuucggaggggaaacucggaaaggggauaacauuugaaauguaaaauaaagaaaauaucuaauuaaaaaaaauauauauauauauauagaaaagaaagcuaggcauggcagcacacucuuugauccuaguacgugggggcaauuugaaagagaaccaucaguucaaggccagccuaagcuacauggagaccaucuuaaaagccauccccuaacacggacacaaaagaaauuagauaugcuacaacaguacauuuauaaccagaaaaugcucaacuaaguuacuaugggaaucugcuuauauauagauuuuguuaaaauuuguaaaugucuacauaguagcuaaucugaauuuuauuuuuaaauauuagucuugaauuuuccuaaaaggcagcaaaaucaccaacaaccaaacauucucucagucaaaaggcuugagcacaucaguauagccauggccuuacuacccugccaaaacagaagugagucaagucagaccuuuagggucaugacaccuccuaaggaucuugccaacugccauuuaagcuguccaaaucuaaaucuaaucacaccugaguggaaauucuaggagagcgacccuucgagguuacaaaacuuaaggcugaaagaagcaaacucaggaacaucaacucuaggaguguugccagugagacaaggcuaaacugggaagucuuaccacaaauggcuguagcaacagcccuguuaguagacugagaccauggaggcuuacacgacugcucucugugauggucacccuuguguucccugucagagagggagagggaacaagagaaucuaggagcuacaaagcaccuuggcaaugaacugguccaacccuacucucccuuaguaacugagcaagacgauguccagacaagcuaaacagaaaccauucaagaucauggaauuuacagaaaaaccuuuucucccauuuuauugugggaaaaaaaaaaaaaaaaaaaaaaaaaaaaaggaugcacagcaaaguaagaacuuuaguagugagcccauuuuacccgacucccggaugccauggagaaguauuuaugaaauuaucuauucagccaccugcacaccauucccuauuauccuccacuuuauuuuuuggauguauuucaaagugaacuacaggcaucuguacuccucucuuaaagcagcauuuguuuguuuuucauuuguuauuugccuaggaauaaaugaggcaauuaaaaugaaagaaaacaaaccaaccaaccuuuaaaacagagcaacuacaacaaccaaccuucauacacaaagugaccucagggcgggugagauggcucaguggguaaagcucuugcaugcaaaccuguguuugacuccagaacccaagcaaagugaaaggagagucuugauuccacaaagcuguccucaccacagcacaugcacacccucacacacgugucucucucucucacacacacacauacacacacaguaauaaaugaaauuuaauaaaaucuaaacaagcuguccucugcagccaacagcacuagugugggaugcucagacauagcaaggguuucugaaaaacugacuuagaauauuaaaggacucacuucuucacagcuucuccaggggaaagggacgucaccacugagcuuccgggcugagacacauagaagagcugcugcucauuuuugauugggccaauuuuacacucauguucauggccccagauaacgaggucgaugaagucauccaaaaacugcucuggaaugaaguugguguuuccaugcuuacuccuacaccaagauuuaaagcagaacauaaguucagagcagcaagggaacuuccuucucaagcuuacacaaaucuuuuuucuccauuccugucagacacucccgaaggguuggugauuguaucgaauuccaaagcacagccuuacaaacuuucaggauacaaucaagccagaggcaugaugggaagcaggaagccuccgggucugcacuguaaggagacagcagaguuuauacagaguucuguacugugaccaaguagggaaaacaagagcucuguccaccucaaaucuaaauugaaccugauuacauaccccaaaaaggaggaaaaaaugaauuaaaucuaaacuucaugauaaaauaucaaacuacuaaauguuugcagugccuuuaacauguuucauuuauuaauuauaaauaggaauaagauaaccaauuaaauuaagaguuuucagcacacugaaacacaaugacuucaacugaaagcugggcucugaauuaguaggccucuugaggaggggguccauaugaggggacagagugcccugcagggaagggcaagccugggaauucugcauugagaauaagcucugaggagucacaguacagcaagauaugaagcuaaacuccagagcucagggaagguggacaaugagcuaggggagcagcagggcuauguguuucuuauguuguguguaugacucaaacgcaacacaaugccacugugccuucacagagcacacaaucuuuucuggaacaaagggauaaggaugcuggcagccugcugcaagacugcaaaauaaucucucgccacuucagucucucuccuucugcagcaagagccaagcuggucgucauaaagaagcagaaauaaagugcaaagguugaaggacacacaccuaaaugagcaauccuguuuuccagaacuccuacagaugucauaacagcagauguguguaagaaugagaagggagagaaauuaaucugucuguaagaaucacacacacaguggugaaaagggagggaggaauggagcagaacagccuugagacuggcauccugaccagauguggaaggccaggaacugaaauccagacacuggacucuagugagagugugcuccucacagagaugcaggcgaggaggaucaaacgcuucugugcacugcauauaauagacaccaguaacaaaugggacugugaaugcuggucagugucagagcacugccuacuagcauguguaagggccugggucugucugucugucugucucucucucucagggccugggucugucugucugucugucucucucucucucucucacacacacacacacacacacacacaguagaucuggauuaaauuaaaaucagcaggaacuuauggguuguggguuuuuugugcacacacaugcagcugagacauuuacaugcguuacuauacauuaacucuguucacugauauauaagagaucuagcaucaacaagcacaccuagagcucacauauguuaguucuaaguacuaccaauagaagcaaucagaacuuauuggagaagugguugacuccaaggcaaggacaggaaaacacaagccugaacugcagcaucuugugaggucaagaaucuaaggccaugcucaacaaauaaacagagaaacauaaacacacaaauacucucucuccucccuuccucucccuccuuuccaucuccucaaggccuuaaugauauaaccauaaagaggugaauuaaugaggaaggucuggucuuuccuacaaggaaagccaaggacuaauauggaaagaaccaacaaacaguauaagucuuauaccacagugcuaacucacugcuggccauaaacacucggcaggcucaaguuaguccacaaaaguacaaugggaaacaagguauucaagcaucuuccccaaauacuaauuucaaaauagaaaccgggagcugccuggaggagcaagcagcucacccugugaguagacaugagcaccaccaucuucugcagugagaugcacacaucaccacuugcagcagggcuucccaccuuucauuauagaucaaccuuuuggaauaaugaguuuccccuccaccuuucccugugugaugcagucgaggcagaaaaggaagucaguggucagcagugguguagagguucauggaagucauacauaccaaaacacacuggagacagucucagacucauaugucugcuuccugaagacuugcacugaccuagcacuuagccuaagccugcacucaaacgcaucacagucaggcccagaucccuuggugucuucuccaagacuucccagcucuggcucucucuccuaucagcuuccugcaaucacucugagcacuuugccucacuccuucccauguaggggucauaggagacagcaugcuuacucugguuucucuuccucagucaucauggacucuaccaggagaauaaaugaccuacauacuagaaaaagacagcucauccagcuauguuucugaaaaugcauucacauaauacacacacacacacacacacacacagagagagagagagagagagagagagagagagagagguggaggaagugaucauuucaucaaaaaauuggaaauaaauguucacugacaggagaaaaauacaacugcagaucaguaagugaggaccacgucuaagcacugggaaggaugaaauucaguaauguaacaguaaagccuugaggucuauaacauacacacgggcgauuccuacuacaguaaguuccuuauaaggauaacacagucacagugaaggacauggaauggcuaacguuucuuagggacaagagaaacagaugagauggugacauuccaugcugcugcaucaaugucuguacauuuaucuucaugucucacccauuccaggcaaacguucguucacaaguacuaauacuugugaacuagguucagccugaagucacacaaaacggagagccccacuugaauccaucauccuggugauggugaaggagucaggccuuuacuuaaaggccugcgcaaauaggucuugggaaccuaggugcuucacuuaaaaauauucagaguauuuuuaccuguucugaugaaucacaaauaaguuaaaccaugaguucucaucuuccuuuggucucaacauuguuacuuuuuuauucacaaacauccgauagagccuuucaucuggaauggagccuguggagggacacgacacuauuuuaaaacuguuuuccuacaguggguuuagaagguaaauaggguuuuacuccucaauaacacauuucucaaaaguauauuuuccuguucagcuaucuaucugaauucuggaaucaauguauaaaugggaucuauuaucccagguuuauucacaacagcacucaguugaauucaaaacacgcuuuccauuuagcaaucaggauaaugugaaaggagaaauaaaggaacucccugugcuuacagcccacgagagagaugagaugucuaacaucaccccucguccucucaccaugaaugugaaguaaaugugcuuuucaacuaugauauaccaauaacaugcacagaaauaauggauguuuaaaaaggaugagauuuuuaaacuguauuuuaaaguauaauacuauuacauauaccaaguuuacacuuuuuaguaauuuaaugguuuuaaauaauucuuuuuauacuaagagacuugccuuggucuaguagaagauaccaagaaaacaaguaacaaaauaauaaauuggagcuggagacgguuugccacuucacaugcugaccacagaagagaagccaaugacuggauggauagagaugucuggauguacuaugggaacugugagguggagcugggacaggcccugcccagcacaugggcccagagugcugguggggaagccuacaugcuaaagcacuggaagguuggcacaacugaaggcagaggcugagggaagggcaugccgcaauggcaacggcuucccuaaagcagcguauguagagaagcagauuauggaugugagggaaacagcgaccccacuucugccccaacacccacaggcgugagcacugugagggacacagggacaguaggcgucagacggaccuuacugaaggagaaggcagagguaggacugcaagaagucugagaguguggagaacuugcuuuggguuuaggcuggagccgacaccaguuaaggacaccagaacagaacaagaugggauaaucugggagacaaaaaggucaccgaagaggggugggugucccagguaacagccaagacacaguugauaagaaagagagcaagccauuuuucuggagacauagcaaauauugcagacacugaaacugccaauggcuuuuuaaagucugucuccuaucucagauucagacaaaaugaaugggcuguacacauuauuucuagccucaaaaauaccugagauacaaaauacacagaauuuuaaaaauguguucuuuaaaaauaauacuuaguuuuucauucauguacaauaaggucuagcaaaaaaaaaaaaaaaaaaaagcuuucuuuaaucccacucaggaggcagaggacgguggguuugaggccagccugguuuuuacauagugaguucuaggacaacuagagcuacauagugagaccgucucaaagaaaccaaaagacaaacaaacuaaacaaacagaaaacggugaaaagaacacaguguggugcagggaagcaggagguguagguggagaugagggagaugagaggucaaucuugaguaugguucugaggugccagccauguuguuuugaagacugaaucucccauuggccuacaguuuccugacuccacuacauugcugcccagugaaccgcaaggacucuccccucuucaccuccacagugcagagauuacaagcacauaguagcacacccgggauaaagcacauuuccgaaucugcuuuaacaguaagaugucaguuguagaacagggacauaaugugagccacuaaugcaacagcuacauaaacaauuuucuucuggucacauuaaaacugguaaguuacaaaauuaacuuuaacauauauaaccuguuaauaacaggucuucgucugucucugauaucuagugugucacaacucacaacagccagauuucacucuccccacuacaaaggccaguguuaccauacugaauaguaugcucugaccucucacggacuucugugacacaaaaugcaguuccgcuaccuagucugcacuuaucauccauccagcuuuguaaaugugacucuaaauaaaagguccaaaacagugcaaaguuuuuguuugcguguuuuauuuucuacuaaaacugccauuagguuugaagagcuaucaguccuuagaaauacuaagaacauuuuuaccagaaaacuccaccaucuuuuauagaaaucaauaagaaauaaucaaauuuguccaauuucccccccuuuggaagcccuauggguccaaacuaucucuaacacuguauuugccaaccacacacacaauucuccacuggcguggacaaagggaucacaucugaccgaagucaaucaccuaccuaagccguacagagcgaguuuugugcuuccuuucugcagcagaaccggacuaaugucaaccuucuccaccgacauugaccguccaaagugauucacaaacccagcacagcuuaaaacauccagggcacagagggcaucugccugugucaaaguuucaaagagcaugagugugucugcagaaaugaguggucugggugagcagcacacccacaucaaaagcacacccuguacacaagugugucuuacucacagaauguuguguuuucagaacuuggguuuccuugacuuuagaacaccugugcagaccuuaacaggugagaaucccaaggugaaaacccaaaaccaaacaggaucuaaaaccaaaaacuucugagucuaacuuuaagauuuugcagcgcuuuuggcuuaauaauuuuggauaaaggacauucaacuuguaauuacaaaaacagauuaugacagugucuucccaaaacuaaauccagugaugaagacacuaccuucuucuaacuacacaucaccuacagcagccgaaagcacacagcaggugcaaagcuagcaccucaucacuaacaugacacccuggccacuaaaaaauauaaaaaaucagcugugaaacaagacauuguaauauaaaguggugucuuauaagaugguuuguuuguuuguuuguugguguuuugggggguauaugaccauaaacuagacuaaugaccuacaugucaggagaagacacaaacauacuuucuauuaggacugccagucuugcuuccauaucaaacagggaauaaaauaauugaaucuagauuuaaaauacuaaaaaaaaaaaggucacuuuuuacagugagaauccaggagcucaaguaagcuaagaggcacuaugugggcagucacuccacuccuagcaacucacuguuagcaaauuccaaaaagcaaggcuccagcaagcccuguaucaggggcuguaauugcagguccuuaaaggccgaagcagaaucacaagcucaaggccagccugggcgacuuaaugagaucuugucucaaaauaaaaagggaaaccaguagcugucgccuggcaugugucagaccuccucucuuccuucaguacugcaaaaaaaaaaaaaagugcauggcucucucauguaacaauucuuauuccauauuaaaaaacaaacaaaccaacaaagaaauauaaaaucauaaaugaaaagaaauuaauuugaauucauaacucaauuugacugcuaauuacuagaaaaaagguagaugcauuguacugauagcauucaaugucauuuuuaagauuccaacagaauuguaauuacccccgugggaucaucaugguugccguggauacuaaauacuggaauggaaauguugagauugccauccugguaguucacccauggaaaccuuaaaagaaaacagugaaaguuucuguaagggauaaaagcuauuuccucaaaacuuuccuuccaagagguacugcacuagguagcuacaaacauauaucugcagacaaccccagcucagugcuggaaauaaacucaguuaaauuaaaaagcuugaaaaaaucuuaaaguacaugaauuguauaaaacagagacaacuaauaacugacaaguuaauaugcuucucaaauuuucaaccuuuuguauaaggcuucuccuuauaguuuggggcgggggaaaaaggauaugugcagguuggaauccaaccaccaaguuucauaacccaucaccagcuccauugucgcuccauacacaguucaggcccugcccauccuucccuagacaccagguuccucgucucugugacaguggggugagcgauuucuaucuauguauguauuaaaaagcacauuuuuucccuuccuacauacguuagaacacuauggcuuucugccccugcuuaaucuauuuugaaaucuuuccacagagagcuuuuuguauguugcaugaguucuaguguaaauguccuguccagaguuuagguaggucccucccauagccuuccaaguaaggauguaucauucucccaaccucagcagcaggguuuccaucaacccuugaaacaccagugggucugaauucucacuaaacucuaauuagugcgggguggggggugggggggugaggugguagggugucuuuugagaaauaccaaugcccaugccauguuccaagaaacucaccaguuggcauggagacuggcacaaacaccugagagucuuagguaacuaaugugcacugagaugugucugccuauaccagugucuaugagaagaacacuucagucucgauucaccuuacaaaggaggcagcugcucuugguagacauuagugcuauugucauuucuguacacuacguaugcucuucaccuaugcuuuaaaaacuaguggauuuuuaaaucaacuuaaggaagcagucacugggaauccagccuugaugugugcugggcugcaugugcucuuccuuagugaacuaugacuuuuaagguuguuccaggauuccuuugccauaaauauauuuauuuuuaaaaggacaaauauaucauucuuuuuuucuagcuccuggguuuuguagauggcaucucaaauaaauucaaaaccaaaccaaaaacaguuuguaugacuuguggcuagcugguaacugggaaguugauagaccucuaagauugaaaaccuuuguaaaaguacacucuaccgcaaggaaagagauggauguuuuuacaaagccccuauacagagacuuucuuuaauauuuaaucaauuucuuagagaacucucaaugaauaauagcuauucccaccccccaccccccaccaaaaacuaauggccugugaugugaggcuuuuugaaguuccuagucucuucuaccucucugacaauucaugagccacauuuuaaauuacuuauaaucugaucaggcuacuugaucuuugcuaauucagucuucuuucagaauuucccuucuguguuuguccauuuuuccuguacgaccuaaggaaaccagaaggggaaauuaaccagaauacaaugcagagaugaaagugaaguuaguguucauauaaaaaaagagaguuccuagucuuuuaugucuuaaaagaggaccuuagccaaaaugcccaacacuggggaaagggaacuggaagaguccaccuccaguagauagacagggucucaaguagagggacagggcuacuaacccacagucaaaauuccugacccagaaaucucccugucuaaaagaacuucaggggcaaaaauggagaagagacuuauggaaaggagguccaaugacuggcccaacuuggguuccaucucacgggggggacaccaagaccuaacacuauuacugaugcuaugaugugcuuacagaugggcagccuggcauggcuguccuuagagaggcccuaccagcagcugacggagacagaagcagacacuuacacccaaccauuggacugaagucagggaccucuauaguugaauuacaaggauugaagaagcugaaaucgagagcaaccccauaggaagaccagcagucucaauuaacccagaccccagggagcucccagagaguaagccaccaaccaggagcauauaugggccagucagaggccacuggcacaaauauagcagaggucuacuuggucuggccucagugggagaugaugcacuuaauccuugagagccuugaggccccagcuaagggggaggccuagugggagcgaaaacaccuucuuggaggcaacggggagaaggaaugggaugaggaacugugggagggggcacugaagggggacaaugacuagaaugaaaauaaauaaaauaauuuaaauuuacaaaaauauuaaaaguuaaaaacguucagaaaaagcaagggaaagcuauucuuuuaaaaagguaauaaagaauuuccugacauuaagucagguauaggguucagguccagccuggucuacacagugagauccaggucagccaaaaguacauagggagacccugucucaaaaacaaaacaaaacaaaaacaaaaacaaaacgaacuccugaaauugcugagaaacaauccuuggauuaaaaugcaggaugaaagccuggggacacagcucagcagucagugagccuggcaugcgagggcuuggaucaaccccagcaccacuauauaagcaaaugaaaagccaaguguaugcugaaaccuaagcagggaagcagagcccaaccuauaguuaaaggcugaagagcauuuaggagugccucaguccccuacacaauuucuucaggucaaaauaucuuaggaguuuuccugcuaacucaaaucuccauuaucauguaccugcauaauucugucccuuuaaaaacaauggaacugagagacaaugaguaagugaacgacuuagucacgugacuauuaaaugacagagccaggauuugaacugacaccauccagaauccaugcucuuuuggaaguuggggagacaggcucucacuacguaagccacagaccuugaacuuggugcaugcccacacuggccucuaagaggaugagaugucaggcauaaccacauccaggcauccauguagccaauguuccuaagcaccaggcuucccagcaguuaaacugacaacagauucaacagcacuaaaaagaucaagaccacaucacucacauaugccuaaagaaagcuacuucagagaaaacauaggcaggcaugggagugcacacguauaaucauagcucgcaaaggcacugaggaaagagagacugaguccgaggccaacaggaauaauagagaaagaugcugugaaaugagacgggguuagggagguacaaggugacaggaaguuuaacagauagccauggaaacuuugaucuuccucccuccagcaggggugcauggauuuuauuuuuuuguuguuguuuguuuguuuguuuguuugagacaggguuucucuguguuaacagcccuagcuauccuggaacccucucuauaaacuaggcugaacuugaacucacacagauccgacugccucugccuccugagugcugggguuaaaggcuuucaccuccaccccaaccagagguggacuuuaauccucucccauugaguguaggcuggacuuagggacucaccucuaaccaagaacaauggacagaaaaccagcuuugcacuggagaaaccugaagccaucuuagccuaauaccaaggucaagaugacuacaaaugcugaccaguaccagagucaucaaagacaagaaacagaaacauaaugacagcacauaagacuaagaacacauuucacucaaaagcaacaugguguccuuacauguuuacaaagaaaacaaaggcagugggaaaauagaugcuuaauaugcacaaggcccuagguucauccccaacauugaagauuuacuuuaaaaaaaaaaucuuacauauauucuaagaccaagagcaaugauccuagacagaaagaauccuguauuugacucaucaaaacuacaucuggcaacaaccacaaaccauaaauacggcuaaaggcaacugauuagagaaaauauaccugccuacaaaauggcucaguaacuagaauauacagguaacuugcacaauucaugucaaaaaacauaaagaugccaaguuuaaaauagaaaacaacaacaacaacaaaccagaagauacaaaaaagaaugaaagaucuagaaauaaacccaaucccaacauuaguucagaaauacaaauuaaugaaaugauauacagaaaauucaaagaaaugcacuacugcaaaacugcccagaaugaaggcaaaagaacuaguagaugacauguugguuuuaucauaugacauaaucuaaucaccugggaagagucucagugaaggacugccuacaggccuaagcaugucugugggaaauggucuuguuuacaguaacugauaggggaagccacagccuacuguaaggaacaccauucccuaaguuuuaguuuuggacuguaugagacuacaaaaaacuagcugagccaggcagugguggcacaugccuuuaaucccagcacuugggaggcagaggcagguggauuucugaguucaaggucagccuggucuacagagugaguuccagaacagcuaggguuacacagagaaacccugucucgaaaacaaaaacaaaaaaaaaaaaaaaaagaaagagagagagagagagagagaaagaaagaaagcuagcagaacaguaaacauguauguuuucaaucgcucugcucuugauuguggauaaaacuagcugccuaaaguuccuauguuggcuuuccuaaaaugauggacuguaaugugggauuauaagcuaaauaaacccuuuucuuuuaaaguugcuuuguaagggaauuuugccagcagcaacaaagacaucacacccaaaaaaaccaucucucaaauguaaauguacuuacuuacuaaaaccaaaguugacugacugaucacugaugaccucaaacugcacagggcggucacccauacaguacuuccuaagcagcuccaagcagcugugcaggguuuuccucgagggcuuguuuucauggaaaagaucaccaccuaacaaaauaaaauccaccuaaucaacagaaaacaguacuaaaauuaguaaguuuaaggcaaaaauuguuuaaaaucuagacaugauagaaaaaggguugcccagccucauguggucacuaaaccuucuacuuuaacaccagccuuagcaacacagugaagugaggauacuauucaacuuuaaagaggggaaaggguaacccgugguuugaccugaaauguaugacccccuaugguaggcccuuggcucaaucacagcacaaaggaauggagauagaggaaacagagcaaagaugauucguuuuuaauuaucagaagacacugaaacauagaucucgauugcuguacuagucaagggaacuuuaguaaauaacuuuccagguucaaugagagacucucacaaaaguagggcagaaagaaauugaagaagauagccaacacaaaccucuggccucacauguucagaugaacucacauaccaauaugcaauguacacaggaagacuguagacaaggccagccuagucuauagagugagauccagaacagccauggcuacauagaaaaacccugucucaggcagggaaagaaucaagcaacaaaguaauaaaguaagaauagcuggauggcaagagucuacauacaagagaacuuaaaaauuagaauuuagauuccaaaaacaguagaguaaauaaaaaugcuaaagggcaaauauaauaugcacuuggaagauccaauccagugugaggugugcagagaagggaauuaggaaacaaaggguagaaauagacaaaaauaguaacagccaggcucagagggagguguucccaaacccaaagaguuacaaaagaucacacucaggguucuguggaaagaaaacaggccuccuuugacuuuaaauuuuacuccccuaagagaaagaaucgagcuugacagaauauaaagccagcauacucaaucaauuucuaagcuuccuacagcuuccuauauccuuuucaaggugcaaguuacaguuugaauccacugggaaagaccaaagacuugagcuucauuuagauuaaaaugaaauuaauuucuuauugcuuccagaaggauaacaaccuuagaaugaaacugagaacaugucaagccuuagagggcuagaagaaggauauuuaaagguggccauuacaaucaucuugcuucaguggaaucugcggcugugugggaaaccugcuuuacuccuuguagcugucucucacucccaugacacacagagaacagugcuuuguccccuccccacagagguaagugcuuuacaguaggcaggcagagccagcaguuagcuggaacgucagguuugugccaccaacagccagcacccacucuuucauucuaucucauagcagcaacaucacucuggggagaaugcaggcuacuagaagccagugggaguuuuagggcaaagaucaucagcuauuaguggguucuugauacagaacuaaguuuucuuaggcaucacacaagaauacaugucuaaacaacagauuuuacuauccacaggggaacacagauaaucacuaaaaaaacaaauuauauaccaauuuaauaugaggucgggagaagaaaagcaguguaaugucacugagugcuuagagguaugaggggggaaaaaaucucuucaaaaagguaaacuuggcugugcacggugacaggugcuuauaacccaguauuuaagaggcagaggaucagaauuucaagguugucuuuagucacauauaaguuugaagacagcaugagauacggaaucaccucaauaacccccgaucccaccccuuaaaaaauaaacugaaacgagaagucacccugcccaaagucaggugguaaaucagaaagguugaccugcaaggucccagacaagaacccaccagggaccaggcagggcaacaaaugauccugagcccuggaaggaaacggguaauauuguaaaggauccagagcccaggcaggaucaagggcaagguauagccuuguauaugcauuugaaucuagauucaaaggaaggcugcugaggagagucugagcaugaugacaggaucugaagaaaagcaguguaaugucacagagugcuuauagguacaggggaaaauagcucuucaaaaagguaacuacacagcuguucagugucaacaguuggcuuuggcugugacgcugaauacacagaaggcaaaguaugaagcagaaaggccaacagggagccacuagacugcaggacaagugaagcagaggcucuauggguacugguaugagccugagcaagacagugagggcuagagaugcagagggcacuaggggucucgcacauaaacugaagggaaacugcugggaaggcagggcgucuaugucuauucuccugcucucuccugggcucugcagacacucacccaccugcugggacaguccccagugcaaucuccaacucuauucuaguuaaguuagaguucaacaccuucccggacagauucuccuucaguuagauguuuuaaaccaaugccaccaucagguacccaggcucaacacaucugacuuucguucaaauccuaaaaauuaacacacguacacuuucuacuuguuacaccucucauauucauucuuuuccacacccagaacugcagauuuuaaaagcauuaaaauagucuccaacuccugcuacaguaccaggcugcuagacuuucuucugcacugagcacagacugagucuaaugacugcagcucuacacaccaaaacuuucagugcuagcccucuggcuuuuuuuuuuuuuuuuuuuuuuuaauguaguucaagcuagccuggaagucaguauggcaauugaggaugaccuuaaacgcccagcuucuaccuccuugguguugggauuacagguguaccacugcacucaagugucauguacugcuauggagcaaucccagggccuuguaccuggcacgcaagcagucuaccaacagugcuacauucucagcccucuuugagcacacaaauggcccacgggcaagccaaaccagucccuaccauccucgaguguugucuuaucccugugccuucaauucugcuucacacugaccauacauucucugugccaccuaucaguaaaggcugcuucucuuucaacacacguguuaaaugucaccuccuugacugguuucauauaaacaccaaucuccucuaccuccaaagucccaggaaauugugcgggcuuaccacaaaugaccuuguacuugacugcuugggaacugcugucucacauucuggauauauguucuuugaaaacuaacugccaucuuuuuauuucagguagaaguuguaacagguuuguacaucauuaaacacccuguguuucuaauuuugaaaguuacuugucacaacaguuucugcuccaauugugaacacaaagaacucaaaauuuuaaccaggcuuuuaguauauugguauuuagccaagaaaugccgaaugcaugagguuauauaauuaacucuaacuuaauggaaaagagccuguuaccaaggaaguacauuagagcaugcacaaauauaccccaaacucacuucauuuuccagggcaagucuuaagauuucaucaaaugucacaaauguaucauuuccucuaacugcaucuuucuccauaaauccaagaugaauaucaguggcaaccaggauuuuaaaugugucuucaucgucacuguauaaagaagagaacacaauucaaugcaauccauuaaaaagauauucaaacaagcagaagauaagcaauaacaaaacuguaacgcaaaauccuguuuauagccucagcaugaaagucugcaguacucaacagaucguuagcaucacagcuuucuaaucacaaguucaacacagagccacugugagugacacuggaaguguuccgucugcucugaaauuuauaagcuucauauaaccagcuuuauguagucaggucuguucccuagauagcuccacaaaaauccaaaaggcuuuguuugcucucuuguuaaguaucugacuguacacuuuuccaggaaaguuauuuaauagucuuccucugaguguaagaauagauuuuauacuaauauacuaguugcuuacauuccaaucccugauggcgucugccugacucugcuguuuacauaguuuucaacaauaaauguggccaaauaacagaacagaauucuuuaaacccaaacaaagguacuuucagguaaaucagcagcuuaagaauuauuaacacccauuuauacuuagcauuaaguuuaguucuuuauaucucagucccugcagagaaagaggcaagcauggucacuaucucuaaaaaauaaggccagacacagagauaguaacucguucaucacacaaccaguugcagaaacaagacuaaggcaguaaaaguuaggcuauuuucacucguauaguuaguucacuuuuguauauaacuccacagaucagaaacauccacaauuguaugcacgaagcccuggguaacccacaaacuucucagcucccacagcuguacccuuccacucucauucagaccucaaaauuaacuggaaaggaguauuauuagucuaguuaugcaaaugaaaauaaaaccaggcaagccagagaacugcugaucuuccuaacauuaaacagcuaauuuugaccaagaacuugaaaccagaguggaagacaccacucguguucaaggauuuucuucugccaccugacuucuauaguccuuuuauuucuuuccauuuuguucaaauucacuucaacuaggguaacuuacucuaaaggacuauuuauagacucgagacuaagacaaagccagagagcaugagccucccugcauggccauguaauuacugcaacacauucaucuauugcuccaccucauuauuuauuuauuuauugcuaauaagcauaaguaugugcuuuuaauuaugcaugacagacguuuugggggauacucuauccauuauuaaauucuguugcuguuuauauuaaaauaucacuuuucucguaaggucaucacaauuaauaugucaggcuuacaguggaucuguggggcucauuuuuauaguagaguuccucuguaccagguuccucuccaaguguucagguaugucagaaaaaccacucgaauccaaacucuaaaaauaaauaccaaaaugcacauauuauaaagguugcacauauuucacuaacaugagcucaguugcaggguagacuuuuugaacaagcgcuagugauuuugagaaaguccuauguacgucuucaacacuuacuauaauuguuucaugaccuaagaacagaaagccacauccugaagugaaguccuaauugcacuaucacuacuauuucucuacuaucuucuucaugagauugguguguaguaaaccccuggacaggaaaaaugaaacguaacuuucuacgugcauaauuuaagcugcuccgcgcaggacuuugaaucagaggccaccccauacucuuaacacuaacauggguuuuauggggcagcccacauuuaaagacagaauaaauaaccaacacauggucuaaguggaacaccucgcauccccagcucggcgaaggcggcgcugccacuacaggagaccucccacccgcgggacuccgaggcggacuccgaggcggaacgcagagcccgcaucccuccaugcccacccggcccgucuucccuaacggccccacgcacucggggcuuccguucgccccggacccgcacgcuacaagaccguagcaaagccuaaguuacccaacauggacuugucagagucgaccagggaggccacaagccaucucuaccucaggaaaagggggcgggagucuccagaaccacaagaaaaccgcucccagaaaccugaauuaggcgcgggagagcggcauccguacuucucgcgagauccauug

SEQ ID NO: 4923 - RNA, 541 nt, Mus musculus
caucauuuuuuuucucuuauaaaccauuuauuucucccggccggaaggugggcaucgcuaccgguggauaaacacagaacacugcguggagcgaggcucgaagaacagcggugcagguaaguggggccaggacucaagcgaagguggaacuguuccagcccacguuggcagcguucaugucguaauaguugauguagacccgguccgggcugaugugcaggcgaccggacagcaggccacacagcagcuugcuguaguugcgguucugggcaccaccgaucuugccgaugcugugcaggcugcagagggugcagggaucguucgugccgcuaaaagucaugagcugguccgggaccacgugcacugcgauguacugugcgggcuugccgguggccugcgccagcugcugggugagcuccgacagaaaccccucuggcacggaggcguggggaacauugguguucacgauggacauaggcaugguggcgaagagacugcgagcguggaccggaggacgguacaaagcgcggugugacccccu

SEQ ID NO: 4924 - RNA, 2594 nt, Mus musculus
uucucuuauaaaccauuuauuucucccggccggaaggugggcaucgcuaccgguggauaaacacagaacacugcguggagcgaggcucgaagaacagcggugcagguaaguggggccaggacucaagcgaagguggaacuguuccagcccacguuggcagcguucaugucguaauaguugauguagacccgguccgggcugaugugcaggcgaccggacagcaggccacacagcagcuugcuguaguugcgguucugggcaccaccgaucuugccgaugcugugcaggcugcagagggugcagggaucguucgugccgcuaaaagucaugagcugguccgggaccacgugcacugcgauguacugugcgggcuugccgguggccugcgccagcugcugggugagcuccgacagaaaccccucuggcacggaggcguggggaacauugguguucacgauggacauaggcaugguggcgaagagacugcgagcguggaccggaggacgguacaaagcgcggugugacccccuaacaucauuuuuaaaaggcuuuccuggguucuucugaggcgggccugccccagaucaccaugaagcccacuaagguggguauauauuuuauugacuaaggggaagcagaucuccaaaacuggcuuggaugaaucacacuacuguaaugaccagaaggugaauguccaggucucccuaagcagccauuucaccauuagcuuauuggugaggaaggacuuuagagccuagagucacugggagcauccuuucacaaugcauuucacucccaucagauaaugauggaguaucuaucaggugggccacugcaaacgggauauucucuccugcuccucucuacugcuggugggagaauaaaaggauacagccuuucuaacaggaagucuaacaaauuacauaaaccucagaauauuucaucucuguuaccuggaauuaugugucuuagauucuaucccagccucuaauuuggaccaguggaaagcaaaugaaugaaacuggaagguaaauguaugucuccacaugaagucuagaaagauuauauaaaaagauuaccaagcauuauucacugaaaacuacauuauucuauaguaucccacaagauuaaaauacuauccagccauuuaaaagaagauauuaauuccuuuuaaguuuuaaucuuggaauuaaacuuuuugagaaaaacuugauaaggcugaaaauucuuaaggauaauauaauccugacgcgaaacugauaaaauuacauuuccauuuuauagauaagcauuaaaaguacaccaaaauguuaaugguaagauggcggaaacaacaaaaaugugugcaccugacugcaguugccugaggaggacacuagagggugccacaucccgaagcuggaguuaaagcacgugguugcugggaagucaacuuggguucuuggcugcaagugcagccaucucuccagcccugggauuauuuucuuuauguucuuugguuuuucucagaaucuuuuuuuccauaaaugcuguuuauagccaggagaaaggccuuuaauacucagacaacaguagcuuauggagaggguucuaguuuauuccagugcuuccugaagaacacagucuguucugaagaggcuucgcucucagaaagcggaagugaaguuagcucugcugggcuucucuuuuaauagagucuauuaaugucucucauagucuuccauuaaauguuuaguaagagcuggcgcugugcgaggcaccaagccaaguuaugguauaaaaggcaaaggcaggugcccgcccuuaagaaagcugugagagaagucaccuagaaucagcuauugccccauguaacaacugcugaugaagagggccaggcgaauccagccagggcgggguccagggggagagggcagggugacugcagccagggcgggguccagggggagagggcagggugaauccagccagggcgggguccagggggagagggccaggcgaauccagccagggcgggguccagggggagagggcagggugacuccagccagggagggguccagggggagagggcagggugacuccagccagggcgggguccagggggagagggcaaggugacuccagcuaggcagggguccagggggagagggcagggugacuccagccaggcagggguccaggagcuuugcagaagucacuugcuguuuagaauuuuuauuuagcaauuaagcaacuaggugucauauaaauaguaugguuuuuuuucucacauaauuuauauuuuuuauuauucuacccuuaaucaaaaucucuggaaaugucagguggauuuuuggaauagucguaacuagugggccaaaaucugacucacauucugaucuguguguuuacugcaggaugagccuuucuuaacuccagcaugucaucaggcuucccacaccacaguggccguuuucagucccacugucugcaagcaagacucucaaguguaauugcuagaauuugucuuuaucguagcauggaucuuauaaaauagaagucuaugaaaugaaauggaaauggaaaaaaaagauaacuuuuccuuucuggag

SEQ ID NO: 4925 - RNA, 19583 nt, Mus musculus
cgcggaggauuguggggcagcaguggguaguuugcuuccucccggccgccgcgucgggcuugcgggaagcuuguuccagccuuccgugucggugcuguacucugagucuccggcgagucgcccucaggccgccgccagcaugucgggcgugcgagccgugcgcaucagcaucgagucggccugcgagaagcaggugcaggaggugggccuugauggcaccgagacguaccugcagccgcuguccaugucgcagaaccuggcgcgccuggcacagcgcaucgacuucagccagggcucuggcucugaggaggaggaggcggcagggccugacggcgaugcgccggacugggggggcgcgggagccgaccaggacgacgaggagggugaggcuucgcccucguugcugguucuaucccagggucuccccuaggguaaacuguguuuugugguggguggccuugagaaguauugacagcagugggaaggccgacccggucgggacucgggguccuguucaggccaggagaagaggcauucgcuuuuuuuuuuuuuuuuuuuuuuuuuuuuaauaaagaacagcugaaagcuuuugggggugauuuuagguggaaacaggugauacuuaaaaugaccacugaaacuuugaggugaaugaauuacaagaaaacaaaacugaagagggggaguuuggagaagcaaccagacuagacuuuggauucuccuuauuaucaaaaaaaaccaaaauuugaaaccacaguuuucgauuuagugaugugacagaaucgguuuaagugaggauguucguguuuagugugguaauucgccaggcagaggcagucagauuaaugaaaaacaugagcaaauagacaccaucucaauaaauaaagaaaaauuuaaauguaguuuucauaaauuugacagaaaguuaaaacaccugggacugaagagauggcccagcaguuaagaguacugauugcucuuccagagguccugaguugaauuuccagcaaccacauggugguucacaaccaucuguaauggaauccgaugcccccuucuuucuggugugucugaagacagcgucauuguacuuacauccauuaaauaaauaaauaaaucuuuuuuuuuuuuuuuuuuuuuaaaucuuaaacaagcccaacauugucauuauccaguguuggaaaggcaugccagcucaguaguuuuaaaugcaaaauucuaaauguguaucacauuugauccaugaaaucccccacccacagaaagaacuauagagcacagguauguauuaagauccaguacugaugucauuaggaacauuugaccugucuauuaagggacaggcuuaaauggcaugccuccuggcuuccaaauaucuuguggugugugaaagagugacuaguuccuguaugcuggguugagauaugucucaggagggaggagaguuaggccuaagauuaaaagaaaacuuuugacuuucacucccugauccuuuaucaugaacuccuuagagugagcauuuauuaaaaauugauuaaaagaagccgggcacucgggaggcagagagacaggccgauuucugaggucaaggccagccuggucuacaaagugaguuccgggacagccagggcuacacagagaaacaaaaacaaaaacgaaacaaaaaaauugguuaaaagaaagguauagcugagcaguguuggcucaugccuuuaaucccaaaacccugucucaggggugggggggugggguggggggaaggucuauucgugcagccaaugguaaugcugguguuguaggccauuuggggcuuugccuguuguuuuauaguucaggaauguuggaaguucaaguucuaaauguuggaaggaaacagguuauuuuaaaggcuuuuguggggaugggggauauaguuuagugcuuaucugggaugaaugaagcccuagguuuagaaagauucgagugccuacuugagauaugaugacagcuuuggccuguggaaauuagacuggcauuuguuuugccauaagaggagucuuaaguguuaacaguugaagaaagcguaugagaaggaaguaaaggagaggugguuuggaggagagcucauuucuccuuuucacgcuuuuaaaccucuaaaagagccaccuucuguucuguagucaguguaaccaguacacauguguuucugcuuuucuuuucuguuuuucaggguugguaaaauuccaaccuucuuuguggccuugggacucugugaggaacaauuugcgaagugcccuuacagagauguguguucucuaugauguccucaguauugucagggacaaaaaguucaugacucuggaccccgucucucaggaugcucuuccucccaaacagguacaugugccuuuuaacugaacaucuuuucuuuaagucccaggaccaguauuugguuguaugcaucuuguucccuuuuacuuuguugaaaaauuaaauccacaagcuagagcaauggcccagugauuaagaacacauuguuguugcagaugacgauucguaguacccacaucaggcaucuuaaacaugccuguaaguccagcucuaggagaucugacaccccucugaccccuucauaugcucauacacacauguacacauaauaaaguaucauuaguguuaggaaagagcacuucacagaugaggauuaucuuugaaucaggcuccuuauguagauacagaaugaguguggcuucucugcauccagguacuacccaggccugaccaguucauaccucagcuagucggugaggucaggcgagguggugccaauucagaguaaugugguuggggccuuuugugagacuuaacuugugcaaaaccuuuugcuuuguuuuugaaaacacucuacuguuagaaaauuugcacuuguuaagacgugucauuugggaguauagcuacucaauaaaacacaaaacugguggcuguacacacagucugcaucacuucucagcaguuucccucagugaguguaguuaaugcagugcugcgcugacaccagucacagugagguaccuacuuggucuuaggucagugcuaagcuuaguguggaguggugcccuguacaugcuaguuucugugcauaggcugcauccaagcagggcuuuggaauuuaacgugaaguaugggugucacaggaaggcaugcacaggguggucgcugggaugauaaggacagggccccggccuaguuugccccacgugguagauugcugaguucuaguuucugggccacuauggugauuuggcuuaaggugauuuuguaaacucgccaagaaacagguuacuuuguuguuuaaaaaaaguuuugcaagggaaauuuuuuucaaagucugguauuuuacuucaccaccugcucauuuuucuucuacauuuauucaccauguuuuuguguauauauuuguguguguuugcgugugcgcauggaaggauguagaagucagagguuaccuuagguagcuuucuuaguucucucugaauuuuuauaguuuugagucaguuucucuuucugaagguaaagcucacuaguugaccagauugacuggcaagcaagccuccugagcuguccuucccuggggcugggaugccaggcaacaggauucuguacuggguuuuccaugugggugcuggggauggaacucagcaggccucaugcuugcaugguacaccccuugccagcugucaucccucuuccuucguguguguguguucaaucacaacuuuuuuucuaaauaaaacauuaccugcuugaaaaaaauauguaguuuuagauguaucuaaaauacuuuggaacucguuuuuauggaaaacauugcuacauuauuuuugguagaguccacaaacgcugcagcugaucuccaagaagaagucccucgcuggagcagcucagauccuacugaagggggcagaaagacugaccaagucaguggcugagaaccaggaaaacaagcuccagcgagacuucaauucugagcuccugagacuccggcagcacuggaagcugaggaaggugggcgacaagauccugggugaccugagcuacagaagugcagguacagaucgaucgaugucugcccagucuccuagccuccgccaggaucacuucucaucucccuguuggacaaugauauuuaaugucuuuaccuguaagcccaaaccauucuuggcagaacuugguagaacuugguauuacaugccugguguccuaacacuuggaggcugaggcaggagggucaagaguucaaggccaacuuugccuacaugagacccuaucuugaaaaucccgugacagaccagucuuacuguagugugguagcuacauugaagagaaaguugaaaggcagcuuguuuaagguuuggaguacagugggagauggccgagcuguccugcugggaugcuuaagaacaguaauagauauguugaagauuccuugucaggcuguuacuaaaacacaaucuggggucagugucccagcacugauaugagucccacuacaagauaaauuggugcuuucugguuuuagacauuguaacuucuuucccccagauaauuaagggcaagugcuuaauuguucuuuggguugauccuuugagauuauggaagaguuuaguugcacucuuuaauugcaagaagauccugaauguguuuuguuagauaggcauuacacuuaaccauccacuaauguaaccguuccuuagauuucugaccugcauagaggugcugcacaucaaaccagaggagcuggcugaaaaaauaguacugugagcacuguugguuugucuuucugaugccgaauucauuuuaucaaaacucggagagaauaguauguggucuguagaggacaggucagagggaugucuuuaggacaggugcaggugucugucaccaugcucacaaaauguuacguuguuugguuuuauuucuauuucuccuugaccuggaauucccugaccaggcuggucucaaacuguagacucaccugucucuaccucucuucuccuuccuuuucugguuuggccaucucccacuggauucuaaaccguaaauaugcugccuuugaacuuuaucuuaaauguagcuacuacaguaagacuggucugucgggauuuucaagauagggucucauguaagcagaguuggcuuugaacucuugacccucccuccuuggccuccaagugccuuucucuuagcaugcauauuuccaguggaaagaauucauguuuuggugguguggagauaaaguguuauauuugauaauuugugucaaguuaauuugucauguuaauuauuuuaaucuuuaauacccaauuagguucucucuuuccucaucaugguaccuuugaagugauaaagaauacagacauugacuuggauaagaagauaccagaagauuacuguccucuggauguccaaauuccuagugauuuagaggggucugcguauaucaagguacugauucgaguuuuuuaaguuauuucuuggcaauuacccugaagguacuuugcuaacguuuuuucauguugucuagguuucuauucagaaacaggcuccagacauuggugaucuuggcacaguuaaccuuuuuaagagaccuuugcccaaauccaagccagguaugucauggugucugcacuccauucuacacucacauacucauuaagccaaacauaaagagugaggaaaggagaccuuuguugugaaaugcacuuccuauuguuuaauaggaaguuggugguuauugaagaugucuuagcggugagagcuaagggaaggaggauacucagaaagaauauaccccagagcguggauguggguuucucaaaaagcugcuaucacuguuugguuuuuugagacaaucuuugacuuuaaacucauaagccuucugccuccucaugcuggaauuauaggcaugaaaugccauucuugcuucuggaaacaucuuauuaaaaauaaggcacuagugaauagcuauacauuuuuguagguugaaguauacuaggugucucuguguagaagaagauguucaaauccuccaaggcucggaauaucacaggguagaagacagcaagaguauagcgguuggagaggugugcugaagcacuguccucugggcauggcacucaugcacucuggcugugguuaccugcugcagacuuauacuagacugggccccaucauuccauuagggguagugaggggcucgugaggccucacccuuacugagggauugcaggcuguuaaugguuucuaggcaagguggugcagacaggagucccugcaggcauuacagccagcauugaaauuauaaaugagguaagacugaaacacucuucagcuugacauuacuggcucagacuucuagagucugacaccaggcaauuuauuuuaaccauauuuaaguacagcacacuuuuggaaaaaaaaguuuuugauaauuaacucagugucauguguacaacaaagcuuaagucauguuuacauugaaauucuuuacaaaguacauauggcuucuucuauaaagauggguacuguugauucagaaacagugcccaagauuuagggucuagggagcuugacuugggugaacauaaugccuaucuauagguaucaggauuggccugggccuaagauaacacagaagucacuuuuaggcuguugugaagcacaggugacagcucauaaggauauguuuaauauuuaaugcuuaauggacuuaaaagcaguguucaagguugagggggaaagggccugggauaagcaaacagguucuagaguacauggguggagccugccucuguagggagcaaaggaccaccagcuuguaaacugcauccuuuccuagcaguccaggaggaagacggguaagcugcuugcucugaagacauaagcuacauguuuaccuuuuccuggauuucccagugcuuagcauguucagcgcagccacugauuagcugccuaucuuccuauaaauaaccucaugcucaagugagcagccacaaacucugacguagccacgcacgcacgcacgcacgcaggcaggaggguuuggaagaagacuuugaguaggaaaggggaaggguaagagagagacuggggaaggugaccagagacuuuguguuugaacagagguuguagcaguacucucugaagcugugaggaugacaugaggucaugguucgugcagcugugcaugugaucuggcuagcacagcuuuauacacaugccuucugucuuucagguuccccacacuggcagacaaaauuagaagcagcacaaaauguucuucuuuguaaagaaauuuuugcacagcucucccgggaagccguucagauuaagucucagaucccucacauuguggugaaaaaccagaucaucucucagcccuuuccaaguaagagccugcugcacccugcaagugggacuuuaugguguggaugugcuguaggcauguguacaugugcuacaggcugugcugggcauccgggcggccaaugaagcuaaagcuggcucugcugcucacuccucugugagcugagaguggugccuugggcuuucauggcgcauguuaaaaagugugcugcuguggcuucagaaagcagcaagcagugcuuuggcaguagcguuucuuucaaggauacuugccuuuucuaaaugagguaccaauuuaaaaagaaaaauagauguuccuaauuuguagaaaugaacuuuuuguucagaagccaucaagcuuaacauagaaaugaguugucaguggcuguacacuugcuguuuaggguuagacaugaagagcucugccuauguuuuaggagcagggaagagagcccggcaaaacuagguccuaacuucuuguuuauauauaacuagaaaagcuuguuuuuaagauucuguguuuguaaaacccauugagcgcuguccccagucuucuucaguuacagcucaggaucagagccacaguacagucuguggaauauaaccguuguccaagccugugagaauugauuaugugaaggaaaggcgcucauuggaguagagguguucacaugaggccuggugcucuacuucagauucgugagaaugcgcugugcuugucccuugugagcauggucuuagugcccaguucuugacuuaccugcaucuguccugccucucuacacaggcuugcaguuguccauuucucugugccacuccucagaugauaagaagucgcagaagugugccgcagagaagccugggcaagaggaucaccucuacguccuggagcacaaccugcaccugcugaucagagagguaccaaccccagugagguucugcagugugagcacagugugagcacagccgagcggugagcaggccuuccacugagagguaccaaccccagugagguucugcagugugagcacagcugugagcacagugugagcacagcugagcagugagcaggccuuccacugaggcucaggaauggacagcaguggugaccccugccugguuggaaagagccugcugugugccagacauaaucaguacauggucuuugcucgcagaauaucuuguagcacuagggauacacagcaaguucuuuuauuauuauuauuauuauuauuauuauuauuauuucuacacagcaaguucuggaguuaccauggaagcacaugccacuguucagagaggggcagcucugguggagaggccugagcuguccagcaucguguuuugaggcuccauagaaguauaugucccagccucccaucacccccucuccuagcccccaauucccaagauggagucaguugaucgcaaugguauaaaagccaguguuuuagguuuuuuagacugaggauuucccucaggguugaacacuugcuuagcacgggugaggcucucaguucaauccuacuauuauauguuucuugggguucugccaggcagucuaggacaguugauuaacuaucugaccaugagaugagaugagacuuaaugaagaaugcuuuguaauuuaaacuuucaaaguaaaaauuguaguugaaaggagccaaccuccuuauagacuugaaucacgcacauggucacucagugcauuuaucucugcaucaaggagguugugguggugaucuggggacaggaucucacuagcccugacugaccugcaacaccuaugcagaccaggcugguguuugccuccugaguacuaaaacuaaaggcauugcuaucgcaucgggcgagauuacuuuuuacuaauuaccuuaauuauuuccaaaaauaauuuuaaccaagcuuugauuaaacauuucuguuauguuuauuucauggauguugguuauuaaaaguggcuucuuugguuuucuuuuuuuuucuucuuuucuuugucaguuucauaaacagaccuugaguuccauugugaugccacacccagcaagugcucccuuuggccacaagaggaugagacucucagguccucaagcuuuugauaaaaaugaaauuaauucaauacaguccacagaaggacuccuagaaaaaauaauuaaacaggcaaagcauauuuuucuaaggagcagguaaggaugaagaaagucacugcguuucuguaaagccgaaucccuuuucuguccucuuuauguuaguuuuggguacacguuagcagaaaguggcuaagagaaaaauuuuggugacagacugggucuuguccaguugaguaguguggggcggggggguguuggcaggugcagauccugcugucuagcugaauugcucugcuuuuaacacuaccaaggaccaguauagccaggaaaaugacuuuucuccucugugcuuuguguuuuguuugacagcccaucccuccacuccucaccuggacauuaauguaauguuuaauaacauuaaagccuuuauuuucuuucuuacugaugaucugguugaggcuuagauaauuuaguuugcucagcuaaagcuaacaucccaaggcuguguuagcccaaaagugugagucuuuuuuuuuguuuugaguagcccuggccuugaacugggggauaccuuguuucuaccugccuuugcuaauaaaggcgugugcugcugccccacccuugcugccucuuucucaugcagacugaagaguggcaugaugagggcagugcaucuugcugugcuagcaucuguccucaguacugacacuggugaggagguguguuucugcuugguaaucuggccaugaagguucuguagcguugucauuuagcagguagauacugcucguggauaucuuguuuucagugacuucuuaccacuugucaugcugaugcuaucuagaggugucagaauagguuuauuuucucugcugguuaaaauauuaaauagcaggaggacuggagagauggcucagugauuaagaacacugguugcucuuccagaggaccuggguucaauucccaguaccagcaugacaguccacaacuaucuuguaaccccaguuccagagaaucagacauacaugcaggcaaaacaccagcacacauaggauaaguaaauaaauaauuaaaaauaguaaacaucaugaaaguauuaccagaaaucuugagggggucccagcagagccaucuagugugguacauagaaacggggucccuucuuacgauuuaaacaguuuaguagagucuaaaaaggaaaacucagggcaggcaagccauaagucuccuacuuccuggaaggaagaaggaaagagagaaaauagagggaacacagcuguuuagcuugaguuuaggcagugagaugucagggcuuuagcaaaagagcaaagaagcccggaaugcuuguuaggaagcuaaaacuguaccaaggcucuugccagcacccuggagggguagggggaggcagaagaaaaagaaaucguuacaucuccugggucgggccugaaaaagacagguagaccuagcugaaccucaaauuuuguagcagcuccuggggacuacaccagggcgaagaaauucugggaaugcacacuauauuuuaagguaaaccugccuucccaggagugaucugcccuauuugaccuuucagggaagagacaagggccugucuuguagaggcagcuuuacaaugguuuauggcuuacggugcccacaggaauagaaacuuggcuccuucagcuuuuaggaaagugaauuagggagguguuuuagagcacugggaugcaguggaaggaaggaagggagggggagcuagugugggagauggguuugaguuuaguguccacagcccuccaggucuuccugccccacuguggguguaugggauacgauaagucacuugugcaggaguaucuuagaaauacugcaguauuguauugcugaggcuuugcuuuccuuacgggcuccagugauaaacccuguuaaugggaauguauuguuacuuuaaaaguucucguugacuguaaaguuaaauucuuugaaauaugugagaaguauaggauacagaagugucuuuagcauuuagugucuuuaccauuacugauuuuaaacaguaaguaaaucucaaaaauagaaaagcuuuaaaauguaguaaauaccaccccacccacccauuuauagaaauaauggacuugugugugaaauguauagugaggagacacuuuguguguguacugccacaccugaggaucaugaaguuugguuuuugggguuuuuuuuguuguuguuauuguuuuguuuuuuaagucagggucuuucuaauacuccuggcucuccuggaacuugcuauguagaccguuaguuccaggucaagcugggacuacaagggauagauugcuucaaagcaaaauaaauaaacccaaccaaaaaauaaaagccaaugccugccaaacacacagggcucuuagggagaguagauaauaacguucaugacuacaugcacgguuuuagaugcuuuuguguaucgagcauugcaggcuuucuugaugggugauguuuggauuguacccaagucucuaguuugccuuaauuaugauuuauuccagugugaguauguuccaagaccuuuguuacugaagaucacuaauaucugggugcauaucagauuaguaucugggaaguaccuuaccuguguggaauaagcuuucaugagcaggacaagauaaaugaggugguuugaguguguguugugauauaaagcuaugaccagcacagcaaugggugugcaagggcucccagaaccaacucaccucuagaaccuuugccuuucaaauggugauaugguuggaaaguaggcaaaauuagaaaaauuuccaauuuuuguaaaauugauacauaauuuaaauccuuucauccuauaugaugauuuuuaaauuuucuuuuaaagaacugcugcaaccauugacagcuuggcaagucgcauugaggacccccagauccaggcccacuggucaaacaucaaugauguguaugagucuaguguaaaaguuuugaucacaucucaggguuaugaacagaucugcaaguaaguguccccaguaagucccgcagacagcuugcuaaggaguuguguguauccuccaagggauucuguaagccucuggguuugauuuuauuguugugggccaugaguuucuauaaauuauaucaccuauaaccuguuugcaaacacaagcaguaaggggcugagggauggcuaagugguuuaaaguuuucuuccagccgaccguuuccuagcaaccaaaucagguggcucacagcugccuguaacuccagcuccagggaaucuuagauucucuucugaccucuaaaagcaccugcacauacguggcauacaugcaaaaaucuucuaaaagccacauaagaucucguguuuacaguuuuguguuaggcuauauuuacagcuauccuuggccacauggcagccugugggcuucgaaucgagcgugccuaggaucccacauugagcagaaagcacccucacuugcuaagauguucuccaggcuggagucaguuccugccuagaggcugugcaagucuguugugucaggagugaggaccauccaggccuguacccagccuagugugcugagcauagucugaguucauaguucucuccugaccuggugguguccuugauucugauccauuaguugaugauugugccucuaaaccagguugacuauugugugucuguggaaagcagcauugcucuugcucuugucccagcauucuuuuuuuuuuuuuuuugguuuuuugagacaggguuucucuguauagcccuagcuguccuggaacucacucuguagaccaggcuggccucgaacucagaaauccaccugccucugccucccagaugcugggauuacaggcgugugccaccacuuucuggcguuuugucccagcauucuuagucagaugcuugggcaagguauauggcucagaaugcuugcuuggcauuuuauaauacagcugggugugcuaggacacaccacuaaucucagagcuuaggagguggaggcaggaagagcgcacugaggucaaggccagacugggcuuuacaaaacaagaucccgucuuuaaagacugcaguaaaagccaggcauaguggcacaugccuguaaucccagcaucugggaggcagaggcaggcggauuucugagugccagggcuauacagaggaacccugucuugaaaaaccaaaaaaaaagaaaaaagaaaaacaaaaggcaaaaaacaaaccagaaaaauacugcaguaaaaaggcacggcugcaccugugggucugagcguccuagcccugccucuccaggcucugcaagugcuuagaugcuuuauuuacgucagagcaaacuggccaccauggacaaagcacugugacauaaagucccucccuuaugaaggaggagcagaagaagcuguaugcaguacugguuuucagugugcaguuuuagcgaggaaaugaacauaagaucagaugcgggaaguaaaaguaugugcuggacaggaacugagcgugugugauuuacauguauuuccuuaauggagguuggugugcaugcacacauggaggacaguguuggagcuggcucucuccuuccacagugcagguaccugggauugaacucagguucucagggcuauuggaugcaagagcccuuaccuacauuuucaaucagggccaggcccacagaucuugccacuugggagucgggggauacugcugugugcauguccugcuauggcaacuccaagggaagacagucaccugacuagccugcuguggaacaugugcuugguguaaucuaaggaagucugccuuagauuucauuugguggaugcuaagaguccacccucaccuguaacauaaaaguugguuuagguugucacagcuguugcaucuuugugcaugcuguuaacaugguguaaaguuccuugagauuguaccaaguagagugugugucugcagguccauccagcugcaguugaacauugguguggagcagguccguguugugcacagagauggucggguaaucauguugucucaucaggagcaggagcuacaggacuuccuucugucucagguaaguuggacacugugcuuugguuggaguuuuguuuguguuugagauaagucucagugugcucagccuguccuggaacgaauuguguagcccaguaguccuccugcuucugccucggguuacugggauuucaggugugcaccucaggccugacgucccuaguuucauuaacugcguaaggaacagucugagcaagcaggagcuguaaugguuacagaaggagagaccaugguuuuccugccccgucacucacuuccaguacacacuggaaguaacauugguucauaaucugcccugguuuuacuugcacaauuguugggguauagacccucuccaggaaggaggagguauuagcccaaggacagcagggagaagacacaaacuagagaagccaucauccuauauacacccacagccauuauacauagcaaguggguuuuaguuuuuggcuuugaaaggcuugcuccugugaaaggacacugggaaaggcuggcuuguaaucccugucccacagacuuguuuggugacacuggaguacaagaagagcaguagcuugccaccuuaggguugugauuagcuaguaaagcgaugaacuauggcagaaaagggagggguuucugcugauguacauuuuacucacagaaauuaaggaaaaguaugcuacuacuuuccuccaggugcaguucucucucucagaggaccugccucuuugaugccagguaaccaggugcaucugugugggcacagcugacucagcccccaucaguucacacuaaguggguuugguuagcugaaguguacacacagauguguuggagugucuccgagagaauggcaugucuagagaccaaggucugcaaguggacagggaccagagaaucagguaguggugguauugcugcccuggugcugcugccuuuacugcugguggcaaaguugauuccaccagggugagaaugaagaccaagcaggaugcuguuuacuaaguaagggucagcugaccaugugggugugggagacccagcagucauuuagugauagcuugagguccucuggccuugaggguuguaguguagaacaaaccucacacuacagguuuuugucauaagcuccagcuaaccuagccagccucauaggaaccaggaccaggaggauaagaucugaccugcaguguuccguacuacuaugcuggcuacacuggguaguuccauuacccgcagccagugaacauaguaagcugaugugaagucuccccagcagagaguagggugagacugugugugaagggcaaauggaggaugcuuggagcacugcagcuucugguguuacuccucauccauugauccagacaggaaacugcaacaggcaggcuuagagccugagugugcacucaagcuguggguagacauagacagcaccgggcagccacagcuucugcaguggaagguggggucuacccuccucuccaguagucaugucacacagaauuucucaaaccugggccggagguugagaaccccagcaaacuuacaguuccaucagcucaccaaagcgugcccaugauucagucccaucuucucauugacagaugucacagcaccaggugcacgcgguucagcagcuugccaagguuaugggcuggcagguccucagcuucaguaaccaugugggacuugggcccauagagagcauuggcaaugcuucggccaucaccguggccucgccaaguggagacuaugcgauuucagguacugugcacugcucggguaggaggcagcacuuagcauucuccuuuaauauaacuaaaugugcguaggagccauuuaucucuauaaugacuuaacaugcuuacacugcuguuguauguauuuguacauuuguguguauaagcggggaggggcagggagagagggaagagggugugagaacuuaguaagcaaacauucuauuccuauagcuaagaauauugcaaaguucaaaaagccauuuuuuagccaggagugguggugcaugccuuuaauuccagcacucgggaggcagaggcaggcggauuucugaguuuacggccugccuggucuacagagugaguucuaggacagccaggacuacacagcgaaacccggucucgaaagaaaaaaaagaaggaaaaaaaagccuuuuuuuuuuuuuuuuuuuaaauuuuaccugcaucaguuaaaacuuuaucaagaccaaggcuucuuucuuuugcuuauuauuuucuuucugggugagaccaggucauguuuucaguuuagcugccuucaaccuauguaaugcaggauauguucagcaagcagcucagaguguugaacucacuuuguguucggcgcuucaguccugucucagcuucuuaggguuuggcuugcaggcauagccuaccacauuuggcuaccacauuugcaggcauagaccaccacauuuggcgcguguggccuaauuuuuauagagcaaaucguaguuuaaaaauacuuagaucgucuuaaagugugggugugugcaaaacuuuagcauuuggaggucugacaagauguuuuagcaggaaaaagcccuugccaccaagccuaaugaccugaguuugaucccaagccucacaugguuguuagaacuucugucacgcgugacuucuucacgcguucauacacacacacacauggacacaucuaugugcacaaaguaguacauaaacuuaguauuuuggaacuaaagcacugcguugauguuacuaugcagucagaagcagccucgaacuccccccaggugugggguuagggguguggcccucauggccugcucuugaaaugcuuguuuaugaggucaucugagcuauugggcagauuuuccguaacuuuguaaacugcaaagugaauggacugauguugguuuccuccauaguucguaacggaccugagaguggcagcaagauuaugguucaguuuccccguaaccagugcaaagaccuuccgaagagugauguuuuacaagacagcaaguggagucaucuccgaggaccauucaaggagguucaguggaacaagauggaaggccgaaacuucguuuauaaaauggagcugcuuaugucugcccugagccccugucugcugugauuuucuccagaacaaguuccagaaauacugacuguuugcagaucaguuauaagcacaagggagagaugucuuccauauaagucccgagugcagacucaugugcacugcugcuccaaucuuucacgggagcccuguuuaaaaguuacguuuacuuugcagccugaauucucucacuuuauaagugacgaguacuuuggaaugaaaaauguauguacaguuauaguaugcaguauggggagauguaaaauaguacauuuuuuauacagcuaaccugaaaauauuacuaacuuaagggcuugaauuugcuuuuuuuaaaauuccaucuuuaauguuaacauaaacuuuguguuuaaaaaaaucuccccaaguauuuugugaauuucucauaacccauaugagcugucucucaagucagcugcuccugcuguuucuuuaaaaaucacccaagaacaucuuacaacacagauucacugagcaccccaggcccuguuccugaaguucaccaagaucacgcacaguagucuucccuaguaccuggggcucuugggguguuggggaugugaagugccuuuguagcccucuuccucaccugggucuucaugaacaggucaaaggcagagggaaccaaaggacgucccauaacacagucucuguuuucccuguuaguagucacugccuuugcauuccacuugaaauuugacaaguugagauauaaaggagaugugccaagugugacaacucaugccucuaacccuaggacuaaggguugaagaccggaagcucaagaguucaaguucagcuugaucugcaagaguuccaggcuauuuggggcuauguaggaaaaaccuuguuucaaaguuuuuuuuuuuguuuuuuuuuaaaaagcauuguaugaauacucaugcuguggauuauguuugcaagggggaaagaguaaaauuuaauagggacaaacaugaagcaugaagugagggaaugcugagacacaugaggaaaaacagccaggucauguguauaauggaguugagguggagcccagugggagggugcuugccuagcaugcaugagcacccagauucaagcuccagacuuagagggaggaaagggcauugggggugaugguuggaauguguacugugaugugugugugucuagaaagacacugcguucucaaaagugagguuggggagagggaacuugcacugcauuggggacuugcguaucuucacuuuucaaguagcguaguuuuguaauuagagauucuugaaaggcaagagaaaucaugacuccagcugcccuuaaggauuggcagcugagaugguggucacaugcagaaucacauauauugacaauccaccgcucuucucagugaaacuugauguaguugugguaacaguaguuucccaguucauucuagaggugucugaugucaggaaacagcauaauaagccaauucugauacaugacagcuggaggaaugagccuucacugcccugguaccacucuaggcaacugcaucugagacauguuccugaaggucagcugugacgcuuugaauguaauuggcccccauugacccauagggaguggcacuauuagaaggugucaccuugcuggaggaagugaagucacugugggggugggcuuugaggucucauaugcacccauugugguacacaguuucucccugcugccuugcggaucaagacguagaacuucauguccagcaugucugucuauaugcugccauguuaucugccaugaugauaagggacuaaaccucugaaacuauaagccagccccaauuagauguuuugcuuuguaggaguugcucuggucauggugucucuucacagcaauaaaauccuaagacucac

SEQ ID NO: 4926 - RNA, 16873 nt, Mus musculus
aggaucugaacagucuuuucaacagcuucgaccagaauucucuucacaggaaagccaacaugcugaccuacccaguauuuauagcauugaagcaagagguccuucccaacgcauggaaaaccagaacuauucugaaauguuacaaaauaagaaaaaaagucucucucuccagcccucaacagaggauuugacuccagcuugcaguucaucugauacugcucuguuugaucaguuacaccugcagcacagcacuccgugugcuucugucucuagugagugcucaguaaaacuguuagaaagcagagaagaagugcugggauuugaagagcugucaagaagggcaguuacaaugucacaaagacucacugaagaugaaaauguaguucuaccuauaaacccacauguaggaagaguggagaaggaggcuucaguucaggggucuaauccauugaguauucaaaaugaaaagccaauucagaacuucauugaaacugacacuacagaagcuguaggaaauguaugucagcuagcacaagcagagcacauauuaaaauccuguccauuucggagcccuauuccaaucuggguaaguuaauuccucugcauuaaaaacuucuaagcaaauaugaaaagccucacuucagacacucauuuucuaucaaauuuuguucagagguuuaggaggcuguacagagucugcuuauuuccaacuuuagucaacuacaugugguuuucacuacuauugugacuggaagaaugccagcguucacaaauagugguauuugauauugaguuauagugguggcuuuauauuaauaauggcaguaauaagcugggcaguggugucgcacgccuuuaaucccagcacuugggaggcagaggcaggcggauuucugaguucaaggccagccuggucuacaaagugaguuccaggacagccagggcuacacagagaaacccugucuugaaacaaaaacaauaauaacaacaauaguaauaauaauggcaguaauaaaguuaauauccccuaaaauagaugauacaccagcuaaauguaaggagaaaauugucagaucuacugcuguucuugcaugggcuaaauuaccagcuaggaguggguauagaguucauccuguuccugcuccuacuaacgaugcugggaaaagaaggaaugagggagggagaagucaaaaacuuacaguauuuauucguggaaaugcuguauuaggggcuguauuugguauuugguauugaaacaagccaguuuccaaagcccccaaccauuauugguauuacuaugaagagaauuauaccaaaugugugggugguuacaaugacauuauacauuuggucaucacccauuagugggccucacuguccuaauccagcguggauuaggaugcuuagugcuggucccacuauuccugcucgguauugaauaggacauagagaguuccaauaucuuuagaguugguugaguaagcauuagacuguaaaucuaaacacagaaauuaagcccucuuuuuaucaagccuuaagaugauaaucaugaugaauugcaaauuugaaguuguagagaaauuacuaaggcuucucccacccccuuucugauagguaggaguagauggaagccagaaguaggguauuuagcuguuaauuacauuuucguagguuugauuccugccaaucuaguuaaggucuuagcuuaauuaaagugauugauuuacauucaguagauguaggauauagucuuaucagaaguuaaacuuguucguuuucuuggacuucgauauccuaaacuucuacaugauuaguugggaugaaagggggagggcaacuguacuuauaauuuuuagggagggaaaauaaaguuguguuugaaguuuaugugguggguaauuauuuugggguuauuguugguuggaaagaugguaaguaaaauuuaauaaaugagacauauauaaaagaauagauguaacacugcuauugaggcuauuagcguuccuaggaugaggcaguuauuuuguagaaguucugugaugauacuucauuuugggagaaagccuagaagagggggaugccucuccuagggauagcagaauuaaagagguuguuaauagaauuauugguauuuuguuucauaggaaugaaauugaguuaauuguuguggaugaaggcuauaaguggaauaaauauuggaacuguaaggauaauauaaauaauuaaguuaaguuagggugggguuguaaaugaggauggccauuauucauccuguguggguaauuggugaauaugcuauaauuuuucacauuuguguaugcuuaaguccaccucauguuccuaugagaauugcuugguuaguuucugcuaagguggaaauaagucuuauuauagcuauggcucaggcugguguaauaagucauauguguucuuggguggcgaugaguauaggaaaaaugagccgcuuauuaggaggauugaaaguagaauaauggcuauuguuauuucuuacgagauuguuuggacuauaauucgaagggcuccagguagggaguauuuugaguuugaugcucauccagaucaugagaugaaauauacugaaaggcuugauguugcuagaauaaauaaaauuccuagauuuaaauugauuagggguguacuguggguaauugaauucauagacuuagggcuaaugucaaugacaggguuggggcaauaauaaauaaugauacugaggucguuagggggaguaucaguucuuuuaugaaaaguuuauuuuaaagauuuauuuuuuauuuuauguauaugaguacacuguagcuguacagauaguugugagccaucaugugguugcugggaauugaacucaggaccucugcucugcucucucugggccaaagauuuauuuauuguuauauguaaguacauuguagcugucuucagauacuccagaagagggcauccgaucucauuauggaugguugugagccaccauguuguuucugggauuugaaaucaggaccuucagaagagcagucagugcucuuaacugcugagucaucucuccagcccuuaugaaaaguuuuauagcaucugcagaugguuggagaauuccaaaauggcccaacaauguugggaacuuuucguaauuguauauacucuaugauuuuacauucuaaaaguagaauguaaaaauagcaauuagaauggggacuagaaauguuaauacauuaauaaaaugcaucugaacuucugggaacaagcuuuuaagucuuacacaauuuccuggcucugccacccuaauuaccuuguccagguaaauuauugaacauauauaaauuuauuuaagagcauuuauuauaagguagcucuauuucucguauccuuuuuacugggagaaauuguaaauagaaaccgaccugaaaccuccagucugaacucagaucauguaggacuucaaucguugaacaaaugagucauuaauagcuucugcaccauugacaaguccaacauugagguuguaaacccuaauuguugauaugaacucuugaauaggauugugcuguugucccuaggguaacuuggucuguugaucaaaaacacuuuugggucaauaauaaguucauuugaguuguaggucuauguuaaaaucuuucaaaggauuuggcucucagagguuaccccauuccaaaucuuucaaaauuugauugugaaccauuagguugauuuauuaauaauuaaacuaguugacuaauucuccauggggucuucuugucuuauauuauuccagccucuuuacuggaaggucaauuucacucauugaaaauaagagacaauugaacccucauucuagucccuaauuaaggacuaaguaauuauguuaccuuugcacagucaggauacugcagcaguuuaacauuagucacuggguaggcaaugccucuaaugguuauauuucuuuuaaucuuuccuuaaagcaccccuguguuggacuaauagauuuggguuagguaaauuaauuggaggaauaauuaauaccuauggucugauaacuuccaaguuguuaacacaucugugcuagaauuacucauuacucauaucaacaguauuucaucuauaaaauuaauagguuaacagcuaucaaccaaacuuuucaccccuaccuaaaaauuuugcuacauaaauuaucuuuugguuuuacgagacagguuuucucuguguaguccugucuguccuggaacucacucuguagcccaggcuggccucgaacacagaaaucugccugcuucugccucccgagugcugggaucaaaggcgugcgccaccaugcccagcucccuuauaagauuucuaugucagaaguauccagugacuuugauguuagcccacacugugauuauuccaagcacuuuccagcacguuuccccucauaaauuagcuauugaaauuuauaauaaauuugagaagggugauguguacuacauugcuuucccuaacaaaauaccacaguaugguauaggcaaguauuguucugacuucauguggugagggugccaaguagguuagcaggcauauaguuaucaguaucuccuaaguguagaaaggcuacuaauugagauuguaucugcaccugccuaugggauuguuuugagccuaauaagagauucguucuacuagggcagccccaauauauaggauggcugaaagauguaauuauuugucccuauggaagaacauauccuaugaaugcaguggcauuaaugaucagggguaggguagugugaccuaaaucauuuuguagugaacaacaaaaguugagaacaucacugugggcaauauucaugguauggcaauuccuaggucaaauaggaauagcuacuaggaaaaauuuuauugaaaagucugcauucaucucuuuccaaaaucuaauugaaauggaccugcaagcccaccuuuagggggacaccaguaguuaccccaggcuuugcuaaccuagcaucaugcaggacaguucuucucuguuaaucaggaaacggauacuggcuaugguauaauggaagaaccagaucucacucuagugaguaauagugacaucagcaucacugaaacagaucuugcaaacuuaacccuugaagacagagaagacaaugaagcacaguuuuuucagguaaaugccuucaccaaaacugcuaaaacaggcuguucuugggccaaacagccagacuuuaaauuuuaaaaguaauaaaaauaaacaugagacugggaggugggaggaaagcaagaugcuagcaaacucaaaaugacuuucuuggaacuaggcaggugucguucugccuacaucuucaauggaaaccucuguuuguggagcuguaucagagccuuauguggaccaacccacaguggcaccuucagguaaaccccuuaucagcuugagaacauuaucaacucauguugggaugaaagccacgcauaauuuuucucaaauauuauagcuacaucagguaguuuacaagaagcauuuaugacaagacagacacuuacagaacgaucuuaccagaggcagagagagaucuggaauaaaacucgacucccucaaaccaaaguauccaaagagaagcuaccuacagguauguagggcauuuuuucucuauuugguuuuuaugacuaaagggugguguuucccucuuugugagaagggccacuuaaacuacuucacugaaaaugcugucagcaucuaaugagauaucuacuucuauggauuucuguauauugaaccauccagggaugaagccuacuucaucugcauuuguauuguuuggcacaguagagauuacaaagacuuuaagacucauccuugagcuuccugcagggugugaauaaagugacucuuccuaaagagaaaaaaagcugucuucagggcacuaauuauuuugcuaauauuaccagccuaauuccacaaauuucucuuacagguugcacaggcaguuagcuggggugaaacagcaaagagaaugaaagcaagaaaaaggaugaccuuucauucaaaguacaaauugaaauaaaacacuagaaacuccagacccaaaauacauacaaacuauaaaagguucuuuuuacuguauauauuuauuuauuuuuaauuuaagucaaauaaauuauuugagggauuugauuccuuugcuguccauccaggucaccugaaagagaagacaaugagagauguguuaaugaguuaagugauucaggguguguuaaguguauguuaagugauucaggguauguuaucuucucagaaaaacacagcacuaucaaaacagugcaggauuuucucugugaagaacaucaaucuuuggucacagcguuaagagcuguggguuuuauagcccaaaaagcccucuuugaaaugaccuucauuguauguauaugggagccccuuccauauacauaccuuccucaaaugucccagucagccagccauccaccccauccagccaucaccauguucccaacagcauaugaagaaccucaugggaauuugucuauggucauguccacagcaaaugagaaacugcauucuagaagccuugguaaugaccauuauaaaaaugacccuuacuugccuuucuuaucugucuuugacagcuucuaaggguuugugugugugguuuuuguuuuguuuuuaauuuugagacaggguuucucuguguaguccuggcuguccuggaacucacucuguagaccaggcuggccucgaacucagaaacccgccugccucugccuccugagugcugggauuaaaggcgugcgccaccacugcccggcaacuuauaaggguuuuuguguuuguuuaaugagacagcguuucucuguguaguccuggcuguccuggaacucacucuguagaccaggcuggccucgaacucagaaacccgccugccucugccuccugagugcugggauuaaaggcgugcgccaccacugcccggcaacuuauaaggguuuuguguuuguuuaaugagacagcguuucucuguguaguccuggcuguccuggaacucacucuguagaccaggcuggccucgaacucagaaacccgccugccucugccuccugagugcugggauuaaaggcgugcgccaccacugcccggcaacuuauaaggguuuuuguguuuguuuaaugagacagcguuucucuguauaguucuggcuguccuggaacucacucuguagaccaggcuggccucgaacucagaaauccgccugccucugccuggcuacuucuaaguuauuaacaagggaggaaauuuguuucaaagaauuauagagguugauuuugagugcuaaauaaaacuagggggaaaugaaugucgcacaugauacccuaauaacuacaguacuguaacuucauacccagaugggcuaugugaagcuagacuaucuugcucaccuaugagucaccaagucugcauacguggaccuauccaauauagauguucagaaaggcuacuuucauucagcccauucagagcaguugaacauuuuugcccaucaucacaacaucauuuaugguaguguuuuucaaaccuggcagugaauuucagaauuaccucaucucacaugugguuucagaguuaacaucuuaccagaagauuugaggauuucuucaauuuauuuuaaggacccuucauguuaucuuuaaaccuacaaaauugaucauaagaaauuauuauaaaaugaauuaacauacuugaguguaacagacaaauguuacaggucucauugucaccacuguaauguaucugcugugauggaagcaugaccuguaucucaauuuagccacaucgaccaguucuggacaaugaccaacaaugcccauucuuauguacaaugaggcucauauaugaugcaucuaguaaguaaagacagcaagaaaaagaaaaauaaugccuuaccauuuuaggguaggguucacucgugucacccuaggaagaagagaaagcuuuaagaccagguaguuuaagacccccacauugagaucaaacuugcaaguuguucugcccuccccgacacaccuacauacaaaaauuuauguacauaugaaaaacuguaucauuagaaauaccagguuuaacaugcacaaagccaagaaaccaacgaugccagauagugaguuucuauagcacugucuuuugaacacccaacaggaaagaacugcugagugcagauaccaugcagugcaaaauccuaagcccuuuacuggguagacuuucagcuauugaguuuaugcaugagaguuccaucucagcuaaaauucccccaaugggaaaauugcucaaaaaggauuaauguucuuuuggguacauguacauacacacacacugauaauagauuaccuucccugagcacuccaaauacuauucacugaaggcuucucacuaaaaucagagcuuccagauuuagccaucauacgugccuggcugcuaggguuuugaacuuauauuuacugugccagcuacccagccaagaauuugaucuugagacaaaguuuccauuucucagauuguacuugaaacuucucaccucagacucucaacucauagaauuuuaggugugggacuaguacaugguguaucuuuuuaucccuacugaaugaacauuucuaguuauucugauuuggcauuugagugauguacuuguacuagccuagcaaagugaggacgacuuucuagguuguacacauagcaaauguuuuucugagaacuuacaugcgaccuggagaucuacaauucuuuauacaaaaaacaaaacuaguuacuuaccaaacaucucuuuagggucuucucauauccauuccuagagaacaacacaugacuuuuaaaaaggcugucauuucaguuauaaaaacugccaagguuacuaugauuaccagcugcagccaguucugucagaguuaauguuaguucauguuuggcucauucagcaguugaacaguugaauucaucaucugaacuggaacuaucuuuucccaaaauuagugucacuaaaacuuaccucacacucacaacucuaaucuuuaugaaggaagugccagugccuaaaguuaaaaacaaacaaacaaaacaaaauuaacacaucaguuuuauacuuuguuagcugucuuguaguuccuucccacagaccuaacagucaguccugugagucaaguaaaaccacaaguuacuguaugaggcguuuccaacgacgucuggcuacuagggaagccccgucgggauagaccucaaaagcaaucauuucaacaacugugaagcucuccagccaucuuuuauauggacaucuaugaauaggaaaucacauuguaaucucagaauuuugccuagcuuaaacucaagguugcauucuuacagugcugaacucucaagcucacuuuuacugcuuuuacuguagugauuuuuuuuaacccagcaacaugguugugcuggcuggaauuagacacgcacauaccuuuaauccuaaacaaugaagaaagauaaagcacccaugaaagugaugucuaauugaguagcagacaaagugaaaaagauuuaacagaauaagauaugcccaaaugucagaagagaagcaacguaagagggcaagaggcaauuuuuacuaggagaacuuuacaaagacagguuaagagagaucaagcuagacacaggugaauacagaaugagccaagagugaagagcccagaucagaacagauugcaagguaguuugaggcagaagucagaaugaaucagucagcuugaaggaaugagccagaacaccugagguaaaccagacaauaucaagggugagcuuuuucagcaaagucuccaaggcugaaaacauucuaaaccuacaucagauuguaagcuuccaaggauaggccuucuuuagcagaugggcaguaaggcucagagacaauuacaucaggcagauagauaaaacuaaauaaaguggcagucugauucuuaguuaacucacuuuucaaacacuguauuugugauguaccaugcuugagaaguuuauaauauuguaaauugaguauaagaccuuaaagccuuauuuuuguguucuucugcuaaacauaccuauuucaguucaaauuauugauucuaauguucuaggauuuacugagggguuggagcacucuaaaacuuucauagaauuagcaucacugaaaguuaacauaacuccgaagauguaaauuuacaugcuacuuacaacacugaaacaaacauccauucauggguaucuuccaauucugacuucauaaucaagacaagccuuuaaaaaaaaaggaauauccaucuacuccauuaccuuuauaagguaaacuauauaugauauugcuagaaccaaguucaucaauaacaccuuugugcuuauauuccuucuuguauauaucaaaacucauacugagcaaugaguucuggguugcaagaggauuuauauuuuugcaccuguucaacuggccauuguccaacagcugacaaaaacacaagugcuaucaaagcuguccauaucugacacagccaguuuuacaauugugaccacaauaggacaguaggaacagugguaauauucaaaccccccuuggggaagauaagcacuuguuugacuuaagacuugcagacagaaccuggguguggguucgaagagaaagcucagauaauaacuuuuuuuuuauuucucugaauaguucuggcuguccuugaacucagaaauccaccugccucugacacccaagugcugggaucaaaggcaugcgccaccacugcccaucuaugaauaggaaaggaaaucauauucauaaccaacaauggcuggcuaauuaccaucuuguaacuuuagaucuccaggcacagauaccuucugaucuuggguacugcacacauaugcauguaggcaaaacacacaaauaugaaauaauuugggcuaagcacuuaagaggcuggguuuuaucauuaguuuauuuuuucuaguauaagaguccaggaguuuaauccaauuuucaaaucaucucuuccuccucauagucauaguggcugcgacagaccacagagguggugaaccuccagauacucuaacucuccuuucuucaugaccuugcucugcagaugagcaaaagggcgaggcuggggucuugaaucuagacauguauaggauuguuagcauuuuccuuccagaaucacaaucauguuuacuauaguaguaaaauaauccuuauaguauuucuuacucugaaaucaagcaacgaaaaaagcuuuacuaaguauuuauuagcguuccaccagcaaguuuaucuucuuccccagauuaguucuugaucuacuuggcauacacuguuaucuauguucuuuaccuucuucaauagucacauguucauuuccuuucaagguucuucugugcccuuucucucuguguguggcaucuuuggcuuuuuuagaaaauguagauucuuucuuaaucuucucuuguuccaaguuucucuuccuugagaauucugaacuuauuaugaagcaacugucuuccugcauuuaauagaaaaaaaaaaaaacaaaaaaacuaguaacuaaacucacugaugggugagugcaaauauauuccuuacuauaccagcacuauuuucucauuugacagcacaccagauuagcuaaaaguucuuuauuauuuuaucagaagcuagaucagugguuaaaaauacuggcuuuucagggcuagaaagaugccucagcaguuaaacaccaauggcuguucuuucagggguacugcauuaaauuucagcaaccauaugguaaaugugaccuggugcccucuuccauuaaucagguauacaugcugguaaagcacucacacaguuaaguagaaaacaguauagaauaaacagcacaaaauaagccacaacauuggcuucuucucuuuuuuuuuuaaaguuuuaacaauuaacauuuacauauuaaauugaauguuuuuuauuuguuuuuuuuaaagauuuauuuauuauuauauguaaguacacuguagcugucuucagacacaccagaagagggagucagaucuuguuacggaugguugugagccaccaugugguugcugggauuugaacucuggaccuacggaagagcagucgggugcucuuacccacugagccaucucaccagcccacuggcuucuucucuuaauuaagacuaagauucaauuccuugcaccuaccaguuccaggcaccaggcauacaccugguauacuuacaugcaaacaaaacauaauacugaguuuaaaaaaaaaaaucuuaagacuggagccaggcagagauacacauuuuguaagccaauagcaggagcaaagaccaugcugguagguuaauccacugguuugaggucucaagaggccagucuaaccucuggccucaauauccuacaaauauucaaagcuagcguuauaacucagcaguaugauaccuuggcauaaauauaaauguggacaaggcuucagaccccaacacuugggacuaagaggaagagucacaaaaaaaaaaaaaaauccuugguuaucaaauagccuaaauaguaguuccacucuuaaacaaaaauucaauaguauacaacuuguacauucuguaaaugaaacaauaaaaaucagccacuuacaaccaacuugauaucacauucagccugaggauuuguugcuucaucuucaguucuguaacauuaaauggaaugugucacaaaucuuaccuaguauucugauaccauugaaaccuauagucaaagaaaaauaauccucccaaagcugauguccugugcacauuaccucagauuaaacaaucuuaaauggacuagaaguuacgauuacuacugaagaauuuuauaggaucuucauuuuauagauggcacacccaccccagcacuugagaggcagguaaaugaguucaacccuagccaaagcuguacaguagugagacugucuuuaaauuagcuuaaauaugacaaaccccauaaauugcccuucaagauccaacuuacaauggcucuucaauaggagaaagugaaccaucaucauccauguauuugugccuccgacugucaaggucuuccuuuucuaaaucuuccccagcaugcauuugcuucaagcauuccuuaaggugguguucauacuugaguuuuucaauguggugaaaaaauccucuugcaacagcuugcugcaaguuagaacacacaauuccuuaaauauuaaaacaucauauacuaauuauaaucaaguuugaaacuguaccaagaggcuaaauaaacaauggcuugccguucaucaaaaggaccagaugugagagcacagaaaccacguaaauguuaugugcaugaugguucuacuguaauuccagacuuggguaguaaagacaauaagaacaaggugaauaggaagacaacccaaacuggcaagcucugccaugucugcacgugcauacacaaauaaauacaaaguagacauuaaucacugauuacauuuuccgaccacuugcaaccauucaacaguuaauacucaaacauuugagaaaccuaaguaguaucuggguacuuggguuuuucucucuagcccuugacuaguuaacuuuuaacugucaauuuggcauagcucugaauuacccuagaagggauccucaacagaggaucuuuguaugauugccuagauuguggguggguguuaccauucugagcaagagguccuaggcuaacaaugcccaggaccagcagcuuccuucaugguccuauucuccagcccuuccugggacuucuaaaagugggccuuaaaugguaccauaccuucucucucgccuguacucaaaggauugacuacugcugaaagcaagcuggguguggugugcuucagaauagucuagagauaauauaagggaccucaagggacccagcuggaguacaacuccauaaaucugugugcacacugauaaauaugcuugugcacauuucucuagugaugcaagagaugaaaauuggagcacuuuauauggaugucacuauuguuaaaaguaacaaucuguuucaggugucccucaaacaauuaagaauggccaacaaaccauucaaucuuaccuaauguauucaccuacauuuaaaaaaaaaacucaccucauauguuaaaauuuucuuccaagguaaagguuuucuuccacucucagauucuaagaauggaaacacagcuccuuugucuuuaauuuguuuugcaucuauuugcgaccuucuagugauccucguucccgaugguuuuccucuuggucuuccucuuggucuuaauuuuggcucauauuuucucuuuuuccucuuuuuccguuucuuuuuuuuaaaucuuucaaaaauagccuuuaaagucagaggccuugguucuauagaagagucacuugaugaaucuguuucaacacuugcagguaaaguaacacguuucacaguagggugucuuugcuuuuguauaggugaaggagcacacugaguuuuaaauaagcugccaucagaggagucaucacuaaaacaaaaaugaaacugcaucaguuaucauuagcuauaauccuccccgaguuucaaggccaugcucccaaucaugcauuccuucaguucacagcuccaacagccuuuacugcccuuagaacaccagacaaaagcaugacaaaccuaaaaaccauguuaaaauuucaaagugcauuucuucaaagaucaacccccuaaaaucauacccagcauuuuagaauagauucaguaccaguuaaccacuaguacuuacuauuauaucuaaaacaagacaguugguuaaaauguucaguuuuaacuuucaaaagcaccacuuaaucacuaaagcuuccacuaucuaccuacuaaacaaaaaugggccaauaaaaccagaacuagccccccaaauguaguuuucuuggaaaaaauaaacuauguuccauuccuacauguucagguugguagaauuauacaguuuuaaucaaacugucaagcuaauauaaaugcuaauugagguucucucuaucuauuuuaaguacaagcauuacaaauaacuugcuggagugcagggugugguaacaugccuuuaaucccaacucuugagagguagaugggcaggauuaccugggugagggcagccauggcucuaucuacugagaugucucaaaaauaaauugaacauuuggacugaaucucuaguuuacccacaaaagcuaccuuaccuuuggucuccaguaucuccagcucuauccgaugccacacagacagaauucacuucugauugagccaucacuuuucgcggccuuucccaauuuucugcaaucacagauuucaaugauguaccagcagucuaaguucagcauacuccuucccacugugugaauuucuguaaaaucccuauggauaguacauuuuauaucuacuuuaaagccucugagugggcuuguuuccaguauccacaucggguugcucacaaucuccuguuaacuccagcucccuguuagugaucuuuugucuuccagaguacccucacacauauggcauaguuuucuuuaaauaugugagugaaaacaagaagccacauuccaaugcaguuuguuuucucacuaaaucuacccccaaaacccgacauggcuuuaaccaccaccuagccucacaguagcauuucuaauuccaaucugggcugcgaacucgacacugaaacagaguucggguaguugggauauggcgauaguggcucaaaaaucacuacugaucaaauggucacaggccuguaauccuaacaacguguaaaagaaccuuuagauuauggcugagacgauagccuagcaguuaaguauacugucaauggccgggcgugguggcgcacgccuuuaaucccagcacucgggaggcagaggcaggauuucugaguucgaggccagccuggucuaaaaagugaguuccuggacagccagggcuauaaagagaaacccugucucgaaaccuccccccccaaaaaagaaaugaauagaauacugucaauggacuaagaugagacucccagaacucacaugccagccuaaaaauagcuguaagcaguccuaagagauucgauguccucuucugggcucugugagcacugcgugcacgugguguagaaauauuaggcaggcaaaacggccauauguacuaaaggagaaaagacuacaguuuuccuaggcuacacaaaauccuagaacuaaaaauaaucacaacuuucgaggauaagaaaaacagggugacuacgaccuuagauugcaaaaugcccgcuacaugaauugcuuuuuuaaauuaacccaccaaaacugaaauuuaagguugacccggucgccccaacgauaugccugugaguaaaucaaagauaauuccuaggaaucacucccaccuguacgcuacuuuacaguuccgagacuacaagcuuuggaggccacguggugagcugcgucgacuaugcgccgugggcccgcugcaagacccuuucggaacguaaccuaagagaugugcgcaggcagcacgcgaccccuuacacggcacuaaaaacgcccuccaggcccagaacaccucggccucucccaacagcgacccggagccucgugcggccugcggauggcgggauuccggcccgcugcucuggcccuacaagagcgccguuuccgcgcggaccgcagcccaaagaaccccgcccugcggccccgucgcccgcagcagaccugagcggccacagugaacaaccgcuuaccucuuccgccgcgucgaaaagagcgcucccggcgcccagcagccggacuaggacaaggacgaaaucucgcg

SEQ ID NO: 4927 - RNA, 4775 nt, Mus musculus
uaaaauuuaauaguauuugguuuuuuauuuguuccugauagguuacacaaggagacuguugaaacugccaggaaacgauuacucgaauaccaaacuguauuaaaagaaagauccccaucccugucagccucagcacugguaccugauucuguugugucagggccaccacagcaauccuacaagccugcugcugcuucagacucuugggauccaagccagagacugaaacuaaguccuagcaaauaucaaccugugcaacccucacagaucccugcauuagagcagagucauauucagguaccaagacauggucacauuacacagaggcaaggaaaaauggcuguaucagaaauguuagguaagcagcccguggagucacaagaacgucaguggcaguucucucagguggaaacacaucagggagacuaugaguucguccuuaaagauucucauucacuuucaaggacuuugucuuauguuaggccacaaacauuacaagaugcuagagaaguaucuaaaccuccuaggguaauaauuugucaaagucuagauucccaacagauaucaucagaggauagugaaaauauaucuucuaagccaagugaaccgucuccuuuucucccacuggugccugaacgcccuuuuacuagucucccaguuaaauuccauucuggaacaauucacaaacccuuuacgaccauaaaccagucuguaaucagucaaaugcaugaucaaccuuugucauccucagagacuauuacagcucagcagggugacuuaagauuucuucaagaacaguuagaacuacagaagaaaguucuucaggcaagacaagaggcucgggaaaagcugcuuuugugcacacagaaagaacugggacagcagacuggccucccaguguuccucccuucaccagcuggaaauauauuuucuucauuacccucugccucagcugaaucaggaaacuuucagacaucuucaacaaaaagugaugccacuguuuccucagacaauauggacaggcuuugggauucuucacaacccaucucaucacagcaaacucauuuagaauuucuccaagagcaguccaguguugagacggauaaccuucaggcuaggcgggaagcccaggaggucuuguuugcacauacacaaaauacgcuggaaaaaauuguacguucugaacaagcugggucuucuuugccacaucagguagcucagcagucauuuaguucacuaacauuggcugauacacaaucuaaaaaaauccagaaacagccuuuaccugcaaacaagaaagggcuacucccaagccagucugaagucucaaaagcucaggauggaucuucagguuuucuacagcagacccuaccucuccagaacacuuuaaaguugcuucaagagcagcugacuagacagaggaguaugauuccgccuagacgugauggucaagagacauuacuuuuauauaaagaaagcuguucagaagacagugaggcugggccaguagaaucacucuccuccgugguuguucagcaugcagaugcuucucgugcaguuucagaaguaccuaagcggcuccaggacguguauucaucugaggaagaaaauagaguucucuccagucauuugaucacccauggcuuuccacagcacagccugcaaagacaagaacauuuuacaccacuccaggaagagacacacauucagaggcuuauacuuggugcuagaaaaaauaaugaggaauuugcucccaagcaaaaugaauuagaaaaggggcucugcucucaacagacugaugccuugucuucuccaucccaagucaccgacuggggaacaucccgggggucuguaucagucagaagugauaggacagaccccuuaaggcauuuuaagauuccagcguuucgggaaagacuaguuagaguuucacaacauacauucccucuccaagauaauuugcaggaacaccaagaauggguagacacagaaaaagagagcuuucaaucuaguccucuaacuccagaaaauccaucuucucaacagacagguuuuucguccuucaaagccucauuaagacugccaucguguguguccuugccaucugcugacucugguaucacacagcacccucucucaacagagagugacaguaaagucaagucaagccaucuucagauaccagaacugcagcauagacuuucgaagauaucccagcucaucccgccucaacaagacaguuugaaggcccuucaagaacaauuagcuacacaaagggaagccaucauccacucuagacaagaagcucaugaagaaacacuaagagaauggaaggaaaaaauauucccagagcagguugguccauuuucuccccugauaccacaacauucacuugcuucauucccuguuucugauacugaaagagcacaagaacuguguucaaccaacagugacaccauaucuucagguuauccugagaugcuggaguugccugacaggacauuggguuuaucacauacugcuuuaccucagcagaauaaucugacugcacauccagaacaccuucaugcacaaacaaauuuuuuucacucuacugagaaagcccaagaaggguugguguuucccagaccaugucaauuugaagagaugucugcugagcauuuuauccagccucaacaugaugacuuaaaggcacuucaacagcaguuagauaugcaaagggaagccauuagaucuggccaggaaaugcaagagaaaaugcuuuugcaaagguuaaauaaauuggagcaaaggauaucuuccaaacaaauuagcuccucucuauuuucaucccagguagcacugcccauugccaauucugacgggaccuuacagucuuucccaacuaaaaguaacgagacugagcugcuugggucccaagaugaguaucugagcuuuucacagccucgucugccucugcagaauaacaugacagagcaguuggacuuagaaaagguauuucauaaagaacugcuuuuacacaaacaaaagagccaaaacaaaagugaaucuucugagcauucccucccuccuuuguuucuguccaaggaaauagagcauccauucauuucacuaccuuuugcagaaaguaaaucuaaaagcauuugugaguuguauuuaucugacaagaagcaugcagcuccuaaugaugcugugaucccaagauugcaggacaggcuuuuaagcuguucccaaccugucuuaacucagcaagauaacaugagucuucagaagcagcugaaucuacaaagagaaacucuacacucuaggcaaaaagcccaagaagaauugcuugugcagagacagacauccuuacagcagcaaauccaaagacacagagagacuuugaaaaauuucuuuaaugucagucagguauguucugaauuuaaaacuuuagcauaauagauauuuaaaccugauuucauuuuaauccuaaaccuacuuucuccuuaguuauugagaguaacuuaguaauugagaaauugaaacaaauauaucuacuuuauagagucauuuuuaaaauacaguaaacauuaaagaauaugcaucuuuaggaauuuuguugcaguggguucucagauaaaauuauaaaaagggcugguuaauagauuucuuauagugugauagauccuguucucuaacgacuguuaacauuuguauaugaaucaaaaucuguguccuguuuuucccuaagugacauaaugguauaguugguaugguuauaaucugauagaagccagaccuacacuucuuacauuugaguugcugagaaaacuggcaucgucacucggacacauauuuaguuagaaugggucuauucuucuuuaggccacuucuuaacuuccuuagugcaaacaauucugcagcgccuagauguucaggagguacuugaaccuagaaguuaaaacccuagagugaugaagggaaaguaauggggaaaaaaggcaaagggaagcacucaggucuaacguguuaacaggcgcaaaggaaucuagugcuugguguggggcuguaacguacaaacuuugcacugggaguuuuacucguucagugauaaaaguacgucccaguuuucaucugucaacauaaagcagauuguuuauucugagcuauaccuggggauauggguucagguuucccuaaauagcuuguucaacaguggaaacaguuacagggacuuuguaguuacagagcaacagaaagugauaaauauauggugcuuuccaaguacuugguagagcccauaaaguaggcuauuacagagacacggggcaaaacugcuauagugauggaauuagucauucagcugagguuccgacuuaagggagauuucaaucucauggcuuauucaugggaucucuuaacccacauucccguuucccuaccuauauuuucaggcaaggaaucccacagaugagaaugacuuggaaaugcagaagagagaacagcucggagggugguuuccucacacccaaggccuuaccuggggagacgcaggucaggggagcgcuaauggugagcagccacgugcagauguccaugcugagcacaaugguaagaugaucccuguuaucuucugauuauacccugucccugcagcuagcugacaggagaaaagucacaaaguuugauuugcuuaaccuuuucuugacuugauaggugagagucuggccaaagaacugagugguagagccucaaagccaccugucuccaaaguuaaaugugucuuggacuua

SEQ ID NO: 4928 - RNA, 1280 nt, Mus musculus
uucagauguccuuuuccaaguuuuuuuuuuuuuacuuuauuaaaauacugaguuuauuucacauguauauuugucucccuaccauuuccacaucugaccaccacuauuacuauguccuaucauaacauuccauacguacuuaaaaccaaguaaaggguggaguuccauccuugaaaacuaaacaggcauuuuagacaacacauucuuggcaauugaaccuggacaacauuuaucaaacacaguagggaaaguucucacuuugcauuauaaaaaggacagccaguuaucaacuauuacagaaaugaagacagaauauuucaaacuguuuaaauccuuuucuuaaagagacuuccuccacugccagagaucuugaauagccuccuggucagucauccggaaacaauucuucacauaauugaugaacuuggcuuccacuuugggaagagaaccgccuuuuucuauacuugcuugcauuuuugccuuaaugucuucuacagaacuagguccuuuugguauuuuaggaaucuuucccuguuuuuugaaggacucuugacccuuugaucuugguguugacgguuuuaagucuuuuccauuuugguuugauuuuugugcauuuuuggcugggguaucucguacagauuucuucacugggaccuuuucuucaguuuccucuucaucaaaaucaucaucaucauccucauuguccucaucaucuucaucaaguuuuacuuuuuucuguggaaccuuguuaccaccuccaggagcagaucgcuucccagacaugccuaagaguuuuacguccuccccaucuucaucuucagacgcugcaucuuccucuauagcuacuagaugcuguccacuaaugugcacaggcccugaaccacacuucaaccguaagaccacaggugguguaauuucaaagcccccaagggaaacuguugguuguacagacauuuucaaaguugccaguguuacuuuaauuggacugccuucauaguucauugcuucugccuccacaauguguaacucaucuuuucccccugcuccuaaacugaccguucuuaaugacaucuggugcucauuaucaucauuauccacuuuaaagugauagucuuugucagccuuuaguucacagccaaaaagguaguucugaggccuaagaggacucauguccacauccaucgagucuuccaugagguggaggcgcgcacuucggugugggagaagccggauggaaaacaacugccuccuguuccacagaacagacucgcaguaaaugu

SEQ ID NO: 4929 - RNA, 25319 nt, Mus musculus
uccuccccuggugucucaucuauaacuguccggauccacccgacugugcucaccuguggcaguccgguaggaaaucuguccaccgcccgacgcuggcccgucuuccggucucuucugcgccugugcaaccggaacguucgggaaaauuccugaagcaguaccggcggcuuccggaagcuagcugcggccugaacaguagugcuggugauugcugcggugauucacuucuagucccgggugguguggauuucgccgagaagacggaauggcgcucuuguguuacaaccgcggcuguggccagcguuucgacccagaggccaacucggacgguaaggaggaccguggccggcagcuuucuccaggccucccucuccggacccuuggccuccuucaccuggcuucaccucuugcggucccccggagccucccagcucucucacccucucugggagcgcagggccgggcgcuucgguguccccggcgccccucauuccucagugggcauccccugcacuugcucaauucuaggcuauccagacccgguuuacacugucaccgccgugauuccugggccuaagagguauaaagaggugcacacuauuagacuucuuguugcguuugaguacuaguggaaagcguguugucacuugucaaauuacuugcuuuuuaaaaaaccgugcugggcuccggaaaugacuguuacacauccguuccacaauaacguuuucggcauacuuuuacuggggccugcaguuuuaaacuacgcuauuccagcauaaaaugauccccaagugcuguuccaaaagccaguguggucaaauuuggaaugcacaaugaaagcaagcaccuaugcugggugaaaccagaggugugaaugaaucucauuauugaguggaguauuuaugcagauaacugggcuauugcaggaauaaacaacacuuaccuccgauucaucuaguauguauaguauggucuuuauauccauucauauauacucauuauauaacugaaccacacugaaguauuucaucacagacuggaacaccacguguuaauaacacaguucagcuuuguaaaagagguuaagaccaguuccuuagauaaugaucuugguacacaaguaaacugguagcuucuuucaaaaugagacugggacaggauuuaaagggaaagaugcagcgaagccaguguaugaacacacguuuaacugucaugauauguacauauucuacuucaguacugaauacauugaugcauuguagccugaggcaauauuuuuaggguacuaaauuccugaccaaaguucaggagagauaccagcuuguuguuggaaguuuaucugucuuugugugugugaaauggaaccauaggcuaggaaagccacgaaaaaauagacagucaucaauuuggggcacauacaucaagggaacaccagucagccgaccaaauggggaaguguuuuagaaaguagggaugaaugccaaguaaauugguugaaugaguggcaguugauaacacuggauuuaggagaaagcuuuuuagaaugggaaucauuugacuuuacacauuaaaauuacaaauuaaaagauuagugcagaauauaccaauauuucugguuuucaaggaguacagugauagauguuucacuuguaagaagcugccagucuauauccaguccuccugcucuuagugauaugguauauguuccaugcuuauuguacuuuaaauucaauuuuaaaugguucccucucuacugcauaucuuugugcauacagguuuccauucugaacuucuauauucuaacucauuguacguaauuaauagccucuuuuuguuccauugcauuaacuacuauuuuguauacauagcaguuacuaagacuguaauauuaacuuaguagcagaggguagacagaucucacggcaacacuaggaauugaauaguagggaauuaaauuuggaagguugagugaguuaagacauuuacagaagaaugaaaccuccuuucucuacccucaugccacuguugucaggaaauaagugugucuguuaucugguuguuuuaaacaaaacacuccacaugcuggugguaauaaauguauuuuguauaagaacaaaauaaauuaaaacuuuuauucuguaaugaggagagagacaggaaauauaaaauaauagcacuaaugaagaagacuguagaaaucuaugauuuguaucuaggaauugguuaaaaugcuaauuuaguaauuagauauuacggcaguuacuaaaauguugaggugguuuuuuugguggugguggugguggugaguuuuuuuuuuuuguuuguuuguuuuguuuuguuuuucccaaacucuuuauuagagaauuucuugggaaacuuguguggauagguuuauaaguauacuucaguuugcuauuuucaugaaaagauagggccaaacagaagauggggaggagugcugagccugcugucagcuaguuacaaacuggcacagaguggggagggccuuggucccuugggcuaagcggagggucugcuggcagucggcugcugcaggggaagggguugcuuugcuucaggggcguggcucgccagcugaauaugcauucaggcagcacuaacugguucuaguggagguaaaguucaggacgaaugaggugggugguggguguagguagcauagcagguaagacugcuggcucuuacugacauacauuguauacauguaugagauuuuuagagaauaaaaaauaauauugccagaaucacuggaauauaaaguuuuauuaauagacaaauuuuacuacaaaaaaaugaaagaauauagagcagugguaguacuaccaaaauugcaguuaugaaguagcaaccaaaauacuuuuauaguugguagucaccacaacaugagggucacagcauuaggaaggguaagaccccgauacagaguauuucugaacauuacccuuuaacaguacuggauuaguuuuguccauguuucauauuccuagagauuuaacguaauguuuuuaauacaaggaacuaauaaaguuuuaaggaauuugcccgaauuuggacaaagauugaagccccaacgccugaaggaagaggugauauagacacuucuguuuguaagcaguugugugauuuuccuuuccuguguuugaacagaugcuugcacauaccacccagguguuccugucuuucaugaugcccuaaagguagguacaagauaccuuuucaauuucuuuguauuuguauaauaacuuuaaagauguaauaaaaccuuuuuuuuuuuucuuccacagcuuguuaguuuuucuuucuuaaugaccauuuugggguacuuuaagcagauugucuaaagacagagacaguugacagugauguuuuccaguuauaaaguuauuuuauuuauauuccauccuacuuuccuaaugauuuauucccuuccuaaguuugaacuugaauuaaagcagucauauuggucucagucuuuauucugucacugugacuaacaagaaaggccucccuuagguauuagaaguuguuguuuaaugcuuacacacauuuaguuggacuaguuuacuggaaacaugauaccacauuuucucuuuuauuuucuagcaagcugaggaaucagagaaaugggagaaugguuuucuuguuuguaggcuguguguuuguuuuucugaccaaauguuuaauguuaccuguuucaaaaaacuuuuaugaauaauagguauguaaauucuuagugacuuacacauucuuaaaacaggauaaauuugagaauaucaguuuacuuucugucuuuccuugaguauuaauuaauauaaacaaaacuuuuuguccgaauauucaccuuaugacauuagaguguuuuuguuaauauaaauuuaacuacucauuuaguuaaauaugaaacuagcaagccauauaaugcuuguauuacuugaaauuuacugggccauggaaugcagcagacuggaaagccaagguuuacaguagauauuuauagaauacugacagacaacaagaaccuggagaauuauugucagugacagcacuugccaucugagcaagaggacgaccuaaauuuguucccuagcaccuacauaaaaucagggugaaaggaguaucuuuaccauagggcugagaaaaguggguccuuaugccucucugugugagccagucuagaugaguugccaagcucuagguuccgugagagaccuugacucaaaaaguuagaugaaaagaaauauagggcacacaccugaacacauaauaaacuaaguaaauaaaaacuaauacaacugcaaaacugaggguaauaaaaaguauuucaguugaugugaaaugguuugauauugucugugggacacauacauucaaauguguucugagacucaccggcaggugacaacuugaguauacaaaugaaugggcuugcaaaaaauuggaagcaagcauuccaaugaauaggaaaucagaaauacuaaaagggaaaaauacgaaauaaaguacaguaagaaagguaaugaacaguaaucaaaaaauaauucuuuuccaagaaagagaaguauacuuccauaaucaguuuuaaaacauuaaagacuauucggggcuaaaaagaacaaagcaagagccagaggaaagggcccuggaacaugguuuccuugucauagaacuuagcagauugcaccuuuguuuagacuuuuuucauguaucaauuaaaugcuaagauucugacguaauuuuauguauguaugucugucuguaugcauguaaaagucaguagcccucugacaguacauuuuuuucgaagacuacagauaauaucagcacucuuuaaacucuguaagauugguaauugguuaugugcaucucaaucuaagagucucaaaaaaaauuacaggguauucauuuuuucccucuaaaaaccaaagagaauccuaaaagagcauauagugucuuaaaaaaaaaaaacuaccaaaacuucuaugcuguaaggaacuacccaugugaguuuaauauuaucuuagggacacaaggauauuguauuucuauuucuuuacucucuacuacauuggaacuaaaaauaacugaaagcaaccucaguaagcuguuccugauaaacuauguaaacuaucuguuuuuugagugaaaugauuaugagacgucuucaguggcauugcaccagacacagaaaagaugaaggccagaagaaaggcuagacaagcucuuaauaagaccagaauacagugaaagaacaaauaguaaaucuuaaagguggagguaaggcaaacagcacagggagagagcuucagaacuaggggccucuggguuuugucccucaugccuuuuauugagaguuaagaaagaaccaagaugauaaaggcaucuaaauaccaaagcagucacuuuucuggguaaccaagggggaauuauuuaaccuuacuuuauuuucauugguuuaaugugcuagucaguuaaggacuucucuuacuaccugaaacugaggauguaugcuuacgauggaaaaagacuaaaauuauuuauuacuaggggccuauuaagcucuggauuaacuaaagcugccaugcugauaaaucauuaaaaguguucugugcuggcuuacuuuaaguugguaggcagaggacauucucagucugucuccuucccuaauuucguggcuccuugcuuuaauacccaggcagcccuugauaguuuguaaaacugcacauaccucaguugcuucugucuguucugcuucuggcuauaagguuaguuuacuuuaaaaacuaaaggacugggcuggagagauguuaagaguacugacugcucuuccagagguccugaguucaauucccagcaaccacauggugggucacaaccauccguaacgagagaucugaugcccucuucuggugcaucugaagacagcuacaguguacuuacguaugauaaauaaauacaucuuuaauaaaauaaaauaaaauaaaaacuaaaggacuauaauuaugacuuaguagauuuucccccagguaaauccccuuacuccucagacccuuuaaauacaugaauuagagagaggauguuggcauugaaaugggguccuguguacacuggcaacagcucuuccagugaguuacagucccucauccaauagaugguguuaaaaaacuuuuuuuuuucaaaaacuuaaauacuauucuuaaaagcagccccugauuuucuuuuucucuuuuucuuuucuucgcccaccccccccgccccccuccccccggcagacagaauauauuauugauaucaguacagcagaggugcccgcauaacaggggagaggggauccaugccgacaccaguccucuccugccccuacugggccauugaggauggggccaguuccuccugcuccaccucaaacacuggggauggagagcccaaggcuggcuuugcuucuggccccuugcuuguaucaucaguccaguguaaugacuuccgugaaggaauucaguuucucucuccuagccccuagguagggaaccccagcuacugaggaagggcagcccaggggacaugggguauaggaagaacauccacagccucccccuaccugccccaaacccuugaguucccuggggccccaaacaagcaggcagaggaaggaugggaguucuucauggggucugggauccacaucuugcaacugacuccccagggggugcugggaggcaggagguggaggucuggaagcgaacauccagacacuucugguagugggagcaugcaugcagccuacacagccucugagagauuggcagcacugggcucacaccaaaacaugugacagcagaaggaggcuaggccggcagacaugaugcaugcaaacaugugcacauauuugcccacagccagggaggagagaaacugcacccgacacuuccccagcacagcuucugucugcuggugcaagaugguaaguguggcaagggccacgcugaugugacuuggaguccacugcucacggcaacuggaagacagaacugacuccagggccccauuaaucacaucuacuccaacagguguagccgugggcacguuccccggauaauagacuuggaaccuucugcaucagcucauucuuuggugcugggaauuccacuuggaaagggacauccacggguccagggagaguccauuuaucaaguagcgagcauugcgccguucagacaugaucuuggagcagaucucaugcaggcuggcggcaauguucuuggcaggugccucacagugaaaacauguggcacuugagcaucuuggucagcuuaucgcaagcuacguaggcaaagucccuuccacugccccgcccaaugccccacaaaugaaugcuuuagcgucucaugcuacagcuagagcagcaauccuuucucucuccccagcccccagccuucagauaauauagaucauuuuuugugguagagcucucggauccaguuguugacugccacacugcuccauccuggggucagcuccucuucugucaucucuacacccagccuagguaacccaccgcgaaacauuugaucccuggguuggccuucguuugggacaucuuuucuuccucuuggggcacuggugcugggcugaggcucugagcugggaaggacaaucaauguccccuccucaggguccuuuaguuccaacuucauuggggccuccucacuggguucauccuuccaaaacucuccuucuucaaagucuucuuggugaacaaagccaguccaggugaguugggacucuucuuggggacugcuccccugugagggggaggcccuacuugggguuccuaccgggugguccccguugggaugugccaauaguaggacccugagguguccuggacccuuauccauuccaguuggcagauaugucuggaaagcguugugguuccagaagaaaucugugugauaagguggcccagcuuugaggcuagugcucuugcaauguucccgggggcuaucugugagggccggggcccagaggggacuuccacauucuccagaggcucagguggcccuguuugagaagauaaguccucauccucuuucuccucuucaucauccuccucagccucuccugcugccuucucuccuucaucuggucccuauuccuggguacugauaaucacggcggauccaugaagcccucuguuggcagcauugugggccaagagcuccagcucagagaauagaugcauuaagccuuugggacccaaaggugcuguccagucuccuugcuggccuccuccgccaaggucaagaucacauuucgccgaagcugguucuggccuuccuuuaaccacuuggcauuggcagagcuugguucaggcacacuacccucuccaguagcacuucgaagguccuuggguaccacagcuguagcuugcagcuuggcauugagcagcugguaaugggcagcgugcagggguaaggggaagcugagugcagggccucuguggccggcugguucagggaugauggaacagacauggccuugguagauccuguggggugaggcccugggcccaguuggccaagguggcucaagcugcagggccccaacaauaccgcaguuucuccaucacaacaucccucgcccaagagcucgcaggccgcccggagccaugcacagcgauugauuuucuauuuuaaggaaguaauuauuuuuuuaaacaagaucguuuuguguaauuaggaaacagcauacaaaaguugaacugguguguauguaauuucaggauucaaggaaauaagagcaacacaguguuaagguuuuuuuuuuuuuaauuugauguuuuuccuuguuuuacaggguuggucuugcuguaaaagaaggacaacugauuucucugacuucuuaagcauuguaguaaguacuacuuuauuccucuguauuguuuuccuaaaaguacauguuccuggaggcuccagagugugcagucagauaacugauauccauuuacucaaauaucagacuguaccauacuuuauaaaggggcugcaucuccuccauaaccucuaaaaucuuugccuuggagaauuuugccuugaagaauuaagaguuuauuaugcuaacuauucauuugucauuuuauguccuuuauuuugguauugaagagaacaucaggaaggacuuuguagguaggcaaugacugggagcggaugcuccuagcgcugcagugacuuuagggaggggcaggguguaguaugugagggcgugaggaagagggggaaugggggaaagaucugggagagggaguacugagaggagaggggaggcugauaauugagauagagaguauauaaauaaauaauauaaacaaucucaauuagaggcaguaaauuucaucaagacaucagugaaaugguccauuguuuuauauggcaccaagaaagaacaaucauuucaguguuuuagaugagaaaaauaaauuuucauaaauuauuuggguuaaggccauauugcagcuuaauuggaaaggggaagcucagauuguuuuugcuuauguuauguuaugcagcccaaggaugcauaaggauagcauagcauccuuggguugccagggauaacuuugaauuccugaucuuccugccuucaaauacaagugguaagauuagagguggcaccaugccaggcuuaguaguguuggaagucaaaucuagggcuuuguacaugcuagacaaguacucuagcaacugauacuacagacugaggccuuuuugaauaaagaacuuuggcauguauaauuagaaaaggccuuugaaacacccaaaauacaaacauacauacauaaaguaggucaaagcauaacuguucauaucuuacuaacagggcuguacaaaagguaggcauaauagugagaagccaccugaaccggucaagccugaagucaagacuacugagaagaaggaacuaucugaauuaaaacccaaauuucaggagcacaucauucaagccccuaagccaguagaagcaauaaaaaggccaagguauaaucuauacagcuacuuauauuugugacaguaucauacuggaauuugcuggugguauuuucuuuuagcauuuuguauaaagacguuugcaguguccacucguguauuuuccuuugguaguaacccuuuaguuuuugugaguaugcucucaguuggaggcuuauauaucucuguuuucucguguaacauucucaugaagguauggugagauuugguaaaagacuuguccuuuuauauaguuaguuugaauugaagcgccacagaggccuggucacuuaguuuacuuuuagauuuguacuuagggaguuugaguuaggauacccucagugucagaauaguuuaacaauugcuuuugcucaccuugaaguagaaguagauuguccaccuccuguucaaaccagacuauauuuaaaugcacuaaugcagugguuccuaaugcugugacucuuuacuacaguuccuuguguuacagggaccugccagccauaacauuauuucauugcuacuucauaauggcaauuuugcugcuguuaugaaucauaauguaaauaucuguauuccaaugcuguuagacagcuccuuugaaaggguuguuugaccccacccccaaaggagucaugacccaugguuugagaaccacuauauuauuaauggguuuacuccuguaaggcaagaucuucaaucugcaccuaaauagugccuguaaaauauaaauacagaaucugggcuccagauuuguuccucacgugaaugguuuuuaagugcaagccugaaaaaucaucacaaccaauagaauguauucacauuauaaauuuacaguguuuccaacucuuccguuuauuauguuuaaauaaguuaauagaucauuacauaauauagccccaaaauaaaaauccuugcuuuugauguucauuugcucauuagcauuuugagguauaggcuguaauuaaagaucaaaaugcuuuuauucuuccuacaguauuaauucagucuuaagagacuaucaaacacuaguuuacacaguuaaaggaguaccagaaaagaacagcaguuuuguuacaguacaguucaucuuuaaaucucucacaucucaguacaaucuauuagaauuuaaugccaauaugaauuauuaccauuucuuuaaaugauggacuacacagauauauaagcuuuacauaagaggcuaugagaaaagguaaauguauuuuaauuuuuuauuuuguuuuaucuguaagggcauguuuugccugcauguaacuacuugcaucccuggagcccauggaaaacaacuguuuccccucgaacagaaauuauaaacaguuguugagccaucguuacggguacugggaaucaaaccccaauccucuggaagaacacuccucuaaaccacugaguuagcucuccagcacugagcugcuuuauuuuauucaugacuuacagauucuaguguacuucauuaauauuugacaaguuauuguaaacgcagagugaacaacuaugaucuuuuuauugcuacauuuauuaaugaccguaauuguuuacugaauaggcuuaaacaaauuauauguguguguguguguguguguguguguguguguguguguguaauuauuaagaagcacuagaagaugguagugguuuuacacggucauaaaauuuuaucuaaauugaaaagucuauauucuucacguaaguaaauugacucagcuaguacagaugaguuuguuuucacuuagugcuugaggauuuugcuuggggaugaagugaaaaggauucuacaguccuuuacauggggcuuacucaucuuuacaagcuugaaccucuagucuuuccuuccuucuuauaguccacuguguagugguaucuuuaugcuagcaauagcaugaaaauuugaaacuuaauuucuuaauagaugcagcauuuuauugaaaauuagaguguuggucaguuauggcauuuauuuaugaaauacuuuuaauuagaaagaauguaaugcacagacaauuaacaucucauaugggaguuauuaagguuaucaauuuuaaguacaaagaaguacuuuggucuauugaugauaagacuucaaaauucucuagcccagaugagccaaugacaaacuuggaguuaaaaauaucugcuucccuaaaacaagcacuugauaaacuuaaacugucaucugggagugaagaagauaaaaaagguaagacuuuuuuuuggguuguuuauuuguuuuuaguaauuuucuguguaaguaauagacauaaaauuuaguaauuuucugucaaaagaaauagcuacauugcacugugugaaaauguaacauauuguagcagagaacuuccuuccuucccaaaugcuaauaacaccagagaaguagcauuugguccauuaaugaugucuuugcucaaacuuacgauuccuuaauuauuuuaucaguuaaauuucuucagcuaagauguuucuuuguauaccauauaaaauauuuuuuauuauccauuugauuucugccuaauaucaaaggacaaaaauaucauccaugacuucuguuucacaagagaauauaggauuuuagaagauuggaugaucacugcauuguagacugaaacauaauauauauuacuugacagcauauaggcaaaaaguagagauaaggcuuuuuguuuugagacaagaagacauuguccaguagcaccagcaauucuggaugacuuagaacucauaaucauccgccucauccuuucaggugcuaggaugugcguuuguuuuuuaucucauugucuuccuugaauuagacuuguuuuaaaagaaaggauacuuuuuaagaauaauacaacauagccgggcagugguggugcaugccuuuaaucucagcacuugggaggcagaggcaggcagauuucugaguucaaggccagccuggucuacagagugaguuccaggacagucagggcuauacagagaaacccugucucgaaaaacaaaaaaacaaaaaacaaaacaaaacaauaaacaguggagguacuauuuuauuauuguaguuuuauuacucuuauuucaaaaagaauauaguuaugaaaccucauguuaccuuuuuucuucauugcagaagaagacagugaugaaauuaagauugggacuuccuguaaaaauggaggguguucaaagguauauauuauaaaacuuuggauauaugcaguaaaauuuuaauauucaagcagaggacuauaguucacucuaaccuuaccagauaguugcgugcuacuuacauguuuggcauuuugcugaaaacuagggcuauaaauucaguaagacuucuaagagaaacaucugauaaaauaauuggaauaaaucuaauuugauuaccauuuaauaagcacuuguuaugugcuauacaacaaguuuuggacugaagauaauaguaucaaauuaaacaaaaaucucauccuauagagcauuuucuaauguggacaggaggauaaaaauaggccauugaauaauuaauuuaggcagaccuaaaauaaauagaauaaaccuagcaacuagcaugguuccaauugugggcuacuuagauaagauuugucaguggcccugguuaaaauucaggggugaggguaggggauggugauuacccugggaguagcuauccacagagggaaccauacaaguauaguggcuuuagagauauguugcucagcggauggcaaggucauggggcuugggcaauaaucugaaaggagugggugaagaaguagacgcggugaaaggccuaacccaggacaaggggcugggcuacuucaaacuggugguaagccguuaucugcuucagggagguauuuuguuuguugaagcaaguuauucuaucccaaccuggccucaaacuccaguccuuucccucagcugaguggcaggauuacaguuguguacuaccauacccaauucaggaagagagcucugucagaagucagaaggagggaaacagcuucaacccuauuauaaaaagcaggugguguuauuccauagaguagguggcugaaugacucgaugcagaguguggcucaucaccgugagagccuuugcugucuguccuguauaccuuuucaugcuuucuccucuaugacacuuuaccuuuacuugacucguucauucuguuccuaccuccaucucaugguaagaauuauaauacgguuuuguuugcuuuuuguuuuauuuugaaugcuuagcuaugcgaauggcauagagcucauauguguacaauuaaugguauaaguugaagaguugggcauucaagaaccuugguaauugguggacuuaaagucauagccuaugucccaagaagccaaguucaucuuugauaauuuaguuaaaacagauaaauuaauagugaaaaacauaaaaagcuuuuauuuaugugaucacacuagggagagggacaaagauccaacagcauccacccaaaguccauuuuggcugagugagauuaacgcuuaaauagagggcuagaaauaauguauaauaaagcaguugcagucaggguauggccccaccuaccaugaacucauuaugauuuggccuuccauuugauuugguacuggauuuuggccuucuauuccucuggucugagauuccuugagggugggggauacucaaaacuuaugagcuuucaaaaugaacaugacaguauugaaaaagacagcuuaacugcuauuugacauuuuucuuccaaaaauuucuaucaucagcguuuauuuuuugcuuguuacugaugucaauguaaaaggaauaauaaaacuuguuaucuuucuuaauuucuuuguuuuauggaauguagccauggucugacccauuuugggacucugagguuauuacuaaaguguacugcaguugauaauucauuuuuuuccuuccuauuuuuuuuuaauaauguuacucuaaauauuucaauguguaacuuuagugacuagaaauggaauuguauguauguucaguuuuagcugaauggaggcaaaugcuuguaguauccaccggguugucuacacacuagaaucuuuuuuucuuccuugcuuuuuacuuucuucacugguguuaagguugagaccuuuucuuucuuuuuuuaggauuuauuuauuuauacaccagaaaagggcaucagauccuauugcaguuaguugugagccaccauauaguugcugggaauugaacucaggaccucuggaagagcagucagugcucuuagccacugagccaucucuccagccccgaguccuuuucuuaagcugacuaguucuuucuucuaggguuaaauguauguaaucucucaccuacuuuuuugucaucuuuuucuuaauuuugugggaaaucuucauaucuuacagcugccaaauccuuugucagauauuuuauaugauucgcacugaccugaugaugucauugauaagcagagggacuuuuaauuuucaugcaguaaaguuuugucuguuuuuuuucuguuguucuccuuauuuaagaaauacuucugagcuacaauuuguuaugcagagagaaaugugugaaacaccuguaacugaauaugaugguguuuuuaaucaaaggaauuugagaagaaugguaguaauuagaaaguuguacccaggagagaagaggaauugagaagugggaaacggaaauagugcauuugcuaguuauugagugagguuaaacugauuguuguuugaaucugcauugaauuugacaagauuuugugauaacguuagagguagaggggacagacuuacugauucagauguggaagacaucugugaguacauuuggugccauugaauaagaugagaaaagacacauuuuuagguggcaauacuaaguucagauucuaacauauauacuuaaggagauaaacuccuagcacuucguacuuaacaaaaaugaaaccaaaaauuuuggucuucuauacuuuaguugauaugaauacaaaaguagagaauauacugcaagcugcauccauguuuuauuaacgugacuuuuugugaauucaccuguagagccuucacguacagcagcaguggggcccggaucuuccagacaaaccauggauguauauauaggucugcagcucauuuuaccauuuguagggauaagaaaucaguauucuacugaaacuucagaaaugauuauuagacuucccauauuaauuuguaaugcccacacagagugaauauacuguacauauaaucauguuucuggugagaguacgagucccuugauuccaacauguuucuguaaauuugaauauuuaaauauaaaucaguguaacuucaugccuaaaaggcuaaaaccaucuuauauauaaauugccuaccuuucuguuugcuuucuuuccagagaucuagaguuuaaccauguccaaaagagggucauuuuccauuccuugaugaacuuaacaguguucuuguagcugcuguuaguauuauaugaaggccuuauguguaaccaguauuucagauagguauuauaagaugcaagugugagauaaacagcuaaugucuuuccucugugucuuuguuuuauagacauaccagggucuacagagucuagaagaagucuguguauaucauucuggaguaccuauuuuccacgagggguaacuuauauaccuaauuaaaauauuuauaguauugauucaaagcauuaauuaaaccuuuauaucuuuaaacacugccauguaguuauuaccuacauuaauaccguuuaauccuuauaauaaccuaagaaaguggggagguacaguugccuucuuaaacacaggagaaaauaggguuacagcuuuuaaguaaucguggugauucugcagugugaucuuauuuggacuuguucggggguguuuguuuguuuguuuguguuuaaucugaggcaggguucuacugguuaugcagacagccucuaccuugggauccucaggccuuagccuccuguagaaccgcuuacaggcguguccuacuguagagccugacuuacucuucuuuguguaacggacugacauucaguuuuuggacauuagguuuuuuagcuguggagcaaugaaagcauuaaccaagaaaggccacgcuuuuccauaacucuuaauuaacaguuuguuacuacguuguaauauaauuauauacaauuaauauauagaaaguuuacuauauuagaguuuucaacuguuuccacguguuucaggauuuuuaaccuggagaccuauaauuuuuuauucccugugcaggguuguuucuuaaguuaguagugguuuuaccuuccuugugauuggccaucauguauggaaacauuagauuccacuuugcuccauguucuuuacuguuauuaaaacaugacuauuaguaucuuuggucaugccacauuuugguagcuucaugagggaauuagguguacauucuccaugagaaaacagacauagacuccaaguaguuuuguauauuuagucaaaagcugaauuauuacaauaaauaacacccugguuuuuaaaaugaguuucccuaguauguauguauuuuagcaguuaaguacuugcaagauauuuaaaauuggaguuuuuauuucuuaauuacauuuguuauaaugaaaauauuggcuuuaauucauugucuaauuuaaaggaugaaauauuggagcuguuguagaagaaaaacuucagauuuuaauacauucuuagcccaagagggcuguacaagagggaagcauguauggacuaaaaaagaugcaguaaguaaccuuuucaaaguaauaugcugaucuguauucaucuaaaucguuuuuaagagaucugagauuaguauguguucauauuaaaaaaguagcucucuuacaggguuaaauauugucauguguacaaaguaguuaaucucaauaucucagcaauaacuauugacaaaauaauccuuguauguauugauucagguauauaaguuuucaauaauauccucaaccugccaaaauugaaagcucuuugucuuacuagcacugguuacaggggagcuggagaguuggcuaagugguuaagugcucuuguucuugcaaaggaccaggguuugguuccuagcauccacaaggcucgccacuuccucaggcuccaugcaugucugugguacacagaccacaugcaggaaagcacucauccacacagaagaaaucuaaaaaacauuuccaauucuuaaaacuguuuuauaaaaccacuuccuauuaauuuaguguuacuaaaccaauauuuaaaucugauuuuuuuuuuuuuuugcuacaaaauuauucauacauacauaaaaucucucuaucuagcggccaaaagucuuaggccuaugaacauacuuccuuauaguccuuuaaguuaaaaacaagaaaccgguuugucgcuaaauguuguuaaaguaauaacaacauuauuaauauaaaccaagauguuauuauuuuaacaacaucauuaauauaaacaaauccuuuguguuaugcuguuacuacugacguuuuuugauccuuucuaauucauaaaacuuguaucuguaacucaaggccuuaacucaacgauauucaauauuuggguaucucauuguucuugcuuuugaauuauaguuuacugaccauaaaacuugcagaaauguuuuacuagcagaaagugagguuuggaaaaaaaaaaaaagaaagugaggcuugcucauacauuuuucucuauugucaaaccuuaacaauuuaaacuuuaaaaaaauaaguauuucagaguucccugaauuuuguggcuaauuuguuccuuuuuagagcaguuuacuuagaaaacaucaccauuuguuuguuuguuuuucaauucuacugauagcauacauaguguagcaauggaaaauagagcuccuuuugauaagagcagucagaagaugauuucuguaagguauuacauuaucugcauguuaauaagaaaggacuaggaaauuuaauaaucuuaagaauaguuguuagcuuacaauguguguguguguguguguguguguguguguguguguguguguguguguguguguguguguauguguguacacgugugugaagguuccaagcuuggccaauuuauuucaugagauauggucuuucccugaggcuagagcacaucuguucaguuguggggucugugcucaguccuccagcauuagggcugcagauccauuccagcacagaugaacaucuuuaugugggugcugguguuccaaacucaggcuuccugcuuggaaagcaggcacaggaccagcagaaccauauuuccaaucguaacauccccaaaauguucacucauucaaaauaaacuuaagcgucucaugcuuucaaguucauaguugucucuuaccauacaaaugucuucucauuucugucuucauacuuaguggacuauaguauauuuaaguagaauaaaaguuuaaugaggccuguaaaauaucuacuaaauggacaguaacaauguaaccuuaaagaaggaaaaccaaauuggagaaaccaggguacucacaucauaagcuguuaagauauuuugugauauaauuuauuuaagccucucuguaggaucuuuagaaguuguagcccugaaugcaugaagugcuuaguuguguauaauaauuuuugcacauuaacugacccaguucuuuuuaaaacagugauuguguagugguuuuuaagauuacaaaguuuuccuuacauuacaggggaaaaaaguuguuccguguagacacgacuggcaucagacugggggugaaguuaccaucucaguguaugcuaaaaauucccugccagaacucagucaaguagaagccaacaguacuuuggugaguaaacauguucucaaaaguucuucauucugaucagaaaaucacaaaugacuuucauagaaacaguauuuuaagugaaacucacaguguaguagacuuuauuccaaaguuaucuagaaguauaguagcuuagaaaaaucacaaaauacauauuugugucucaguaucaaucuucuagcuaauucuuccuguuaaucauuuucuuaaaugaaacaguggggcucaauauugacauuuugucauagcuugagcaaugccaguauugucuuuauaauuaguacuuagucuacucuuggcuuggugugguucaauguuucacugcaugguuauuguguauuauggucauauuuucaauacuuagcaccaaaauaaugacgauacauuaucuauuucaguuaaauguacacauuguauuugaaggagagaaagaauuucaucaaaaugugaaacugugggguguaaguauuaugaauccaucaauuuuuccugauucuuaagaucauuuuuagaaugcuuauaaaaauagugcaggaguuuuuuuauaauaagaauauugucucccuguguuaaaaucuuacauguauuuuacauaguaaagcucaugaauauaaccuuaacauguuuuaucaagauaauuaaauugcauuaaaauggccccagaagcuugauuuugaaauuagacaagauguuuuucugagaacaauaaaagcaccagguuaacucuuacucuugauguguuguagguaauugauguuaaacgaaguuauguaacuaugacugcaacaaagauugagaucacuaugagaaaggcggaacccaugcagugggcaagucuugaacuaccuacaaccaaaaagcaggagaaacaaaaagauauagcugauugauuagaagagaaauggaauucuuaauguguguggugaaauaguugcuugcugcuguaaucuuuuuguuguuuuuagucugucguuuuggggucaucaugagguucuucaaagccaaagucuguuaaauguuugugccucuaucuuccuuucgaguugcauaauauaauuauucaagucuccucacuagaacuauaguuguugcccuuacacuugaagggagggaaagaaaccauaaguauaauugcaguauuuuuuaguauaaauuauuauaagcaggaagugaaagaaguuuuguuuuguuuuguuuaauccugauaacuccuuuuucccuuaaaugggaaagcaaagugguauauaaaaaacugaguuggccucuccaugaacuuuuguuauuauaauucuugaaaaucuuuaaggaaaagacuuuuuguuucuuccuaugcaguaguuacuuuuuguaguacuaauucugaaguggagucaaaccgucugugugugcuggcugaguuuauaauucauuugcaguuaaauuaauuuuagaaaguugcuucaauacuugcauuaccuggcaagcaguauaauuuaagucuauaggaaauaaacuaagauuauagaauuacaauuugguuaaaauucaucauaagaguaagcaauaauguuaaaaucucuuuccugauuauuuaaagaacucuuuaugguguuuugacaaaauuauaucugauuuauagucuaaacacucuuaugggugauaucugucucccugaugaaaaacuguaucuguuaaauugugaauguguagcuucguugaaauacauuaagguguguguugcggcuugaaucugaaauguaccuggaggcuuguuuugagcuguuggucuuucaacuuagggcucuauuuugaaggcugugaaaccuuuagcauauugaggggugagccuuuaaggauuauacagucuugcuggucugauccagucaggacauaugaaccaccucugucccauacucccacugcugccuccucagccauuauagauuguauccucugaaaccgugagccaaaauaaaccuuaccucccuugaguuguuucugucauguguuuuggucaagacaagaaaaguaauauacaacgggaaaauuacagucugucuguauuuuagaauaccugaauguuauguuuuaaguuaauuuaguaguuuaauucuugggagccauuuuaaggguuucaugaagaguuuuacauauaaugguuauguguuauacuucauuuucauuaguuguagaugacacagauaaacuuagaucaaaaugaaaguugaaggucuuuauuucucaaacucuuugguguuaauagaauccuaacaaaguuucauuagucuauuguuuuaguuaguaaagaaucuaugggggcuggagaggcagcuccuuuaagggcacuaguuaauggguucaauucccugcauucacguucauuucacacacaggaccuucuucuggccuccaugggcaucagucaauuauucugugcucuuugauacagcaagcaaccuauuugcaugaauuaucauucugcuauuaguagauaacuauuaaagauauuaugaaccucaggcaacaaguauaaagauacuaaucuaccuucaggcuuugaugaagcaagaacauacuaaacauuuuuuggcaauaaaaaacugggauccaaauaguguuucuaaguuuauaguuagaagggaaugaauuuagaaaaagagaucuugcccaucaaugguggcgcugccuuuaaucccagcacuugggaggcagaggcagguggaucucugaguucgaggccagccuggucugcaaagugaguuccaagacagccagggcuacacagagaaacucucucgaaaaaccaaaaagaaaaagaaaggagaucuuguguacuaccugaggaaagagguugaaacaauuugauucaaaauaauaauuauaucuguaucacuuccuuguuggggugguuuuguuuucuuuugaauaacaacuuuguuuugaugucacuguuagagcaaguuuucuaacuuuagacaugauugcacaacauauucuuccauaguugugcauaguuugugaccauuuaauuauuguuucagaacuucugcauggccuucagauaaaaauuaaguaaaauuuaccuuaacucuaaagcuacaguauuuuuaagaaauaguauuuuacccuagcaguuaauaaaaaugcuuguuagcuuugagaaguuauuucuauuagauauauauuucuuuuauuagagcaucaaaacaaucaacccuagauaaaauuuauacacauuguaacucaauuuaucaugggaaauuuaaaaugcaguuuucuugucuagcuuuugcuugcacaaaggaaguaauaaguugaccuguuuuuccuaaccuuuuauuuugcaguaacuuuguguugguggaauuauaaaaauagugcaggaguuuuuuuauaauaagaauauugucuuccuguguuaaaaucuuacauguauuuuacaaaacuaagacauuaacuuugguauaacauuuuaaaguaggaauguuuaauuuuaaacauuuuagcggaacccuuaaaggguaauaauucuucaacaccuauuguaaaacuuaagccagugauauacaaaacuaaauugaaaugagauguuuauagauugauuguguacaucuuuuggagcacacugugaguacaaugauucagcugugacauuuguaucuuauuuuauggaauuuugucuuuuucauaugauuuguuugauuuucuaauauuaguuauucaucagaaugaagagacccauuaaaauguucuugcaaauauucugaguccugagagaguccugagauacuacuaucaacccucuucuuuaagauuacccugggggcuggaaaaauaauagaaagugguuaagagcacuugcuauuauuccucuggacacggcuuuccagcacccacuuugggcacuuaacaacuaccuaugacuucaacuccaaaggauguaaugcuuucuuucagcauuuuuuuugugagcacccauaaagagaauaauuuaaaaaacaaaaauuacucugaaaauugggucuuguauacaccuaagggaaacuuuaaaagcucauuaagagaucuagaauucacugacagguacuuagggguguguguguguguguguguacacauacauacacacacacacacacaucauuuuuauuucucuuugucuuuguuuuuaacagcuccacuuuugaaguuugaaaaguaaggauugguuugugcuacuguuuuguucagguuauuuuauuuuacuuuaaucuauguucguucauucaguauuguuuuaugggcuuauucugacguuugagcuuucaaugucagccuggguuuuguuuuuauuuuuuuuuuagaaagguuuuauuggucucuuugauuucuuucauaucaguagaaggucauguagaaggucauguuuuuaccugacugcuuaucuucuguucuuaccacuguaauucuccucaucuugcaugggccuuuuaauuaaugauaguuucucauauuauuggguauauagcauucucucuaaaauaccuaucuugccgagauuuuacauuuauguauguaucuaauauacauauauguauguauauauauauauauguauauauuuuugauuuuuaguuuuuauggggauuuuuagaugugaagaaauucuuuaagaagaaacuuccaaagacuuuuauuuucauuagugaucuuuaaauacuucaugucauuuaaagauuuuguauuaaaauagcaagauuuguuacucauuuuucgcuaagcaaauauacuauucaagugaauaaauuaaaaaacuaucuuuucaaaacuuuuccuaauuacagacuaaugauuaaacaugaaaaagggaaaacuucccaaagguugagaacacugucuuuuuugcaacaaagacauuguauaaguauauuccuguuuuauguuauuuguuauaaucuuuuugcugccugcaaauuauauuugcuauuuuuguuuuggucaacuaacuaaugccuauuuucugcuguacuauuuggcauauuuggguagcuguuaaugacaggcauacaacagaauggacuagcauuguuuuaagaacaucggugaauaugaacuuacugcuaauggcuucccaguaaaguauguuguccuguaauaccagugaggaaaaggauucacaucacauugguuaaacucuugcagaguugaaaucacuaagcuguucagcagagauuguagacucagucaggcacuuugaauuugaucccugugccuuugucuuugccucugcccagacauacucugugcugcucaucaguugaaugaauagcuuuuuaaaaaauacuggcacauggcauaacagauguuauguuagaaaauaauuucacaaaaugucauuuugccugggugguuuugauuaauagacuauuaaaaacucaucauuugugauuuguaaccucuu

SEQ ID NO: 4930 - RNA, 920 nt, Mus musculus
uucagacuauuuuucucaaagcuuucuucauaucuuuguuccucagacuauagauaaauggguucagcauaggcggaaacacaguauacaucaaugaugcuacagaaguucuccuguaugacucuguaaaugcagaacuaauguauaccccaaaagcugucccauagaacaaggaaaccacugacagaugagauccacauguugaaaaagccuuaugccuaccgccuggugauggcauucugaggauggaagagauaauuuuauaguaagagaaaauaaucccuacuaggggcauaccaccuaaugcacuacucaugacauauaucaaaauguuauugaugagagugucagaacaugcaaucuugauaaccugauaaaguucacagaagaaguggggaauuucaagaaaugugcagaaagauagacgcaaugucauuaagccauguagaagggcauccacaaugcuaauguacaaagacaaaaaaaucaucacaaaacacaaauggaguuucaugaugucuguguagcgaaggggauugcagauggccacauaacggucauaagccauugcugcaagaagaaaguuuuccauuccagcaaaaaguaggacaaagcuaagcuggguaaugcagccuguguaacugauggauuugcucuguuucugaagguuugucagcaucuuaggaacagugguggugcugaagcagauaucagugaaggacagguuugagaggaagaaguacauuggaguguggaggugagcgucagagacaauggccaggaugaugagcagguucccagagacugucacuagguacauaagcaggaacaguccaaagaggaugggcugaaguucuggauccucugagaggcccaagagaaagaauucuauuacucuugucugguuuucuaauuccaug

SEQ ID NO: 4931 - RNA, 938 nt, Mus musculus
aucacuuuaaaagaaguauucucccaaguguuuuuaaggccuucuuaaugucuuuguuccucaagcuguagaugaaaggguucagcaugggggugaccacuguauacauuacugaggccaccacgcccuucccagaggaggaaguagcaucagaacuaagguacacacuaaggccugucccauagaauaaagaaaccaccgauagaugagacccacagguagaaaaugcuuuauauuuuccaucuguugauggaauucucaaaauugaagaaaaaauuuuauaguaugaauaaaggaucccugagaaagggaugaagccaaggacccauaucacaauauaaagaaggauaugauugauuaguguaucugagcaggcuauagugagggcuuuggcauauucacaguaaaaguguuuaauuaucugauuuguacagaaggacaaccgcagcaucaauagacucuguaucagagaauaugaaaagcuaauaaaccaugauacaagaacuagcaaaccacuuaguugaggauucauaaugacugaauagugaagugggugacagauggccacaaaucggucauaggccaucacggugaggagaaguguguccaugccuccaaagagcaugaaaaaauaaaucugggugaugcauucugcauaggagauggacuugcucuguguuuggauauucaccaacaucuuagggacaguuguagagaugaaaccaaugucagaaaaggacagguuagauagaaagaaguacaugggaguaugcaggugagagucaaugcugacggccagaaugaugagaagauucccaagcacagcgaccacaaacaugagcagaaacaguccaaauagcauggguugaugcucuggauauugggaaaaccccagaagcaaaaauucuaaaauauuuguuugguuuucugguuucaug

SEQ ID NO: 4932 - RNA, 27607 nt, Mus musculus
ccaaucgagaaggccguucucgcucagaaaucuuguucaaacuucaauuucauucuuugacugggcuuuuaaccuccgcuucagaaucaaucggcauccaauuccggggaaccgaaauuucaauuccggaaggacucggacacgguaaacggaagugaaccgcagcucgccuccgucucuuccgguguggcuucgugcggcccccuucucuuuuucucgguaguagcaggccggcugggcggguucuggugaggcuagguaaggggaugggcgguggcggagguggggagugaggccuggguguggccuccauggcgacuccgcugguucccaggccgcgagucucgccccguugcuucucagaggcuagggcccugcacuucucaggucccggccgggggccauuucaucggaacgauauuugagcuccccgugccuucgaauguagcccuugcugccucgaacgccuuuaagguaaucguacaaaauuuuugccuuccagaaagaaggauuucggccguuggaaucugucuucgcgccccaucgcuccaggaaccuggccaucccgcuucauugugagcaguggguggaauuugauggagcaggaaagucccagggugaggagcuucuguccguucucauuuccuccacagucucucucacuaucaacuauuagaauuuaguugcuuucguggaaaccgaugcauuucauuaguucuuucuguuucucucucucucucccucccuucuucccuccaucccucucuugcacucucccuuucuccucuccccucucucucucucccccaaaccucaugcauccauuuugagaaaguguuaaaugcucaggccaugcauauuuaucuguuugcagaccacaaaccaucccuuaccccuucccuucaucccaacaauaaaguauuaacaagggaaaaauagggaguuuggcacucaagggauggcucaugaaaaacugaaacuugggacuggagagauggauuagugauuaagagaccacaugucauuucuagaggaucagauuuuaguucccagcacccauguuaguggcguguaacagccuguaauuccagcuaucugggaauggggagaccagagucucuaggcacuugcagucaugugcgcccccccccccuuaaauaaauaauagaacucuguuaaggaaugggugaggcuuuauuugauauguuauuucuccacuggugaaaugagccaauucaagccagauuagaauauuagagcagguuuauugggacgcugcucucuggugaguacauuggccccaaggauagaggccggggaagucauuguguggaguggggauuggggggugggcaggagaaaaggcaucugugggcagagaaagaaagugggggggggggggagggaaggagagagagagagaaagagagaaagaaaacacaagaaaggggagaccaaaguguuugguuuauauagggaagagccuuugugggaagggcagcccagucccuggccuggaaaguucaggguugggcagggaaugccagguaggaacugagggauucugggagaaccuggaggccaggucugcuuugguguguaugauauguaccucagucccuugucuccgucugaagccaaacaguauuuuucuaaagucguaugauauuugaacauaaugcuuuucuccugguuggguagcauguuucaggaaaacuuaaaauuuuuaccuuuuguuuaauugcaggaaaaaauggguuucauuauauguucaugcaugcacauuguauauuucgaucguguacucuguugccucuucuuaucuucccuuuugucagauacucccucauauagguuuauuggggcuggagagagauggcucugcuuuuagagcgcuuguugcucuugcagaugaccuggguuuauaagauggcucacaacccucuguaauuccaguuccacaggauuggacacccucuuuuggccucuagggccaucagccucucaggugggcacauauauacaugcaggcaaaacauuaggaaauauauuuuuaaaaagacguauguaugcaugcaugccuuuccuuagaggccagaauggcguggucaccugaagcuggacuuagagguaguuuugagucacccguuguuggugcuggaaacuacucuguuuuucuguaaacacagcaaucacuuugccaggcucuacuuuuaaaauucuuuuauugcuauguuuuaaacaaauuuguauguaugggguauuuugucugaguauaggccuguacacccucugaguagaguuuccuuggaggcaagaagaggguauaauauccccuguaacugaaguuacagauugucaugagcugcuauguggaugcuagaaauugaauccugguccuuugagagaacagccagugcuauuaauuucugaaccaucuuuccaucuccauuaugacuauuuuauuuauucauuuuugagacaaggucuguagucuaggcuagccugguccucacuguguagcccagggugucuuuagugcaguccuguuucagccucccuagugcuacgauuaccugcaugcgugaaccaccaugucuggccuuuaaaaagaaaaaucuagauuucauuagugaaaacauagauuuguuggguuacuugcuuaaugugaucucuuucuauccauguaccaagcucaaccauuguaagaugagcauaugugaaacuuugugaacuuuaagauccaacuccuauggcuacaucuuacuaaagucacagcagugacugagucugagccugaggaagaugauagcuugaauccuugagauccgggcuagcugggacaacagaaugaaaugccuccaacaagaaaaacugucaaauuaaugggaacaaaaauguuaauguauggcugagaaagccuagauucauugaaucacaguggaguggagcacacuugcuauaggcuguaagaauugggaugguaguaggccaacacugaacaagacaccgucuggugcucauacugauccuaagcaguggaaagaacaggaagggaaauuagguccuaagcuguuuggucuuucucauugugcacuccaggguuuggaguagauuguugauccuaagcaguggaaagaacaggaagggaaauuagguccuaagcuguuuggucuuucucauugugcacuccaggguuuggaguagauuguugaugacaaucgagaaacuuacuagcaaucugauggcugucagcccuauuuagugaacauguaauucagugaagaugccuguauuuauguagaauacaagucuguugaaaguuacacuucaaguaaagucucaaucagaguagaaaauaauuuucacaacuuucaagaaacccuacuucacauuuugggagucagguacuuagcucauuauagauaaaccagcuggggaccaaguaccuaacuaugugagucuaugggggauauucucauuuaaaugagaauauccacuacauuaaaugagaauauccacuacauggagggagcauguuguacacucacaaacuuuacuuacguguugaaauccaaagggacuuaguuuuagaggcauguucggaccaucuugugcuuccucuuucccuuccuuugguagaugucagggugcuagaggagagcaucucuuaccagcaacuguggcugcuucaggaaugaaucgagagacuauaaugggauuucuugagacacacggauggcugugcugaguaccaugugcgauacacccguggaauguuuuaacuuuucaucccuagccagaaugucucuaguaaaguaaaggguaaggaccuaaccagaaauacauaccuggcaaaaguugaagcaaucauuucaguacuuauugcucugagcaacaaauucugagaucuuccaagucauuaauaaauuacugaaccauugccuaagaguuucccuguuuccuccuagauuucccaccacuccaccccuuucucucuuuagaaagcaaaaggaccaauaaacaaaccaaaauaaugcagagccagagcaaaacaaaaggcgcggaaagcaccuguacgcccacagaggcugcacacccagauggguggcuuccugauggcccauuaccuuuuaguucuguaauaggaacccugggucagucuuuccucacucuguagcugcucccugccagaagcuuuucaguuucaugaagccccauuuauuguuagucucagugacuguaauagcaguguccuauucagaaagucuuuucuugucucaaugagguaaagccuauucucucuuauuauuccuuauuauuucuaauaaugaaaguucuucuauuacaaucaacguaucuggccauaucuuaagguccuuaauccauuuggaagugauuuuuuugcaggaugauacauauggacauaauguauuuuucuauaugcagccaucuuguuuaaccagcacuauuuaucgaacaucuugucuuuuuucuaguguauguuuugguuucuuugucaaaacugaguguccauagguaugcgaacuuacguccaugucuucaaguccauugauuugugugucuuaugcccaugccauggaguuuucauugcuauagcucugcaguaccacuugaaauauggaauggugauccuuccagcagcuucuuuaucacucaggguaguuuuagcuauccaggauuuuccuuuguguuuccaugugaaguugagaauuguuuuuucacuuucugugaaaaaguugcauugagauuuuaauggaaauugugucgaaucuguaaauggcuuuugaugggauggcucuuuuuacucuauugauccuucugauucaugagggaucauucagucuuuuagcaucuucaguuuuuuuuucuucaauaucuuuagguuuuagaacucagguacuugcuguguuagacuucuuccaguuuuuguuauuguuguuuuuugaugcuacugugaaagguauugcuuuccugauugcuuucucagucaguuauauaaaggcuacugauuuuuguauuaauuuuguauccugauacuuugaaaauuuauuagcuuuagaaguuuccugguggaguuuuaaggucuuuuauguauaaaguauuaucugcaaauaaagauacuuugacuuucuuuuauaucugucuccccuuggucuccuucuguugucuuuugcucuagauaagacuugaaguaagauugaauaucuguggagagaguggacaaucuugcuuuguuucugauuugagaggaauuacuuauauuucucucaguuuaacuugucauuagcugcaggcaugcuguaaguugcuuuuguuauaucuuguuacgggaaauauuaaaaaaagaauccacacuauugcuggcauugcaccaaugggguggcuggccaggcaauggcaggcaguggcuggccuguucucaucuuguggagacucagagcuccaaaaucucuccacccaguucucuuaaguucccacuggcaggucgcuaucacaucagccccaugcuucaaaacucccuuggccuuuuguggugcacuucugacaaacccccaguuugcugcuguaccuuucucucuggaauccaguugaaggaaaauaccacacaaacuuaguucagaaucaguaguaacucaaucgcugugggugcaucagcuagaauccuaaucuuguaagccauauuaaaucuaaguccucugguggucaggagacacuaguagcuauggcaccauccugcgcuauacccagcuacucucugccugcagucucucuaccucuaggcuagcccuaugcgguucgccugccucagaaccacuuguaccuucucagccaucuacccucugcggcuaguugucacaaauccccuuaacccaguaaaucaaaacucuagaagcuuauaaucagucagauuuauauaucuauaaaaacucaauucacaagaugcccacacaguuaauuucagagccaauugauaaugauacaagcugcccaccuagauuaggcaaguuaucccaauuauucuauccuuuuaugauauucauagguaccuguggcuacuuaaagccacucggaaucugggucgccuuccucuuccuccauuuuccuuccuucuccucuccucucccagacuuuucagcuccaccuucccuuccacugccuaaucaccggcucuagccuuuacuuuauaaguugagguggggagaagguucacaagaagucacgugugugcuugauuugcuccuuguccuuugcccuccugagaaaguggaauuagcaucaaaauccaagcaaccuugggugcuauccacaucaauaguguuuguaucucugcucuccagggcuucugcgugaaggauggauguguucaagaccucauccuucaucugaggagacgauaaugugguuuuuaucuuucaaucucuuuauggugaugucuauugauuuguauauguuaagccaucccuguaucucuaggaugaggccuacuuaaucaaguuagauaauuuuguuuuuuaagagagggacucuguguaguccugguuauccuaggacucacuguauagaccaggcuguucuuuuuuuuuuuuuuuuuaagauuuauuuaauuauuguaaguaaguacacuguagcugucuucagacacuccagaagaggagucagaucuuguuacggaugguugugagccaccauguguuuguugggauuugaacucaggaccuuuggaagagcaguugguguucuuaacugcugagccgucucuccagccagaccaggcuguucuugaagucucucugccucuaucucccagcugcugguauuaaacagucuuuuugaugcauucuugaauuugguuugccaauauguuauugaauauuugcaccuauguucauaagggauuggucuguaaguuuuuaaaaaaauuuuuuuuuuuuuugagaggcuggugcauuguuuugguaucaggguaacuggccucauaaaaggaauuagaaaaaaugcccucaguuucuauuuuguggaauaauaugaggaauauuagcauuaauucuuugaauucaguuugguauaauucugcacuggauccaucugguccugggcucuugugguugggagucuuuuaguuacaacuucuuggaucuugguuuguuuaaauugcuuauuugaucuugguuuaacuucuguaugucauaauaugaagaaauucauccauuucuuuguauuuuccaguuugguggauuacagcuuuuuaaaacguguuuuuuuuuuuuuuuuuuaaacuguuuuccagauuuugucagugucuguuguaauugaguguaaaaaagaaacaaaaaggaggacaugccugcuccuaagugguugagcuuuauuuuuaguauagcuauaaggaagaaacaggcuggaggggcccgagugaacauggccagacugagcagggccaugugaggagagagggaggaaaagccaagagaggagccacaaaccaaaaggggcagccuuggccaagagacuaguguaguuaauggcugaguuauauaggggccagaggagcuggugggggagggaagcccagccuuauaacugggccggaaugaguucaggauaggugggcuggguuugccagccaggagaaccuguaaagggacugaaggaugcugggagaaccuggugguuuacuugauauguuaauaggcaccucaguuaacaguuugucccagguuugagacuaaauuguaaugccugucuuuucaugucuaauuuuauuaauuuggauuuccucuucauuuuuuaguuaauuuggcuagggguuccuagucuuguugauuuuuaauuuuuucucaaagagcaaauuauuguuucauugauucuuuguauuguuuuuguuguuauuucuguuauaacccagaguuuggccucuauucuuuuuggguguaauuucuuucuuuuuuucuuuucuuccuaaggcuuucagguguauuacuaauuuacuaauacaaugucuaucuguuugucugucugucugucucuauuuuuuugaggcaucaucucuuucuaguaguccugaaacuugcuuuguggacugggaugcaauugaacucuccaggugguuuuuuuauuuuuauuuuuauuuuuuuuuauguagauagugcuaugcacuuaccucuuagaacugccuucuucuaucccauagauuuggguauguuguguuuuuauuuucauuauauucuaaaguuuuuuguuuuuucuugcccuuuuuuuuuuuuuuuuuuuuuuuuuugauuuguuuagucuccaugaguuguaaacuuucuguuguugaugucuggcuuuaauccaugguagucagaguguuugcauuuuuuuuuuuuuuuauaucuugucaaguuuuggagaaaguucaaugagcugcugagaagaaauuguauucguuuguguguuugggugaacuguuuuguacauguuugcuagguucauuugaccucagcauuucucuguuuacuuuucaccuggauggccuauauugaugagaguaggguuugaaaucaccacuaccagugugagggucaauauguaauuuuaccuguaguagugcuucuguuacaagcuugggugcccuuguguuugguguauaauuguuuagaauugcauuauccucuugguguguuuuaccuuuaaugaguauguaguguccuucccuaucuucugauuaguuuugaaaucuuuugucaaguauuaaaaucuacaugacacaccagaagagggcauuggauuccauuacagaugguugugagccacuaugugguugcugggaauugaacucaggaccucuggaagaucaaucagugcucuuaaccgcugaaccaucucuccagcccuucuaugugcuucuuguguccauuugcuuggcauuccuuuuuuuuuuuuuuuuuguauuuauaauauuuuuauuaauucuuuggaaauuuuauacaguauacucacgcugcucaauuccuugaaagaccacccuuaccuaacuacccauaccuuacuuccugucauuguccuccuccuccucuuccuccuuuuuaaaaaaaaaaauuuuauuagauauuuucuucauuuauacuucaaaugcuaucccaaaaguccccuguacccuccccugcccugcuccccuacccacucacucccauuucuuggcccugguguuccccuguacuggggcauauaaaguuugcaauaccaaggggccucuuuucccaaugauggccgacuaggccaucuucugcuacauaugcagcuagagacaagagcucuggggguacuuuauuccuccuuagaauagggaacaaaauacccauggaaggaguuacagagacaaaaguuugaagcuaagacgaaaggauggaccauccagagacugccccaccuggggauccaucccauaaucagccaccaaaugcagacaccacuauugcauaugccagcaagauuaugcugaaaggacccugauauagcugucucuuaugaggcuauguguugccagugccuggcaaauacagaaguggauguucacauucaucuauuggauggaacaggguccccaauagaggagcuagagaaaguacccacggagcugacggggucuguaacccuauagguggaacaacaauuggcauucccuuuuauacccuuuacccugauaugaugucuauccuugaugguaagauguguuucuuugggcuggugagguggcucaguggguuagagcacccgacugcucuucugaagguccagaguucaaaucccagcaaccacaugguggcucacaaccaucccuaacgagaucugacucccucuucuggagugucugaagacagcuacaauguacuuacauauaauaaauaaauaaaucuuuaaaaaaaaaagauguguuucuuugaugcagcaggaggagagauucuauuuucuaauccauucuauuagucugugucuagguaguuuauucugguguuuucuugaguguaauuucuucacauucaaguuuuuuuuuuuuuuuuuuuuuuuuucucagugcccugaguuguuagauagaaauugcuuaaauuugguuuuauuguggaauauuuuucuuucuuugucuaauaugauugguaguucugcuggauauaguagucugggcugacaucuguggucucucagaauuuguagaacguucauccaggucuuucugguuuucagagucuugagaagucaggucuugugggcuagucuuuauaugucacuucaucuuuuucccuugaggagucacuaucucggcauauuuggcuucuuuugguuugguagguguacugccuaguuuugugucaacuugacacagcuggaguuaucacagagaaaggagcuuuaguuggggaaaugccuccaugagauccacuuguaaggcauuuucucaauuagugaucaagggggaaaggccccuuguggguggggccaucucugggcugguagucuuggguucuacaagagagcaggcugagcaagccaggggaagcaagcuaguaaagaacaucccuccauggccucugcaucagcuccugcuuccugcccugcuugaguuccaguccugacuuccuucagugaugaacagcaauguggaaauguaagcugaauaaacccuuuccuccccagcuugcuucuugguugugauguuugugcaggaauagaaacccugacuaagacaguagguuaauuucugucuuuugccucucaguuuuuaauuuuuggguaucuuuguuaguguuaugaguuugggguucagagauuugucagucugacuauuaauaaaauuuaaaaaagaagaggcuuuuauucaaauacuagugccaagucuacacaaaggaguccuaaauacagcaccuagccaccucauucagggguuuauaaagacaaagaauacaaagauacaauguuuuccagcaagcagaaguccuuuuuuuuuuuuuuuuccaaaauaagcuuguuuacagaagcagaauagcaguaaaaaacccuuaagaguaaccauucgggccuuuuuuaugcccaccucaguuccugaacaaugacauggaggcuuauuuauuugugaauuaaugccuaggccuuaagcuaggcuuguucccauccagcucauaacucaauuaucccauuuauauuaaucuaaagucugccacguaggugguuaucucucuucaguugcagcuuccuucacuuguuggugaaucuucccacaccucauucuuucccagaguuccucucucugccagauguacaccuucuauucuuccuuuuguuguaggccacaggcuuuuuuuauuuuaaccaaucagaaggugccuaaggcaggcaaggaaggacagauagauuuucacauaguguucaaaaacaucacucuaacauguaacagccccuaacacuuggagguguaguuuugcuuuauaguuaguucuuuuaagcacagagauuuuaaaguuguagauaacauuagcugggaguauuggaaaauguguguucuggcaaauagugguuaaugaucagagauccaaauuaaugguacaaaugaauggugucaacauagaagguuugguggauauaggagcugauguuaauauacuuucccaaaagucuuggaaucuagauuggccacuucagaagguuuacacacaauuuauaggaauugguaaauuaucaugaauaagacaaaguguccaauggauuacuugugugggaccagaagggcaaauggaaguuaagaccuuauguggcugacauacccauaaauguaugggaagggaucuuuuacaacaaugggguacucaaauuaauauuccugcaauuccagggacagcaguaaggaaaucagaggugauuagguugaugcuucuggggaauguacuaacacggguaacagagaacaaucgcaggcugugccugcccauggucaaaaagcaggacagcacaggucaaaaagggaccgcugcaaacauacugcuccuucauguauaugccccagcaaaacaucauccaaccgacuuuccaaagaacccuuaaguuuccacuucaauuagccaucagcagaauguuagccaucacauugguuagguuuguuuuauggagacaacagauaguuucucauauagacagaaugcaccuuguugagcuguagccauuuguauuuauuugaggcuaauacugagagggauuucauauuuuuuaucauuuuuguugauuguuguucuggcaacccuuuccccaaauugguauuaggaguuuguuguuuuggauaggauggauuucuuccugguucuccuuuguugauggauauauucgucugaggcaauguuuucuuucuuaugcucuuguagaugacccgucuucuauauagauuccuuauuucugcagugugagcuugguugugagauagauucuaucuaucuaucuaucuaucuaucuaucuaucuaucuaucuaucuaucuaucuauaaauauaaauauauaauuuaugcuugucucaaaauguuauuucuauugguuuuugcagggcuagagagaugacuuauugguuaagaguuacaguugccacggaccuggauucaguuuccagcaaaguucccagugccuacauugugguuuauaacaauccauaauacuaguuccagauccuuucccacccuccuugggcuccagacacucauggugcacauacuuacaguuagacaagauagucauacacauaaacaugaaauugguguuuuguuuuguuuuguuuuuguuuuucaaggcgggguuucucucuguagcccuggcuguccuggaacucacccuguagaccacagacuguucuggaacuuacagagauccaccugccucugucucugccucucgagugcuaggaaggugugcgccauccaucaugccuggcugaaauauuuuuuaaaaaucuuuuuaaauauaguaauacagacuacaggauacagacugaugcagccuacuguggguggugugguuccuggggucuugggguauauaagaaaucagagggggaagccagaagcuagugacaaacagcagucuuccaugguucugcugcagcuccugccuuuagguucuugccuugaguuucugcccugacuuuccgaauugguggacuguuuguuggaaguguaauaugaaauaaaacauuuccuccccaaguugcuguagaucaugguguuuuaucacugcaguauaaacccuaagaugguggguuuuguauguaugucuguauauuguguauuucuugaugcccaaggauagcagaaaaggguguuggguccucuaggacuggauuuauagauguuugugagaauugaauugugcugggaauugaacuuggguccuaaggaagaguuauuuucugagccaccucuucaguccaagauguugaauuuuaaguaacucaugugccuacuuuccugaguucuuuuuuuuugguuuuucgagacaggguuucucuguauagcccuggcuguccuggaacucacucuguagaccaggcuggccucaaacucagaaauccaccugccucugucucccgagugcugggauuaaaggcgggugccaccaugcccggcuuuccugaguucuuuauauguuguuuauuacagaguauaauuuacgugagcauacacacacacacacacacacacaaauauacaaaugcauuaauaaaaaggcucugguguuacucagagugcuguauuaguuacuuuucuguugauauaagaagauguuaugaccaaaaucacuuaaggaagaaagcauuuauuuggccuauaguuccagagggaaagaguucagguaauagugcagaagguaaaugaggagcccaaagauuacauuuucaugugcacacagaugagagcagaggaagugggacuagguuuauaaaagcaucacccucagugauguuuauucucaagcaaagauccaccuucuacagcuccauaauuaaacaggccugccagcuggggaccaguguucaaauacaagugccuauagagcauguuucuuguucacacggcaacaaauacauacaaucccucagucagugcaggugcuguuagugagcccacauuacaggguauacauuuuuaaugguuuucaugaccuuaccugcagagagcuagucuauaauguuugaugacagcuaacucugcuuuuugauugaucucaauaggaauuuaagucauccagauuaaggagaaugaaucucgucauuuuccacuuugaugcauaaguuucccugacguguccuuggaaucgcagaagaauuuggucacauauuuuaccaucagacuaaagagauggacuugacuaguuuguccugugguaaguccuguuacugcuguuauucuguuguagguccugccugcacaauauagagccagagaucugccagucuguuauuuagugcugaggugggcugaagaggacuuguuuuguauaucuagcaugugcuugggagcaggcacugcauaaucaucacugauacauuuauauauauuauuuauauauauauauaauauauaaaaauauuauauauaauuauauaaaaucauauauaauuaaauauauaauuauauauuauauuaauuauauauaaaauuaaguauaugauaaauuauauauaauauauacauauaauuuuaaucauaggcaaauuaagaguuauaguucucagaaguuaaguuucccuuggcuuuaaugugaaacuaaugcacuuuuuuuuuucuuuuuuuugguuuuucgagacaggguuucucuguguagcccuggcuguccaggaacucacucuguagaccaggcuggccuugaacucagaaauccgccugccucugccucccgagugcugggauuaaaggcaugugccacccugcccagcucuaaugcacuuuucuuaaugggcaagauaguuaaucauauuuucuugcuguaaaaauugguauggcauuguagguuacggggguuuauaucuugagugaaccaaguuauauauuaguugcaaaaagauaaacucccacccucacagugaaugugggcuucuuggcagcuuuguauugauguaucuuuuauuauuuuauuuuucaagaaagucugcuuucuggugaccagaacugcagucaaggagaagagacagagggagaaagcaugcuggcugauugccugaaaaacuguaauaagguaugaggaacuauugcauccgucuuuccauguagacagacuuaucucccaggauucccgagaaggguaaagccccugacgaggacuaauuauccagaagaggcuuuucacauugcuauaaugcuguguuuauagucauuccuaguuagucuugaccauugcagugccaaauaccaggggcuuugacaguguucuuaaagauaauaaagcauacauauuacucuauuaaaaacuuuguuuucauauuuacccccuuuauaaaauaugucuaggaguaguauuaaaacaaagagagaagaugaaaaagaucaggguguggugagguaaaaauguuugaaaugugcccuuaaaaccacucuauuagaguagauggauggagagugugggucccaagagacuaugggagaccucacgcucucucuaggcauugaguucucuauccuuaguccuccgagaggacugguggggauauuaacuuggcugaaacaagcaugugggggugguuuaggauuuugugacuuuucaggaugaggcuguggauuucucugaagaggaguggacuacaaaggcuccaacucagaacagcaagccuggugcuguggcgguggaggagcacacaagccuggccgcuguagguaaguugguaguuguuugccuaugaugcuucauguggagcagguacagaugauguacuuagugugcuuaggaaccuugucaaguccaaugcgauagauagcaguaauaacaguuuucuucuaauguauuuaaacuaacauguuaguuuaauucagggggcaucuacaucaaacuucaguaccuccuauaugguguauaugcuucaucacugagcugcaggccuggcacacuguggguuggcuuguuuuuugugugucugugguagugcacaccuuuaauuuuagcacuugggaggcagagacaguuggauguuugugauuucaaggcuagccuggucuuauagaguuccaggacaaccgagugcuacucagagaaacccuaucagaaacaaaagcaaacaaaaagguuuauuuuuauuuauuguuuuuuguguauaagugcaggugcacauaugccaacagcacauauguggaaaucagagaacaacaacuugcuucucugugcucaucuuguuguuugaggaagggccauugcuauuuuugccacaguacuucuggcugguuguccaguuucugccuuucaucucacuguaagaaugcugggacuaggauuacagacgugugccauugcaguuaauuuuuuacuacuugguguccuaguuuacucaauguugcuguggcaaaaccccgaguaaauaagcaaccuggggaggaaaagguuuauuuggcuuacagguuauccuccauccagggaagccaaggcaggaaccuagaggcagaaccuggaacaaaccaugcuugcuggcuuacucccuuaggcuugcucagccaccuuuauucugaccuggcaggaggucugcaucaguuaacagucaaauaaagguucuauagacaugcccgcuggccaaacugauggaggcuauucuuuaguugagguuccuucuuccccagagugacauugacagacaagaugugaguucugcuguugaacugagguugucaguguuauuuggaaagcuuuuguaccugaugagcuaucuugaugacccacuguggugcuucuuaaaaugugcguaaccuaguucuguugaaaaguauguucuugucuccaucuuugauuaaugggauagcacuuucuaguuaguauucuauuucaugacuaucugaauuugaugaacuauuauauuuguaaguuaaugguuuacuuuauuccuuagcaaacauuguagugauucauuuugucagaaauguuaauauaaaauuaauuaauauuuuaguggugagagauccuugggaucgugggauuaaagccuugucucuuuauccuuuagaaauaauugcugcacuuauuagaauuauggaccgaaaaccagguuugauugugcaugccuguaaucucaguaggcuuacaaguuuuagggucuagcuuggacuacaagagucccuguauuggggaaaaauacauauuauagacuugaaucauagaaaaguuugcuauuuguucuauucaugcaacuuugcauauaggauaucagacacuuaucaaacccagugcuuugacuuguugaaagcaguggugagcacauuggagggaguucuucaagguggaugcuuacgaagagcagcauugacuaacggcauacaucauugucaguuccucucuucucuuugucucaaauacuuuuucauuuucuuuuucuuuuucucuuuaugguauagucuaaguaguugauucuccuccuuagacuccuguguacugggauugcugauguucuuaccaugcucuacuuucauauuucuucccuuugcucucugguaacauguuuuuauuuuauuaccauguauuaguuuuggcagaauuaauaguuagcauuuuuucucucuaaaucuucaguuugcucauaagucagauuuauuuaggaaacgauggagacauuuuuaacuucuuugcuauacuguuguuacuuaaaccuaaucuuggguuuaauucuagaauuggaaaagcaacuacaaaccaaagauuuagcaccagagcaggauuuuuugacaagacacaccuucauggagacacagcagguggugaguucaaggaaaaggauauuuuuuuauuuuaugcacuuagccaagauugacuuuuuuuuuuuuuaauuagaagucauggagagaacuggguuuuucaguagaaggaacaaucucuuauauacuucagaagaugaguauuaagaggauccaaaauuaaagugaaacugaccaagaaggcacauuuucucauguagacuugcccucacagcaaaacaaaacagcaaaccaaaauuccuugccaugacugauuuuuuuuuuccaguugaauugcuccagaaaggcuugugucuuacuuacacuggugaggaaguccccuaaagaucaucucaggauuuuaguaaccauugguauuaauuucuguuagugauuuuguguucugacaaaugguaaagaugaaagucuucauuuuuaaaagaaguaaacuuauuuuuaaucacauaacaaguuugaaauaugcuugggaaugugccacaacauaggggguacgauagaguuccuuguauagugauguaagcuuauuugcaagaggugcagaaauucaugaauauagaaggucuauugagugacuguggauagaggaaugcucuaggaguacugagaccugaggagauagauuauggggacuuagucucuuuuaaagggaaggaugucacuuccucauucuccagugagcauaggugauguuuacuuugcucaagcuggcauuuuugugacgguuuaggaugcagugaccuuugaagauguggcuguggacuuuacccaggaagaguggaccucacuggacccaguucagaggaaccucuacagagaugugaugcuggagaacuaccagaaccuggccacaguagguagggcugccaucccuuguucuagcuucauaagagaacagaaauacuguucuacaauauggugucagcucagagaucauugggaaauggcagaugaagucccuuaacauaauuuaauacaucaugguaguucucaacuaaauggugguuaguagugucacuacuacuaugcuaaucauauaauuuugagauuuuuccucuuuuugauuuguuuuguuagugaggaaaggucucauccuauagcuuagguuggcuucaagcucuuagcacuucuccgaucucagucuucugagagcugggauagcagaugugggcuaucacacauggcugucauuuuuggcaaucuuuaugaaucuguuucugaagauaagaacuagugcuaucauuuuuuucccuauaagugugaagacccaugcugggcacauuucuguguuguagagugcuuguuuagacacaugaggccuugaucuguaucccugggggugagggugggauaacuuuauaacacuuuaguaauuaaauaauacuauauuagaucuuauugggaaaaaugguucagugcacuuuguuuuacauuuuuuuaagcauagaauuuuuauuaauaacgaaggaauagggauauugcaugucauuaauaguuuauuuauuuauugauaguaguggggauaauuuagaacuuuguacaguccagguaagugcuccacuacugagccauauccuuagccauuuuuugguuucuugagauaggucucacucuaguucuauagccaugacuaucuuggaauucuuguuuuucucuugccucagccuugugaguguugggauuauaucugugcacacacagucuugguccucccuagugguuuuuaaaugugcauuugguucuaaauuuggauuugaugggucauagaaauuuucuaguuaccaauagcauaaauauuuguauucugagcucuuuguuaauaauuuuaagucuuucuugagacauguuuucuauuauuggugaguuuacaugagucuuuuccauugauauauauuugucucugugucuaggaggucagauguuuaaacccagccugaucucuugguuggagaagaaaguagaguugacaguaauagagcaaggaauucuccaagguuaguauuuguugaaaacauuucuuguugaugucaaauucuguauguuuggaaauguuucgagggaacuguuagaagaccaucuugaaucugaaguccaaggucuuagaaacacaguugucauagaaaaggccaaucuaaagggucugugaugucccaguuuauuguuuucuuuguuuauccuguuuacuaugccauuuaauuuuaauagaaagauuuguaaauuauuauagcuaugauaccauauccugugcuugucaaauuuuagauuuagacaguugcuuuauucucucuuaguuuuguuguuuaauguauuuuaauaugaaaacacacacacacacacacacacacacacacacacacacacacacacacacacaaguaaaguuuuggucuggaacucaguuuuauagaccagacuggcuuagaauucagagaggucugcuugccucuggcuccugaagguguucaccaccacgccugaccaaaugagguagagguuuuggcuguucuaaaaaauuuaaccuuucauuuguugugcaaauguguacauacacuuuuuuguuuguuuguuuguuucacuuuagaaugggaaaugcaccuuaagacaaaaaggacagcacuucagcaggauagauuuuggucagauaugucaaaugggaugcaacugguaagucucauaaauguacuuuuauguuuaugggugcuuugcccacacauacaucugugcaccaugugcagugugcgugcccuuggagaacagacaguggcaucugauucuuugggacaggaguugcagacaauugugagcugcagugugggugcuugggaacgaaccuggauccuuuggaagagcagcaaaugcuuuuaaccccgaaaccaucucuccagcaccaggauauuucuuuuuaaagaaauauuuuuauuugaggauaucucuuauuuugauaauaaucaacucccacuucuccuaacuccuccaagaucucgcccuccccccccccacccccccaacgcuacauccuuuuuuagaaucaauuugaauuugugcuagccaaaucauuucuugguguauguagggccauccacuggaaugaccuacuaggagccacacuccugaacucagaaaucaucaguugucuguaguuucucagucagggguuggggcaacaagauccuaaugucuaaggucagggaaaauuuaauaauaaaaauaauuuaauuuaauaauaaaaacagauccaaaugaaagaugugagacaauuagcugucaacaggcauggaacucuuuaaucuuuccuuuuuccauuacuccuuuuuuuuauucagagagagcacacuaccacucaagguagccuucucuugugacacuugcuucagcuuccagaaugcugggacaguaguaagucaggauacucagcauaaagugaugccccgaaugcauugugagguuuagagcauccgaauuccacaguuuuaucuuucuguacaagccugaccuucuaaucaucuuuuuacccuuuaucaauagggaagagagcacaguggaggggaaccuggugacccuguucaaguuggagcaguuuuuagugaagauucaugcccucaaacucacaguaguacuucaaauacagggaacacuuuugcguguaacuuagauggaaaagacuuucagccacuccuuaaagaaacuucuacugaagagaacauuguccaguugaaccaguguguaaaaccuuugauuuucacuccagauguuucccagaaaaagugcacuccggaaaaaucuguugaaugcagugacuguggggaaacuuucguuaaucagcuagaacuucagacacauaguucuucucaucgugaaaagaauauccacaaaucagaggaguguggacaagcuucuacucauccuauaagccauggugggcaugugauucccacugaaaaaaaauacuaugaauguaagaaaugugaaaaauuuuuuacacauccuguguaccuuaauauccauaugcaaagccacacuguggagaaacccuaugacuguaaggaaugugggaaagccuucacugagcgcucaagcuuaauugugcaucuacgacaacacacucgagagaagucuuacgaguguaaggaaugugggaaaaccuuuauucaacccucacgucuuacagagcauaugagaagucauacgggagagaagccguaucagugugaccagugugggaaugccuuugcgucuuccucuuaccuuacuacacacuugagaacucauacuggagagaagcccuuugaguguaacauaugugggaaggcauucacacguuccucuuaccugcuaggucacauacgaacucauacaggugaaaagcccuaugaauguaaaguaugugggaaagcguucaguggccguucuuggcuaaccauacacuuacggaaacauacuggagagaggcccuauccauguacagaaugugagaaagccuucaccagcuucgcucagcuaacugaacauauaaaaacucacacuggugagaagcccuuccgguguaaaguaugugcaaggacuuuuagaaauuccucaugccuuaagacucacuuucgaauucacacuggaauaaaaccauacaaauguaauuacugugggaaagccuucacugcacgcucaggccuuacuaagcauguacuaauucacaauggugagaagcccuaugaguguaaggagugugggaaagccuucaguacaucuuccggccuuguugaacauauaagaauucauacaggagagaagcccuuugaauguuaccagugugggaaagccuuggcucauuccucaucccuuguuggacauuuaagaacucacacuggagagaaacccuuugaguguaaucagugugacaaaacauuuacacgaucuucuuaucuucguauucauaugcgaacucacaccggagagaaaccauaugaauguaaagagugugggaaaacuuucccugagcgcucaugccuuacuaaacacauaaggacacacacuggugaaaggcccuaugaauguaaggaguguggcaaaggcuuuauuagcuuugcucagcuuacuguacacauaaaaacucauaguucugagagacccuuucaguguaagguaugcacaaaaucuuuuagaaacucuucaucccuugagacccacuuccgaauucacacuggaguaaaacccuauaaaugcaguuacugugggaaagccuucacugcucgcucaggccuuaccauccauuuacgcaaucacacuggggagaaauccuaugcaugccaagaguguggaaaagccuuuagcacuuccucaggccuuauugcacauauaagaagucacaaaggagagaaacccuuugaaugugaccacugugggaaagccuuugcuucuucaucuuaucuuaaugugcauuugaaaauucacacuggagaaaaacccuuucaguguacaguaugugggaaaacauuuacguguucuucuuaccuuccaguucacaugcgaacucacacuggagagaagccuuuucaguguauaauauguggaaagucauuuuugugguccucguaccuuagaguucacaugcgaauucacacuggagagaaacccuauguaugucaguacuguggaaaagcuuuuacagagcacucaggccuuaauaaacauuuacggaaacacacaggagagaaaccauaugaauauaaggaauguggggaaaacuucacuacuucugcugaugcuaaugaacaugaaacuccccacuggggggagaaccuuugaauguaagggauucagaaaauugauagcccuugauccaucauuugcaaucaaaauuuauagucuauacaagucuuauugauaagcaacguauaaaaaacauucgguugcuaugugcuguaaaaacaacucauucugaggaugcucugaguuuaaggauugugggagaaaucaaaauuucaugauauauguaugaacugaagguuuguaauauagggaacgaaaaccuuuaguguuucuaugaguguugaugcaagacauguagaaauguuucuauguucacguguggucucacaguugagaaaugucuuucugaaguuugggaaguaacuuuacauuugaacacaagcuacaugcguguaagaggggauuugcuucagugucuuggauggcaacacuuggcuuucuugggugcuucucuaugaacuuugaauauuucuccauuuguguauuuuuaugaccucaauuccauuguuaguuuuccuuuuuaaaauauuccuguuugaugugauugaaacuuguuuuuaucuaguaucuguuauaugucccauguuggcauugugaacuaaugacacaaacucccaucuccucacuacuuguuaguuuauuuguuguuguuuuuuuccccucuuuucuuuggagacagucucacuuucuggccuaguauaacaugaaaguuauguagccuagacuggucccuagcucauggcagucuagacccagccuucugagugcauagauuacaggugcaagccaccauaccuggcucuuucuacuguuuuaaguauaaacuucacuagcacugaaaaaaccaucauguuuuacaauuguguucagguucuuaacacaaguagguuuggaucugaccaauacaaucccuuacucugaguucuaagucuuugguagccauuccauucucugcuuggaguucagcuuuucuuuaggcuuugcuucuuagaucauguaguaucuguauuaacucuacuuagcuuuuuuauuuuugugacagggucuugcuguagcucaaacugaccucaaacucgcaaaccuuuuugccucagacuuacugcuagaguuauaggcaugugccuucaugccuagcuggcguauaucaaucuacauaauguucucaagguggaacuguguuauggucaguuauuuuaagacaucuaauuauccuuuggccucuauggauaguuaguuucuauaccuuguuuguuaguauugcuacauagcgaguguagcuaucucuuuaaagucaugaccuuauguucucagauacaaucccaaaagugacuuuguuacuguaaugacagauauugucaguguguauguaacaacugccaauuuauauucccagugauguaccuagucucuuuauugcuuaucuucuuacuuuuuccuuccuguauuccauuuaaaaaugugagaugguaucuucaguuuugauuugcauuuuucuaguacgccguuuguauaucucugcuaaaauacugauuucaguaauuuaucaauuuuuaaaucaagaucuguguauuuugcugugaaguuaccugaguuacuauguuuuagacauagacccauuguaauauauaugguuuacagauuguuuuuuuggcuguguacaugcuuuuucaguuuuuuuuuauugcuaugcagaaucuuuaguuugauauggccuuaauucuuuauuuuugcuuuuaaugcccauaauuuucaugucagcucuaaaauucuuugcuggugugucuggaagcauucuuggaguuuuauuauguuacaguuuuaaauuuuacuuucaggguuuuguuuguuugugguaaccuaacuauguaauccaugauagcauagagcaggcuggccuuaaacuuggagcaguauuucuuccccaggccuuuugagugcugagauuuuggguuugagccagccuauccaacuuaacuauauuucuuuuacuauuauuugauuuccuuuucuuuuuuaaccccccuaagcuuauauacgugcauacuguuuuuguuuuaguuacuguuacuguuucuguuuuggugcuaggaauugaauuuguggccucaaggaugcuaggcaggugcuuuaccaucaagcuauaguucuaacuucauuguugaaauuauguggaccacauaaagggcuuuuauuguuucauuuguuuguuuuuuggauaauaucuuuauaaucuggcuggccuagaacgugcuauguagaacccggaacucacagagaucuaccugucugccucccagagugcuggaauuaaaguuauguguuccuaugccugccauugacuauaugcuuauuuguaaacaauuuauuuauguuuuuguaucaguguuauacuguuugauuucugccuauauacugguuuuguuuuugcuguucuuucuuaagacaagguuuacuggagcuuagacugccuuugagauuaacuaaaugaucaagaaugaccuaaugaccuuggacuuuugaucuucuugccuuuaucuccuaguaugauucuaggcauguaccaccauacuuugcacgcucagugcuuaucaaacuucauacuaaguggacaucucuagcccuguaauacauuguuaagccuagaauuuuuguuuuuauuuagguccuuuugggcuuaacugaaagguuuugguuucuuaugacuuuguuuuuuuuuuuuuuuuuaagccugugggggaaaaugccuuuagaauuguuaaugcagugguaaucuacaaagcacuuuggguaggauggacauuguaacaaugguaauucucucaauguguguggcauaccuugcaaauuguuuauagacuuguucaugguaguuuagauuuuuuccuguuuaauuuuguucucuaucauuuuauguaguuuuauauguuguauaauauuuugcuuuuuaaauuuguaguauguaaagauacuguugacuugaaaaucuuauguuuuaugaguuuuuauaauuuuuuucauggaugcccuguuaaccugaaacaauuuuacuuuucuuauuugggugacuuuuuucuuauccugauugcuccagcuaggcuuuucccaguauuuccugaauauaagaaggaaagguagguacguaaaccugcccuugguaagucugggcuuuguaacugagugaaaacugaauuuguuuuucaugugcugucaugaugaaauauauuucuaucuaguuuauugacuucaguugguauccuaugauguuacaugauccuguacauuuccuauaauaauggacuuuucuuucauuuuguucguucaguauagcauaaaccaucuuugcaucccauuuauaaaaucagucuugaucacaguuuuuaugguccuuuuaaaaguuacauuaugaagugaucaggagauugaaauugucuuaauaaauaauaauuguuugacauugagacagagucuugcuguguaguccaggcuuggccuugaacucacuguguagcucaaacugacaucaaacuaaugauccuaccgcauuaaccucucauuuguuauguagcuucaguaaugacccacuaugcuugacugauaauguuuagaaagacuucucugugcugccaauaagugacucauuuauuuuuuagggcauaaauagaccaaaaaaaaaaaaaaaagagguaagaugguuccuucguugcaauggugugaugauuguaaagauauccuagaaauagaauacuuaaguguagaaagcaaauauuauuguauguagagagaaauagcaugguggaguauaagacuauuuuagcacucuuugacaauaaauugagauuaacauugaguuuuaaaauaacuaaggg

SEQ ID NO: 4933 - RNA, 4430 nt, Mus musculus
gcuuguuuauauaucuguguaucauguguaugccugguucucauggagaccaaccagaagaggguguuggauccccuggaacuggaauuacagaugcuugugagccaccaugugaguucugggaaucaaacuuggggauggggcuauggaaguagucagugcucuuaaccacugagccagcucucuagcuccuacauuugacguucuuauguaguauuugauauguaucacggcaauaauugauugaaauauacuuucagaucaugaauaaauccuagcguauaaagugaacacagugggagugggagauggcucaauggauaaagcacuugucccacagugugggaccaaagucugaaucuccagaacccaaguaaaugaggcgugggcaugucugcccacguguaauuucaacacuccgaaggcaggaucuccaaagcaaucuggcuagcaagagcagcugagagacccgccucugugaauacgguggagaggaagugaaaaagacucuucaugcugcccugggaccuccacaugcccauucaaacacacacaccguacaggacuacagaauuucucuauguagccaugacugcccuggaacucacucuguacaccaggcuggucuugaacucagagauccacuugucucugccuaccuagugcugggauuaaaggcauuggccuacugcccagcagacuggagucaauuuuuuaauaaugcuuugauacacucaaaacugagcacacugcacaaaccuagaguccaagcuacuguggaggcaggaauauuacuugaguccaggaguucaagccagcacagacaacauggugagaucccaucucaaaaaaucagccagugcugaaaucucauuuugcaugacgaugcauugaacuuccuccaucuuuaaaaacaaauacaggcugggcauggugcaugcuuugaaucuuucuuagcauuuaggaggcagaggcaaguagaucucugugaguuccaagccauccaggacuaccuuguaucuaaaaggaaggaaggaaggaaagaagggaaggaaagagaggaaagagggaagaaaggaaggaaaaaacauagguguguguggugaucagucccuuaacccuacucaagaggacaggacuuugaggcaauccuaagguacauagcaagacucaaagacauaaaagcuaggcguggcuuaguagcagaagugguuggaggccucuagcaagcacaaggccuuggcuuugaucuucagcagugcccaaaaccuacacaggaaugaagcucugacguaccuagugugugaaugaacacucccuucagcuucauaccugaaugaccuacaucuguuuggauuguauauucuauuugcauuuaugcucugauucauagcaacuucucacagaauggauuugccuugaacaaacuaaauaaaaagauacuaaaagagaaaaaggaugaaauaaaauuuaucauggagaaguaucugaaaccugcacacaauuuuuguuuguuuguuuguuuguuuguuuuucaagacaggguuucucuguguaguccuggcuaaccuggaucuugcuuuguagaccagagauccaccuaccuuugccucucgaaugcugggauuaaaggcaugcaccgccaugagcacacacuauaacagagccucagcauacaugcaauagaagaaugcacccauccacacccacucaaauuaucaauaauaagaacuugggcugcugagauggcucgaggugaggugauggauaaaggugccuuccagaacuaauaggaaggaaagagagaagugauucccacaaguuguucucugaacucuacauggaaacuggcaucgcaugcaugcaugcauguauguuuaagacuacucauacaacaaagccuauagaaauuuuuaaaaauugaagguggaguuagaagccaagaagaaaacaaaagaacagagaaaauacuuggaaacuaacuucaaaauaacuuacagagaacuuaaaauggugaaccagaaagaagguaugaggagaaauuauaaaaauacuuugaagugaccaaaaugaacacccagcacauuacaucgagguggucaaagcuaagugaguauguaagcuauccaauccuuauauuaggaaggaaagcuacgugugcucaggcuggugugacagcucaguagguaaaagggugcuugccacuaggccugacaaccugaguuccgucccuggaacccacacagugaaaggagaggaccaucucccaaaacuugucuucuaaccuguacaugagcaccaugguaaauaugcacucaugcgcacacacauacacacacgaauuuaaagaaaaaaagaaaaguuaucuacacagccagacccugccucagaacugaguucagauccccagaacccauguaaagcuagauguggcugccugaccccauauuccuaugggcuggugggagguagcgacacaauaguuggaggaaacucacaggccagcuagccuggcauaccagcugugaacaccaauagauccugucucaaauaaaagggaagguuaagacugacaccagagguuccccaaccucccuccaucacucccucuacauacacacacacacacacugguuauguagacacacaaagauauauuuuuuaaagauuuauuuauuauuauaugugaauacacaguagcugaccucagacacaacagaagagggcaucagaucucauuaugggugguugugagccaccaugugguugcugggauuugaacucaggaccuucagaagagcagucagugcucuuaccuacugagccaucucaccagcccacaaagauauuuuuaaaggccucaaguugauaaucuaacuugccacagcaaggaacuagaagcuaaacccaaaacacuuagaagaaaacaaaggcaacuacucacaauacacaacaacuauuacuauagaacccggagagaugaaaauaauaaaucuaugcaccaagugucuguuacuuuuagcuuuguuuuagccuuuuuuacauauuuauuuugugaauguugacaugcgccaugacacacauaugcagaacuacuugcaggagucaguucauucuuuccacuguggguuccagggauguaacucaaguagcuaagcuuaacugcaaguccuuuuaccacacuagagcucugggcagcccauuguuuucuuuuguuuugagauacugccuguggagguggaccagcagauuagggaacuugcuggcaaaccugccuacccgaguuuaaucucaggaacccacauaguggaaggagagaaccaacuccagcaaguuguccucugacagcuaccuguacacacugauccacuccacacacuaaauaaauguaaaagaauaauaauuuuaaaaaucaguuaagcuggcauaguaaugcauaccuuuaaucccaacacuccagagcuagaggcagaggcaggcagaucuuggugaguucaaggccagccuugucuauaaaaccaguuccaugucagcaagggugauacaaugagaccgugucucaaaaaaacaaaaccaguuaaccaaaagaacaguugaauauugacaagcaaaggaguauacuucuggaugcauaagcauauuacaaaauguacauuaauauuuuggcuuuuaaauuuuuucacaguauauaguauguauuauauaaguaucuucauacaacuauaaaauauauauugauuauauucuaccccauaauucuuuacccuccuuucccccauauucguccccuuuguuucccuacacagcuucacuucuacuccaugucuuauauauauauacauaauuuuauguaucuauguaaaaccuagggacuauacaugagaaaaaaacauuugucauucugagacuggcuuaauuuacuugauaagacuaccccuggaugcauccauuuuccuacaaaugacaacuguuuuuauaacauguauuauaugugcuuauuugugugcauguguguucaagcaugcauaugugccccacaacaugucuguugaagucaggacaacuuacagaaguuacucucucuuuccacuaucugauuggcagcaagugccuuuacccacugagccaucuccuggccaucuuucuuuaagacugauaaagauuccauugugaaacuggccagcuggcucagaggucaaacguacuugucaccaaaccugauacccugaggucuauaccuggaaccuacuuguauaugucaaucagugacacaugccucccucaucccccaacaaaauaaguacaaaaaaaggauuguauuuuguguauauagcauauuuuguccaucccuguuguuagauacccagauuguuucuauaacgagcuauuaugaauggugcuacaauaaauacugguguaaaguaucauga

SEQ ID NO: 4934 - RNA, 14492 nt, Mus musculus
gggucagagccgcggaggcggagcaggcgcugcggcaggagggaagauggcggacgaggagaagcugccaccaggcugggagaagcguaugagucgcagcucagguaccucuugggggucgcccggggccagggcggggccucgcgagcucucggaaguuaggcuggagcuugccgagacaggcgagucucaucaccggccugauucgggcauggagaucuggccuccuccgcggauaacgggcccggaaagccagaaacugagguaggagguggggcaggcacagacgcgcccccguccucgcccaccgcugggcuccggugcucagaggugacgaggcugcaccucggggcucccuugagaggaagagauccggacucagugcagagggcgugggccgcccugaucugaguucucccgcagcauccgagacacgugccugcucaucccaccccccaacccccaucgggacccugcggcagugauggcuucuaaccaggccaguucgucucugggucaagcaugguaccaagcucuuugaaagacuuuaaguucuuucauaaguccacgucgguguggucucacguucucccacucucucucucucucccucuccccccuacccuccucucuucucuccucuccucucucuuccucuuccccuauccccacccccaccuccauaucucccucccucuuuuuccuuggcuuauucucucccuccuccuccuccuccuccuccuccuccuccuccuccuccuccuccucucuguagcuacccucuuucaaaagaagacuugcucucauuuuugaggugagagaaacugaggccaggacacggaaagaacucaucugauaaugcacuucaguuacuaggaaugcccuggauugcaaugauuuuuaauuuuauuuuuauuuuuacuucuuuugaucccaagcauagccuuccucggugucaguggcaacgccuagaguagccuacaaggaccucagguagagcuagggucucugcagccuacagagcucucucagaauucuuaguuauuaagcaucaggguucuggacacugcuuauggcucucucugaauuaacccagcuagguuuaaugucauucacuuuccccauuuugucgaggguggauguggaaagguauuagacagagccucauaaagacagguuacucuugaauucuugguccccugcuucagcucccccaagugcugaaauuacaggcaugcaccacuuugcccaauguauuuauugaggcagucuuuauuaguaagacuauacuuagugugugugcauguggagagcagacaauaacuugcaagaguuuuuuuccuucuaccaugcguaacucauauccucaggcuuggcugcaggcacuuacccauugaaccauuuucuuucuuuccuuuuuaaggcugugugugugugugugugugugugagagagagagagagagagagauagccuugaaccucuggugucuaccgggauuacaugacacagauuaauuagcugagguaaagucuuacuguguagcccaagccggcuuccagcucaugguccuucuguuucgccucucagcacugggacuaaaguucucugccuuuaugcccggcucugaugaccuuauccucuggcccggcucugcagaugagaaagcugagguucaccgagauggccuguugggaagguuuuaguuggauuuagcuccuguccagcuguccaggcugcucuauuccuagugugggguugugacuucuagcggaaacuuguuucuagcugggugugguggcacacagcuguauuuccagcacuuacacagaagcaggaggucuagcucauggcuauccugggcuacauaaacuuuuuuuuuuuuuuuaauacauguaugggcauuagacuugcauguguauuccauaugcaugcaauacccacagagaagccugaagagggugcuagacacccuaggacuagaauuacaggcaguugugagccucuaggugggcacuggaaauugaaccccaguccgauagaagcagcuggugaagccuccuguaguaaaacucuuuuauacacacacacacaccucuaccccugcccgucugccuagcuauggaccagucccaauucuugccauuuguucucaguagaacuaugaaagccgcccuuucauggguaacacucagcccuucucugcugcuagaucagcuguguaacccagaaugacucucagcccuuggagugacccagaaucuacuggguccuuccuucagcuucugccauaccccuccccucuccucuucuuuucucuuucacuuuuuggaggcagucuugcaaacuuaccuuuacuggcuucaaacugcagacauccaucccccugccucagccucccuaaugcuaagcauacagguaugcuucacuaagccagacuuuuccuucagguguuuccuuugccaucuccuuuaugcucuucacugucacucaggugacagcaggucccaaguaaugcugcuuccuugcucucugacuuaggccaccagugcagggguugagaauacagcuuuggguuucuaucucuguuuaugcacaagacacaaacacugcugcuguagcagagauggaggagguggugccuaggguuuguuuggaauggagcacuggguaagaacaguuacacuuuuuaucuucuggugauaugugauccugggacuugaaucuagaaccucacaagugccaagcaagcacugaaccagugagcuagaaccucagcccauacuguuuguuguacauguuuggaauugggucccuuguagccaaggcuauucucaaacuauaacugaggaugcuuuugagaaucugauuguauuuauuuuguaagguggcacuaugccaugguauauauguggaggucagaggacaucucgaagcugauggguucucuccuuccacugggcaacuuccuggagaucaaacucagguugucagacuuggcaaguucccuuaccugcagagccaucuagaaggccuggaagcuguuuuaucugauuuacugauugagugucugucugguaccaccuaaagcauuagcacagcccuacaggucccgauggggacagcauccuccccagccuuuagcaugggguagaacaggaaauggaucugcuaaaggaggcaccuccggagccagucguuauccuggcuuugagauggaggccuccuuggcccagccccugcugaaguaggugcugcucucccccaggccggguguacuacuucaaucacaucaccaacgccagccagugggagcggcccagcggcggcagcacuguuggaggcagcagcaagaauggccagggugagccugccaaggugcgcugcucacaucugcuggugaagcacagccagucucggaggcccucauccuggcggcaggaaaagaucaccaggagcaaggaggaggcccuggagcucaucaauggugaguaggggagggagcggggcuuguuggagguccucucucaacugggucaggggcuaccucaguuucuuuuccuguuccugugacaaaauacucugacaagggccagcaagaggguucagcaggcaaaggcacuugcugcuaaagcugagggcccaaguuccauuccgggauacauguggagagagcccacuccugggaguuuucugucacccccaagagcaccacagcaugugugcuucccugccccaagaaauaaguaguuuuaaaaugagguugguugauugguugguuuuuuguuuguuuuaacugcuaaggagcaguuuaauagagaaagguuuguuugggcucaugucacaguuccaggucacgauucagcacagcaggaaagucacagugaaggagcaggucauagcacagcauugucagggacaaagagcagcacaccugugcuagggcccuauuggcccucucuaguuuuuagaagagaaucccccaguagcccaccuuccagguuauucuagauucuuucaaguggacaauaaacauugcucuucacaggggccuuguagaagucccaccagacccuccacccagucuggucaacagucacuucuggagaaauauuguacuauaguaggguuguagcgcaguugcuagcaugcucaccugacuuacagggagccuugacuuucgccucuaguacccugugagccuggcauggucgugcaaaccuguaaucucugcauggagauagagacagagaggaucagagguucaggcuggggcugggaagacggcucagugggcaaagguacuugccacuaaacuuaagggccugaauucaguuccuaggaccuacauuguggaagaagagaaccuacucacucaagcuauauucugaucccaaugaaaacacugugguacauaugcacacauagugcuuuuuauuuacauaaguccuagguccaacauacugcguccaggccacuugaugaccuuaucaugaaaagaagugccuguguugggaugagcuuggcccaugcaggcccucacucuuugcuuccugcuugccguuuggaguggccggcucuagaaagucaguagcaguauuuggugagcucugggaucugggagauucaaagccucacucaagacucgguuuuucuuauguaaaaugagcgauaaugcauacuuaucccgaaggccauuguagcagugcagggauaggaggcagccuuggucagugggagccacccugaaugaugucaucagggagaggccugggcaucugagggucggucuggagauagaccagggacuaguaagcacagagcuggcccuguagagugauggguccguuuuuagcagccuauuuuugauaaauauguguauggguguuuugccugcauguauguaugugcagcaugugugugucuggugucaggaggcgagaaggcaucagucaaguucccuaaaauuguacuagguuugucagcuacugugcgggugcugcagacuaaacccagguuuuuugugaauguagccugugcucuuaacuucuaaucuauguuuucagccauauguguaugggaacacacauguucaagcguggaagucaaagcacaguucuuaggggugagcuuucaccuacuuugugaguucuggggacuaaacucagguugucaggcucagucaccugcuaagccaucuugcuggcccuuugugugacauguuugagauuauuuuauaugugugauugccugcauguauguauaugcaccacaugauuccugcugcccauacaggccagaagaggacaucagauccccaggaacuagaguuacaggcaguugugagcugccauauguaugcuguaaccacaccuggguccuccggaagagccaaccagugcucuuaagcacugacccagcucuccaguucguuugguuuuuauugagaacacuggcucaccuugaacuucuugcaaggggaucaggugacagugauaggagggagcaguaucugccccugcugcuagccuuggccuggagguaccguuaguuccccucugccuuuaggaaacagacugccuguuuuggaagcagcacuucugcaucccugcugcagcuucuuuuccagcacuggcuccucuacagcugcuggauggcagccagaggaaaccugaagcccagcugguaucauugccauguccuugucugagacagccaagcuguggacagacccuggcucccugucccacguugcuuugucccuacucacuaagguccugaggauccagggaggcucagaaccagaguaugcgcagcaccuuucuaggcuucaaagaccagcuaccuccucugcugagugauguccuuccagccugguggccuauggcuaugccucugggccccuccugcucagccuugggucaccuaugaucugagagagauuauuuaagcauuuuuaguuaaggaaccacccuuuugguucauuuuguaccuuagucugcagcaacacaaugcuacaagcuuuguagcuuaguuucuuucucacaguucuggaaaaaucuaugccucuuguuuuccucuagagucacucucaaacaccagcaaaccugcagucucucacucuccucugucguuuccuggugagauugcuuuucuggacuugcagagagcugcuucuguuguguccuuuagugaccuuggcugugguuugguuugauuugguuugguuuggcuuggcuuggcuuggcuugguuuuucgaaacaggguaucucuguguggcccuggcuguucuggaacucucuguagaccaggcuggucucaaacucagagauccaucugcuucugccuucgaggacugggauuaaaaggaaccuuggccaucuucaccucccuuuaaagauagagcuuaugcagcccaggcaggccuuauaauuccccauguagccaagggugaccuugaacuucugaccuacucaucucugccuccuaaaugcugggauugcagguuugcacugcuauccuugauuuagagauugaaccugggaccugguguaggaaggagagcacuccacuaagcuaaagccuuaguuagccuggcuaugccucuucuuaugaauaggaacucaucauagcauuucaagucccacccuugcagacuccuugucucccaggguagucagaccaggagccagggcgucuucagagugcauauugggacacuagcgugcagcccauagcagaagagugggcauguguagcuuccaaggguuuguucuacgucagccuugacuauggcagucacucauucaucccucagaauagcccucugaagugagagcuuucauucgcccauuacauauuuuuguuugguugguuuuuuguuugguuugguuuuuccagacaggguuucucuguguaguucuggcuguccuggaacucacuuuguagaccaggcuggccucgaacucagagaucugccugccucugccucccgagugcugggaauaaaggcgugccccaccacgcccagccauuuuuuuuucuuuuacacuuguuuauuuguauguguacaagcgugccagagcagcguguggagguuaggggacaccugcaggaagaguugguucuccuguuccugaggauggagcucaaauaguuagggauggacaagcaccuuuacccacugaaccagcuccccagcucccacccagcugccccaguuccuaggccagucaugucgugaggccccuaaagcagaauccugcccucccuucccugaggccauuggguacuggaugcucagggcuggggaaccacagagcagggucagaucucagcagcugcagucugaagcugguccugccgcuccaugaaccucagggacugcugaacccacacaugucugcagagguggacauucaccuguuagguuugcugucuaggggacuccuuugucuuagucacugcuccacuguuccauugcugugaagaaacaccaugaucgaggcaacuuaaaaaggaggcauguaauuggggcuagcuuaccauuucagagguuaguccauugucaccauggcagggagcagugacacaaauguccuggagaaguacugagagcuuuacauucugaucuacagcagacaccgggccugguguggcugguuaaaaucucagcccaucccuagugacacacuucuuacaacaaggccauaccuacuaauccuuuucaaacagucccauuccuuggugacuaagcauucaaauauaugagucuauggggccauuuguacucaaacuacuacaaccgcaauagcacccuggcuuccccaccuucuauugaggcagugauuuguccugaagaaaguccagggaguccagccucagcccugaauacagagguccagguaacaaaaaucgagaaauagcagugucugucuaaagaauagugauggguccccaucgccuuccucagggauaguuucugcuucacuuauucauuaauuccuuggccaccaggaauuccugccuugugcacaggucuagacagaagaguagggaacagugguaaaugagggccccuggcuagauuucuuuucugagacaguaucuaugccuugguguccugagugcugggauuacaggauuguaccauccagcucaaugcuuucuuuauuaaauggcuauaucuugacaguguguauguaagaagcccucuggcuaucccaucuacauuucccugugaccuuggcuacaacuaggugacacugccacagggcuggagcuggccaaaauuccuuaguacauccuuugauccccacagaagaacacaaccagacagccagggagaugcgaaucaggaguuuaccaggucaggguuacugauaggauucauucuguacuaggggacucuugauaccaagggugguugccagacaagucacugggauguacaggucaagccacaguccuguguaucugacagacuccaggcaguggcuuauagagacagccucuuccggccaaggcagaaagaggggagcuggggaucccuugauagacaggugugccuuggcagguuguagaccaaauaccaagguaacugccauguaguacauucagauaggggugacuccuggcugucagucagucagucauauugccugcccccugugucaggcaauaggagccugaggcccugagcgcucgggaauagcuggguuccuggcccucaaggcacugguuguagcagcuaguaacguuacuuguuguacaggcaccaguugggaccuucagugaugugcacacugagcagcucgggugggaagugugggugggaguccagcagcagccacggcaggccacccuccgaugugcagagaucccuguggagccucauguagauugcauggccgugaccagcacuccaggagcuaagcaggaaguuugaggauucaagaguagccugagcugcauaggaggcuaugucucggagauaaaaggacagaguccuguccaggccaucugggaaaacugagagagagcugcucaggucaggguggcugcccugggagucucugugugccauggcugcaaguuagucagaagauggggacaggaugggcugucuugugucugugucuagggcuuucuuacccaccucaggugcuaccuagaccaggugccugguagucuccccaccuugcacaugucugagagugcauagcacaggcucacaugcauccgcauacgugguacugugcucucacuccccugagccuggguccuuucaacuguuuuguuguuugucugacuuuguuuuuauuuguuuaggugagggguugguaagaguguaugaaggucagaggauacaacuugcagaaguugauucuucgauucuuguaggucccagggauagaacccagauagucaggccgugugacaagugauuuuuguuauuguuguuuugaggcuuugcuucagucacuauucaccuucuuuccagcagcccuggcuuccugaccccgcaggagagucacaacccaguagagccgcuuuaaugucuccugagcucugccaauacaguguggaaccuugccuaugggaccauuguacaggcacucacacacaguccuuacaaccucagugccccagcgaguacucugcugugccuccguguugcgcagguggagacuccuacugcccacagcugaagaggucaccagcuccagugaagagcuuggcugcaugcuagcuggcugcaggucuccagagccuugacauugccccaggaguaggggugggcagucaucugcugugagguuucagcucuguguccaggccugagaagaggucacugcguguaugggugcuucaauuccugugcaccguggaugacuguccuggcuauucagaucgugcuauggucauaggcacgugaggaugggcgacugguuugcaccguugggacaugcacaugggaggacugucuucaugggugcacauaauaagagcacaggauaagggugugguugcuugggccugaggguaugggagguguugugggugcgaucagcauaaccuuguagggaacugggugcacaggucgggcaggucuggccuagcuccuagguguguccaguucuuccugcauccugucuggccucuaugugucugaugcgcggcucuccccuuguaucccuacaggcuauauccagaagauuaagucaggagaggaagacuuugaaucucuggccucacaguucagugauugcagcucugccaaagccaggggagaccugggucccuucagcagaggugggcaagagugggcaccaccacacucagcacuuucccucaguguucugggcggaaggcccugaggagggcagcuccggagcacaggccuuccuguccaccagguggcagcauagcccucaggcuuccuggccuggguuuuuuguacugcaaaagggauauaaaaccuccuuagugucuuuccucccaggaucauugucccccucacaggcccauuaaggugauucugguuugucacuggcaucucugguagagcuauagggacgggccccugagcauuccagcuccuuugccccuuuggcagguuuuuugggaaaauggacaagggaaacaauccagagcucagaccuaucugccaagggcagaggaaaguagauuccuucuuccucccccaucuucucuccuucaucucuuuggcgugagcuggaagugugaggugugggccccugccuuggagucagguagcaagccucugcugucagcccuggccaccucccugcaggauagauaauguucagccaggaauccagaguucaucaugcagugugucuaaauguacagcacagcucugccuacuaucccacgcugucuuugggcuucccggggccuccuuaaugggccuguggcucucagcugggccacagcucaucacugcacagugacagggcuauaaaacccaugaugaauaugcuugagacugaaugcaggcaggagccccaucugcugugcagccugugccugaccuccacugucugcuguuucacaggucagaugcagaaaccauuugaggaugcgucguuugcucuacggacaggggagaugagugggcccguguucacggacucgggcauccauaucauccugcgcacagaaugagggcaggcaccuggccagccugcucuggcugccacacagcccacggaugcccuuccugcuacugucacacaguauuuauuguuccuaaaaugacugggaggggcucugagcaucccgcucccuguuugccccuauucggggcuguccuagccaggcuccuucuggaggaauugacuucagaagggcaguggggauggggaggcccccaggcucagggggucagaggugaccugaucccccaggucucagaggcaggcaggagggccuucuuucuuguuaguuauaugcuccauucguuccucuguucaguugcaaaaagcagacgcuccauaccuggcggugcagcaacucagccucagggugcagugcagcacccuacgcaccuuccauuaaaucuggaaccacugguuggugguccuguaucauuaccuuccuggugagguguggggcccuugucucagggauggggcuuuuacccacguguccagacucuucucuagcucuaaaagaccuucuuuuccacagcuuggggggugcuggcaagaauucuuuccacuagcuauauucccagggcugcaaauaccucugagccccaccaguccagacccacuuguauaagcacccuggggacuguucagguaugcgcagaccaccccaccaccccaccccacuuccagcuguuaggucuggagugaucccaagagaaccuggcuuagcaucugccuuggcacacccccggugcccaucccucccccucagcacacagacagacugcuuauuggugagaacaaaucacccagcaucugccacccacuucugacuggauauuccugggcucagccacaagaccuagcacucuccaggugcuguuuccaugguaacagaggcccccucaacuggaggagaggggggcuuuaucagcucccagaagaaaagagauccuauuggagggggcugggaaauggauauugcuuugaguggcagguggggagagaaggcggacucucccaccuuggcuagggcccuaugucucccacaacugccucugagccuaaggacugagggcucagaauucaaucaagguuucugcauauacccacaagugauggggggcccagccugggggauguucuaaccagcaaggcuugggggccagagcaacauuaagccuggaccccaagagagcccucccuccccacaggccugagucucaugaacagagucaccugagccugcucccaucuggcugcuuucuagagcaaucgcucuuugccagccgccugcuggagcauuugucauuaggaagguuuaaugaguuuuuucccagcucagacaggcacaggcugagcugaguuggcuauaccuccagcaaaauguucuccagugggccaguggggacucaaggcaaacagucacaguuuugcugucuugcaacaguugggugggcucaggaggcaguggcagcccuccaaguaucaugggaccuuuggagggaagaagaggaccucuagcuuagcuugcaacaccaagagcucugggagguucucccuagggccacugccacaucugauccacugccuguaagaagcagguauuaccauagugguaauuugugcaucccuauguguggccaugugauuugguaucuauguucuauaugaucccaacccacugucuagggucuguccuuuggaccccugccaaccucuuuuccugucuacacaauuguaaaaaccuaagacugaacauugcuguuagauaaaugagccccaggagcccacucagcguccccagcauauauuauuaacuaccugugguuucccucaccugcuccaaguucccacccagacuugcuacugggaacuggcuauaaauccugggccuuuaggauggcaacaguguaacaaccccccacccccaagggauggaaacuucucuuugugcagacuccacugcucauucuuaaugggcucuucuuagacuugacacaggggauucuggguuauugcugcaguagggaauggcagccuccugauuauagccaaacagucaucuaugauuuagagcaaguugguuaacucagcaccacauagcucaagacagacaaaugaacagaaguggaugggugaggcggguaggaccaauugcuaauccuuuguaguugcagcaugugccgaguaauuuguauauuugcauucaggcaugcaugugcacaugcgugugcauguauucauugacuguauacauuaagagugcauacguauaagagugacacaguggguguacuaucagaugcucuggcccaaguaaacacucagugcccaccugugacagacauguucacaucaguucuauccuuauggaaacaugucucuaggcacaaguauacucuagcaaaggcuagaauuccacagugcuguaagugcagccugguucuuugacucugagaccaugaccaccuugagcacaaguuacaggcaggagacaugcgcacuccuuuuccuuauuuggaaauuugagacaagaucucacccggguggcaucagccuccccagaacugguaugucuaguggguuccuccaugccaagccuuugcugucuucaguggcaugaaguuugucaugcuaguccgggccuuuauucuuuuccccagugucgugcuuguucacuuacgugggaauuaauugcucuucucgaggaugccuuuagaaauugguuuuaaaugagugcauuaggcagccccauucauuauucauggguuuccuucccaauauggcauccaagucugaguucccggagaugauuuaaucacagaggccauuaauuagagaugggacagcagccuccugguggccucagcagggcggggucauggccagugaagaucugcacaugcugucccugccguggguucggugggcuggugugggggauggggagcagcauguauugcucacugcuccauuucagcugaaagccccgcacauaacucacugcucucccaaguugugaugccuuggccucagccuuucugaagcugugacuuuaauaccucauguuagggugacccuccaaccauaaaacuuggcagaguuucucuguguagcucuggcuguccuggaacucacuuuguagaccaggcuggccucgaacucaggaaucugccugccacugccucugccucccaagugcugggauuaaaggcgugcgcuaccacugcccagcucauaaaacuauuuuuguugcuccuucauaucuguaauuuugcuacuguuaggaaccauaaauaucuuuugagaua

SEQ ID NO: 4935 - RNA, 14492 nt, Mus musculus
uaucucaaaagauauuuaugguuccuaacaguagcaaaauuacagauaugaaggagcaacaaaaauaguuuuaugagcugggcagugguagcgcacgccuuuaaucccagcacuugggaggcagaggcaguggcaggcagauuccugaguucgaggccagccuggucuacaaagugaguuccaggacagccagagcuacacagagaaacucugccaaguuuuaugguuggagggucacccuaacaugagguauuaaagucacagcuucagaaaggcugaggccaaggcaucacaacuugggagagcagugaguuaugugcggggcuuucagcugaaauggagcagugagcaauacaugcugcuccccaucccccacaccagcccaccgaacccacggcagggacagcaugugcagaucuucacuggccaugaccccgcccugcugaggccaccaggaggcugcugucccaucucuaauuaauggccucugugauuaaaucaucuccgggaacucagacuuggaugccauauugggaaggaaacccaugaauaaugaauggggcugccuaaugcacucauuuaaaaccaauuucuaaaggcauccucgagaagagcaauuaauucccacguaagugaacaagcacgacacuggggaaaagaauaaaggcccggacuagcaugacaaacuucaugccacugaagacagcaaaggcuuggcauggaggaacccacuagacauaccaguucuggggaggcugaugccacccgggugagaucuugucucaaauuuccaaauaaggaaaaggagugcgcaugucuccugccuguaacuugugcucaagguggucauggucucagagucaaagaaccaggcugcacuuacagcacuguggaauucuagccuuugcuagaguauacuugugccuagagacauguuuccauaaggauagaacugaugugaacaugucugucacaggugggcacugaguguuuacuugggccagagcaucugauaguacacccacugugucacucuuauacguaugcacucuuaauguauacagucaaugaauacaugcacacgcaugugcacaugcaugccugaaugcaaauauacaaauuacucggcacaugcugcaacuacaaaggauuagcaauugguccuacccgccucacccauccacuucuguucauuugucugucuugagcuauguggugcugaguuaaccaacuugcucuaaaucauagaugacuguuuggcuauaaucaggaggcugccauucccuacugcagcaauaacccagaauccccugugucaagucuaagaagagcccauuaagaaugagcaguggagucugcacaaagagaaguuuccaucccuugggggugggggguuguuacacuguugccauccuaaaggcccaggauuuauagccaguucccaguagcaagucugggugggaacuuggagcaggugagggaaaccacagguaguuaauaauauaugcuggggacgcugagugggcuccuggggcucauuuaucuaacagcaauguucagucuuagguuuuuacaauuguguagacaggaaaagagguuggcagggguccaaaggacagacccuagacaguggguugggaucauauagaacauagauaccaaaucacauggccacacauagggaugcacaaauuaccacuaugguaauaccugcuucuuacaggcaguggaucagauguggcaguggcccuagggagaaccucccagagcucuugguguugcaagcuaagcuagagguccucuucuucccuccaaaggucccaugauacuuggagggcugccacugccuccugagcccacccaacuguugcaagacagcaaaacugugacuguuugccuugaguccccacuggcccacuggagaacauuuugcuggagguauagccaacucagcucagccugugccugucugagcugggaaaaaacucauuaaaccuuccuaaugacaaaugcuccagcaggcggcuggcaaagagcgauugcucuagaaagcagccagaugggagcaggcucaggugacucuguucaugagacucaggccuguggggagggagggcucucuugggguccaggcuuaauguugcucuggcccccaagccuugcugguuagaacaucccccaggcugggccccccaucacuuguggguauaugcagaaaccuugauugaauucugagcccucaguccuuaggcucagaggcaguugugggagacauagggcccuagccaaggugggagaguccgccuucucuccccaccugccacucaaagcaauauccauuucccagcccccuccaauaggaucucuuuucuucugggagcugauaaagccccccucuccuccaguugagggggccucuguuaccauggaaacagcaccuggagagugcuaggucuuguggcugagcccaggaauauccagucagaaguggguggcagaugcugggugauuuguucucaccaauaagcagucugucugugugcugagggggagggaugggcaccgggggugugccaaggcagaugcuaagccagguucucuugggaucacuccagaccuaacagcuggaaguggggugggguggugggguggucugcgcauaccugaacaguccccagggugcuuauacaagugggucuggacugguggggcucagagguauuugcagcccugggaauauagcuaguggaaagaauucuugccagcaccccccaagcuguggaaaagaaggucuuuuagagcuagagaagagucuggacacguggguaaaagccccaucccugagacaagggccccacaccucaccaggaagguaaugauacaggaccaccaaccagugguuccagauuuaauggaaggugcguagggugcugcacugcacccugaggcugaguugcugcaccgccagguauggagcgucugcuuuuugcaacugaacagaggaacgaauggagcauauaacuaacaagaaagaaggcccuccugccugccucugagaccugggggaucaggucaccucugacccccugagccugggggccuccccauccccacugcccuucugaagucaauuccuccagaaggagccuggcuaggacagccccgaauaggggcaaacagggagcgggaugcucagagccccucccagucauuuuaggaacaauaaauacugugugacaguagcaggaagggcauccgugggcuguguggcagccagagcaggcuggccaggugccugcccucauucugugcgcaggaugauauggaugcccgaguccgugaacacgggcccacucaucuccccuguccguagagcaaacgacgcauccucaaaugguuucugcaucugaccugugaaacagcagacaguggaggucaggcacaggcugcacagcagauggggcuccugccugcauucagucucaagcauauucaucauggguuuuauagcccugucacugugcagugaugagcuguggcccagcugagagccacaggcccauuaaggaggccccgggaagcccaaagacagcgugggauaguaggcagagcugugcuguacauuuagacacacugcaugaugaacucuggauuccuggcugaacauuaucuauccugcagggagguggccagggcugacagcagaggcuugcuaccugacuccaaggcaggggcccacaccucacacuuccagcucacgccaaagagaugaaggagagaagaugggggaggaagaaggaaucuacuuuccucugcccuuggcagauaggucugagcucuggauuguuucccuuguccauuuucccaaaaaaccugccaaaggggcaaaggagcuggaaugcucaggggcccgucccuauagcucuaccagagaugccagugacaaaccagaaucaccuuaaugggccugugagggggacaaugauccugggaggaaagacacuaaggagguuuuauaucccuuuugcaguacaaaaaacccaggccaggaagccugagggcuaugcugccaccugguggacaggaaggccugugcuccggagcugcccuccucagggccuuccgcccagaacacugagggaaagugcugagugugguggugcccacucuugcccaccucugcugaagggacccaggucuccccuggcuuuggcagagcugcaaucacugaacugugaggccagagauucaaagucuuccucuccugacuuaaucuucuggauauagccuguagggauacaaggggagagccgcgcaucagacacauagaggccagacaggaugcaggaagaacuggacacaccuaggagcuaggccagaccugcccgaccugugcacccaguucccuacaagguuaugcugaucgcacccacaacaccucccauacccucaggcccaagcaaccacacccuuauccugugcucuuauuaugugcacccaugaagacaguccucccaugugcaugucccaacggugcaaaccagucgcccauccucacgugccuaugaccauagcacgaucugaauagccaggacagucauccacggugcacaggaauugaagcacccauacacgcagugaccucuucucaggccuggacacagagcugaaaccucacagcagaugacugcccaccccuacuccuggggcaaugucaaggcucuggagaccugcagccagcuagcaugcagccaagcucuucacuggagcuggugaccucuucagcugugggcaguaggagucuccaccugcgcaacacggaggcacagcagaguacucgcuggggcacugagguuguaaggacugugugugagugccuguacaauggucccauaggcaagguuccacacuguauuggcagagcucaggagacauuaaagcggcucuacuggguugugacucuccugcggggucaggaagccagggcugcuggaaagaaggugaauagugacugaagcaaagccucaaaacaacaauaacaaaaaucacuugucacacggccugacuaucuggguucuaucccugggaccuacaagaaucgaagaaucaacuucugcaaguuguauccucugaccuucauacacucuuaccaaccccucaccuaaacaaauaaaaacaaagucagacaaacaacaaaacaguugaaaggacccaggcucaggggagugagagcacaguaccacguaugcggaugcaugugagccugugcuaugcacucucagacaugugcaagguggggagacuaccaggcaccuggucuagguagcaccugagguggguaagaaagcccuagacacagacacaagacagcccauccuguccccaucuucugacuaacuugcagccauggcacacagagacucccagggcagccacccugaccugagcagcucucucucaguuuucccagauggccuggacaggacucuguccuuuuaucuccgagacauagccuccuaugcagcucaggcuacucuugaauccucaaacuuccugcuuagcuccuggagugcuggucacggccaugcaaucuacaugaggcuccacagggaucucugcacaucggaggguggccugccguggcugcugcuggacucccacccacacuucccacccgagcugcucagugugcacaucacugaaggucccaacuggugccuguacaacaaguaacguuacuagcugcuacaaccagugccuugagggccaggaacccagcuauucccgagcgcucagggccucaggcuccuauugccugacacagggggcaggcaauaugacugacugacugacagccaggagucaccccuaucugaauguacuacauggcaguuaccuugguauuuggucuacaaccugccaaggcacaccugucuaucaagggauccccagcuccccucuuucugccuuggccggaagaggcugucucuauaagccacugccuggagucugucagauacacaggacuguggcuugaccuguacaucccagugacuugucuggcaaccacccuugguaucaagaguccccuaguacagaaugaauccuaucaguaacccugaccugguaaacuccugauucgcaucucccuggcugucugguuguguucuucuguggggaucaaaggauguacuaaggaauuuuggccagcuccagcccuguggcagugucaccuaguuguagccaaggucacagggaaauguagaugggauagccagagggcuucuuacauacacacugucaagauauagccauuuaauaaagaaagcauugagcuggaugguacaauccuguaaucccagcacucaggacaccaaggcauagauacugucucagaaaagaaaucuagccaggggcccucauuuaccacuguucccuacucuucugucuagaccugugcacaaggcaggaauuccugguggccaaggaauuaaugaauaagugaagcagaaacuaucccugaggaaggcgauggggacccaucacuauucuuuagacagacacugcuauuucucgauuuuuguuaccuggaccucuguauucagggcugaggcuggacucccuggacuuucuucaggacaaaucacugccucaauagaagguggggaagccagggugcuauugcgguuguaguaguuugaguacaaauggccccauagacucauauauuugaaugcuuagucaccaaggaaugggacuguuugaaaaggauuaguagguauggccuuguuguaagaagugugucacuagggaugggcugagauuuuaaccagccacaccaggcccggugucugcuguagaucagaauguaaagcucucaguacuucuccaggacauuugugucacugcucccugccauggugacaauggacuaaccucugaaaugguaagcuagccccaauuacaugccuccuuuuuaaguugccucgaucaugguguuucuucacagcaauggaacaguggagcagugacuaagacaaaggaguccccuagacagcaaaccuaacaggugaauguccaccucugcagacauguguggguucagcagucccugagguucauggagcggcaggaccagcuucagacugcagcugcugagaucugacccugcucugugguuccccagcccugagcauccaguacccaauggccucagggaagggagggcaggauucugcuuuaggggccucacgacaugacuggccuaggaacuggggcagcugggugggagcuggggagcugguucaguggguaaaggugcuuguccaucccuaacuauuugagcuccauccucaggaacaggagaaccaacucuuccugcagguguccccuaaccuccacacgcugcucuggcacgcuuguacacauacaaauaaacaaguguaaaagaaaaaaaaauggcugggcgugguggggcacgccuuuauucccagcacucgggaggcagaggcaggcagaucucugaguucgaggccagccuggucuacaaagugaguuccaggacagccagaacuacacagagaaacccugucuggaaaaaccaaaccaaacaaaaaaccaaccaaacaaaaauauguaaugggcgaaugaaagcucucacuucagagggcuauucugagggaugaaugagugacugccauagucaaggcugacguagaacaaacccuuggaagcuacacaugcccacucuucugcuaugggcugcacgcuagugucccaauaugcacucugaagacgcccuggcuccuggucugacuacccugggagacaaggagucugcaagggugggacuugaaaugcuaugaugaguuccuauucauaagaagaggcauagccaggcuaacuaaggcuuuagcuuaguggagugcucuccuuccuacaccaggucccagguucaaucucuaaaucaaggauagcagugcaaaccugcaaucccagcauuuaggaggcagagaugaguaggucagaaguucaaggucacccuuggcuacauggggaauuauaaggccugccugggcugcauaagcucuaucuuuaaagggaggugaagauggccaagguuccuuuuaaucccaguccucgaaggcagaagcagauggaucucugaguuugagaccagccuggucuacagagaguuccagaacagccagggccacacagagauacccuguuucgaaaaaccaagccaagccaagccaagccaaaccaaaccaaaucaaaccaaaccacagccaaggucacuaaaggacacaacagaagcagcucucugcaaguccagaaaagcaaucucaccaggaaacgacagaggagagugagagacugcagguuugcugguguuugagagugacucuagaggaaaacaagaggcauagauuuuuccagaacugugagaaagaaacuaagcuacaaagcuuguagcauuguguugcugcagacuaagguacaaaaugaaccaaaagggugguuccuuaacuaaaaaugcuuaaauaaucucucucagaucauaggugacccaaggcugagcaggaggggcccagaggcauagccauaggccaccaggcuggaaggacaucacucagcagaggagguagcuggucuuugaagccuagaaaggugcugcgcauacucugguucugagccucccuggauccucaggaccuuagugaguagggacaaagcaacgugggacagggagccagggucuguccacagcuuggcugucucagacaaggacauggcaaugauaccagcugggcuucagguuuccucuggcugccauccagcagcuguagaggagccagugcuggaaaagaagcugcagcagggaugcagaagugcugcuuccaaaacaggcagucuguuuccuaaaggcagaggggaacuaacgguaccuccaggccaaggcuagcagcaggggcagauacugcucccuccuaucacugucaccugauccccuugcaagaaguucaaggugagccaguguucucaauaaaaaccaaacgaacuggagagcugggucagugcuuaagagcacugguuggcucuuccggaggacccaggugugguuacagcauacauauggcagcucacaacugccuguaacucuaguuccuggggaucugauguccucuucuggccuguaugggcagcaggaaucauguggugcauauacauacaugcaggcaaucacacauauaaaauaaucucaaacaugucacacaaagggccagcaagauggcuuagcaggugacugagccugacaaccugaguuuaguccccagaacucacaaaguaggugaaagcucaccccuaagaacugugcuuugacuuccacgcuugaacauguguguucccauacacauauggcugaaaacauagauuagaaguuaagagcacaggcuacauucacaaaaaaccuggguuuagucugcagcacccgcacaguagcugacaaaccuaguacaauuuuagggaacuugacugaugccuucucgccuccugacaccagacacacacaugcugcacauacauacaugcaggcaaaacacccauacacauauuuaucaaaaauaggcugcuaaaaacggacccaucacucuacagggccagcucugugcuuacuagucccuggucuaucuccagaccgacccucagaugcccaggccucucccugaugacaucauucaggguggcucccacugaccaaggcugccuccuaucccugcacugcuacaauggccuucgggauaaguaugcauuaucgcucauuuuacauaagaaaaaccgagucuugagugaggcuuugaaucucccagaucccagagcucaccaaauacugcuacugacuuucuagagccggccacuccaaacggcaagcaggaagcaaagagugagggccugcaugggccaagcucaucccaacacaggcacuucuuuucaugauaaggucaucaaguggccuggacgcaguauguuggaccuaggacuuauguaaauaaaaagcacuaugugugcauauguaccacaguguuuucauugggaucagaauauagcuugagugaguagguucucuucuuccacaauguagguccuaggaacugaauucaggcccuuaaguuuaguggcaaguaccuuugcccacugagccgucuucccagccccagccugaaccucugauccucucugucucuaucuccaugcagagauuacagguuugcacgaccaugccaggcucacaggguacuagaggcgaaagucaaggcucccuguaagucaggugagcaugcuagcaacugcgcuacaacccuacuauaguacaauauuucuccagaagugacuguugaccagacuggguggagggucuggugggacuucuacaaggccccugugaagagcaauguuuauuguccacuugaaagaaucuagaauaaccuggaaggugggcuacugggggauucucuucuaaaaacuagagagggccaauagggcccuagcacaggugugcugcucuuugucccugacaaugcugugcuaugaccugcuccuucacugugacuuuccugcugugcugaaucgugaccuggaacugugacaugagcccaaacaaaccuuucucuauuaaacugcuccuuagcaguuaaaacaaacaaaaaaccaaccaaucaaccaaccucauuuuaaaacuacuuauuucuuggggcagggaagcacacaugcuguggugcucuugggggugacagaaaacucccaggagugggcucucuccacauguaucccggaauggaacuugggcccucagcuuuagcagcaagugccuuugccugcugaacccucuugcuggcccuugucagaguauuuugucacaggaacaggaaaagaaacugagguagccccugacccaguugagagaggaccuccaacaagccccgcucccuccccuacucaccauugaugagcuccagggccuccuccuugcuccuggugaucuuuuccugccgccaggaugagggccuccgagacuggcugugcuucaccagcagaugugagcagcgcaccuuggcaggcucacccuggccauucuugcugcugccuccaacagugcugccgccgcugggccgcucccacuggcuggcguuggugaugugauugaaguaguacacccggccugggggagagcagcaccuacuucagcaggggcugggccaaggaggccuccaucucaaagccaggauaacgacuggcuccggaggugccuccuuuagcagauccauuuccuguucuaccccaugcuaaaggcuggggaggaugcuguccccaucgggaccuguagggcugugcuaaugcuuuaggugguaccagacagacacucaaucaguaaaucagauaaaacagcuuccaggccuucuagauggcucugcagguaagggaacuugccaagucugacaaccugaguuugaucuccaggaaguugcccaguggaaggagagaacccaucagcuucgagauguccucugaccuccacauauauaccauggcauagugccaccuuacaaaauaaauacaaucagauucucaaaagcauccucaguuauaguuugagaauagccuuggcuacaagggacccaauuccaaacauguacaacaaacaguaugggcugagguucuagcucacugguucagugcuugcuuggcacuugugagguucuagauucaagucccaggaucacauaucaccagaagauaaaaaguguaacuguucuuacccagugcuccauuccaaacaaacccuaggcaccaccuccuccaucucugcuacagcagcaguguuugugucuugugcauaaacagagauagaaacccaaagcuguauucucaaccccugcacugguggccuaagucagagagcaaggaagcagcauuacuugggaccugcugucaccugagugacagugaagagcauaaaggagauggcaaaggaaacaccugaaggaaaagucuggcuuagugaagcauaccuguaugcuuagcauuagggaggcugaggcagggggauggaugucugcaguuugaagccaguaaagguaaguuugcaagacugccuccaaaaagugaaagagaaaagaagaggagaggggagggguauggcagaagcugaaggaaggacccaguagauucugggucacuccaagggcugagagucauucuggguuacacagcugaucuagcagcagagaagggcugaguguuacccaugaaagggcggcuuucauaguucuacugagaacaaauggcaagaauugggacugguccauagcuaggcagacgggcagggguagagguguguguguguguauaaaagaguuuuacuacaggaggcuucaccagcugcuucuaucggacugggguucaauuuccagugcccaccuagaggcucacaacugccuguaauucuaguccuagggugucuagcacccucuucaggcuucucuguggguauugcaugcauauggaauacacaugcaagucuaaugcccauacauguauuaaaaaaaaaaaaaaaguuuauguagcccaggauagccaugagcuagaccuccugcuucuguguaagugcuggaaauacagcugugugccaccacacccagcuagaaacaaguuuccgcuagaagucacaaccccacacuaggaauagagcagccuggacagcuggacaggagcuaaauccaacuaaaaccuucccaacaggccaucucggugaaccucagcuuucucaucugcagagccgggccagaggauaaggucaucagagccgggcauaaaggcagagaacuuuagucccagugcugagaggcgaaacagaaggaccaugagcuggaagccggcuugggcuacacaguaagacuuuaccucagcuaauuaaucugugucauguaaucccgguagacaccagagguucaaggcuaucucucucucucucucucucucacacacacacacacacacacacagccuuaaaaaggaaagaaagaaaaugguucaauggguaagugccugcagccaagccugaggauaugaguuacgcaugguagaaggaaaaaaacucuugcaaguuauugucugcucuccacaugcacacacacuaaguauagucuuacuaauaaagacugccucaauaaauacauugggcaaaguggugcaugccuguaauuucagcacuugggggagcugaagcaggggaccaagaauucaagaguaaccugucuuuaugaggcucugucuaauaccuuuccacauccacccucgacaaaauggggaaagugaaugacauuaaaccuagcuggguuaauucagagagagccauaagcaguguccagaacccugaugcuuaauaacuaagaauucugagagagcucuguaggcugcagagacccuagcucuaccugagguccuuguaggcuacucuaggcguugccacugacaccgaggaaggcuaugcuugggaucaaaagaaguaaaaauaaaaauaaaauuaaaaaucauugcaauccagggcauuccuaguaacugaagugcauuaucagaugaguucuuuccguguccuggccucaguuucucucaccucaaaaaugagagcaagucuucuuuugaaagaggguagcuacagagaggaggaggaggaggaggaggaggaggaggaggaggaggaggaggagggagagaauaagccaaggaaaaagagggagggagauauggagguggggguggggauaggggaagaggaagagagaggagaggagagaagagaggaggguaggggggagagggagagagagagagagugggagaacgugagaccacaccgacguggacuuaugaaagaacuuaaagucuuucaaagagcuugguaccaugcuugacccagagacgaacuggccugguuagaagccaucacugccgcagggucccgauggggguuggggggugggaugagcaggcacgugucucggaugcugcgggagaacucagaucagggcggcccacgcccucugcacugaguccggaucucuuccucucaagggagccccgaggugcagccucgucaccucugagcaccggagcccagcggugggcgaggacgggggcgcgucugugccugccccaccuccuaccucaguuucuggcuuuccgggcccguuauccgcggaggaggccagaucuccaugcccgaaucaggccggugaugagacucgccugucucggcaagcuccagccuaacuuccgagagcucgcgaggccccgcccuggccccgggcgacccccaagagguaccugagcugcgacucauacgcuucucccagccugguggcagcuucuccucguccgccaucuucccuccugccgcagcgccugcuccgccuccgcggcucugaccc

SEQ ID NO: 4936 - RNA, 1017 nt, Mus musculus
agacacaaaggauuuauucuggcucacacagagggccagugagagggcucagcuggcaaaggggcuugcuguucaaacuuggggaucugaguuagauuccuggaaccuacaugaagguggaaagagaucagacuccauagaguguccuaugaccuucacaugcaugcuguggcacacauguccuucacuacaaugacagccaagcaacaggacugaagagauagcucagugguuaaaacacaaggcucuuccagaggaucugacacauggaagcucacaacuaucuauaacuccagucccaggggauccaacauugucuucuggucucuguggguaccguaugcauaugguacagacauacauggagggaaacaccauaaaauaaaauaaaacaaaacaaaacaaaaauaaaauaauuuaaauaaaacacauagucuuuuuuguuuuuguuuuucuuuguuuguuuguuuugaggcagaguuucucuacauagccuugacuauccuggaacucacucucuguagaucaggcuggcuucaaacucacaaagauccaccugccucugcuucccaagugccuggcaaaaccacauauucugacucauaguucagggauacagucccucauugcagggaggucaaaccaacaagagcuaaugcaacccgucauguggcugccacaaucacagccgagagcaauggccacgcugcucaguccacuggcuccauuuguguuacauucaccacccaaguguauuaguuuugauucagucaugcugugguagcacgacuacaacuuugauuggauagauuuauuugacuaauccauggggagucagggcaggcacucaggguagaaaccuggaggcaggaacugaagggagaccacagagcaucgcuccuugcuggcuuguuacucauggcuuguucagcuuguuuguugguuugguuugguuuguuucucuuuccagacaggguuucucuguguagccuuggcuguccuggaacuugcucugua

SEQ ID NO: 4937 - RNA, 45020 nt, Mus musculus
aagaagagcacaguuccuugguuuauucuugagauggcgauuuugcccuguguccuggggaggagagccgcguagguaagggaggguacagauccuucuggaaucucucaccguaccccagacuuccuucagaaggaagcaaauuaaauagaccacagaccauucauucccccuuucauacaguucccaguuaugagcagggcagcaccauguaggauccugauuuaugcccaacaucuugguccccugaaggcuugggggcacaggaguggggcagaguagggagaggagauugugcagcacugggucaaggaagcagaaggaaggcgcagcucagggagggcgcccccuuugaucuugcuuuacuucuuuuacucaaagaaagaagaaguaugcgagggaagggucccaggcagggaucaggagguauccagugcucaacuauggaaaggaauagcaccaaaaggccugguggagggguggagaggcagggguggggcuucaccagcucugaguuaaaagucuacugcauggaggucugggggugagguggacaauggacaguuggauggaggggggagcuagcagacaacuggguauaccaccuggggugaacagacagagggagcugggcucuccacacucucccccuacaagggagaaagaauagucagagucacgugacccuggaucuggagucccuggggauaaacagaauggccucagagccucagcaccaaggagcccauguggggcucccuucagcuuccuucccaccucacaacuucagcugcuaaagcagauggagccgaguucaaacccaaacuuuugguucgucugaccaaagucagaggcagccacaucccacagaggcaggaaacccacagaagagcugaauucaaagagggucuucgccugucccuuccggaccuggccaugaggggguaggagaguaagucagaggagggugacgagaggcuuccccacuccacacccgccagucccugguuccauggucuuacccgacagccaucaugggagaccuugaugguagcugcuguugucugguugaaggacaacucuucccaguuggucccuuggaagcggauggagugccuguggucacccgcagcuucauccagccaugccaccgaguucuggcagauguaagugaaccucugaugggcugcagcacucaacaacuucaggaaggucaacuggaccacauucaccggggagccaucagcauccacauaggagaacugcaguggggcaagguagggugaggaagacaccucccaguccaccugcagucuacccacaggccugacacuucugccaagucucaaguagcccaaaguggucuuggauucaugguguagcugaggauugccuugaacacuugaaguuccuauuuauucaguguuaggaacggagcccaggacuuuguagagaaguacuuguccuucucugccuacccacgccaguucccaacaguucucacgcaugccguccuccaugucagcauuggaacccaccuucuucccucggcggaaggugcuguaccagccuccaggcuucucucgggaccacgaggccaguuucaccugagggaggaugggaaggucauugagcgccaacccaacucccucugccucuccuacuggacaucgugggucauggauggcacaggcugugcccuuggcaaggguccacagcucccucacccucacaggccgcaacucccagaauucucuguggugacuggaugaaacccagggcccugcccacgcucaagugcugcuagggaauggggcuugaggcugggaucuagccaccccacaugaccccuaccccugugcaugcacugcgggugaagcccauagccuugugaauacugggcagcacccuugccuuaaggcuuggcuucagguucuguacuauaagacauuaccugacagacaggagggacagguguuaugugaagggagaauaagggcucaaagauggcagaagauggcagaggugggaaaaagacaagaugguuucuuucacucaccgucucaaacuucuugucuggauagagacaggucucaccuccugccgugaaguugcagaaaaccuugaaggcgucacgugcacagcccugauuggggucaauccaguacucuccuaucacggaagcagagccaggcaaucagugcacaggaaugcugcagugcucaccugcccuucccagaaggaccugggccucaccaucgggcagguguggguggucgcggugaagcucucggcacaugaggccugggcucucggcugugcccagaggucucugcaacugcugcagcuccaagcucagugaauucagugaggccaucaccuccuccaggccaccuuccaggguguccgucacagaucggcgccugcgcaggccaugcaccucagccggagaacccuggacucacaagggaaugggaauggaagagaggaagaaucagagaugggcagagaagacaagacaaugggaggcagagaaauucagaagaggaaggagaggagcaagaagaggggcggggggcgggagcagagaaugaaagaagagaaagagauauugagagaguaauggguaauagauggagacgcagggagggagagacaggacagaacccagggagagaagcucagaucagacuccacaaauggucccacugggacugccaaaacccacgaacccagaaugucuuccaagucucuuuuggguauuuguuuguuuugagacagggucucauguaccccuggcuaaccucgaacucucuauguagcuguggauaaccuugaacuccuggucucuugucucugccuccccagugcuggacugacaggugugugccaccacccacugcacuccacuccucccaaagcuuucaaggaacugcauuucugagcuacagaccgaaacacuggacuggguuaugagggaccugauaagaacacccaagucugauuccugccuuccuccagagucugggaacucaccgggggaccaggaggacccgcugguccagggucuccacgaggaccaagagaucccuaugagagaggucacuuugaaaugaauccugucuauggagaccugguucuaccaaugcaaauacaugcaugugcacaugcacauacacucacacgcacacacacacacaaacacaugcacacacauauaccuaaacauauagauucacuugcacauauguguguggacauacccccacacauaugcacaaacauacaugugcauacauacacaucugugcauacauacacccauguauacauacagacauguacaugcacuccucuggagaccuccgaagccuccagacaaaucccccacacuaaaauccccauuacagccccucacuuuccccaggacagccccacucauuccugacccuuauccuuccucuaaaccagcccccuuugaacauuauucucccugccaaggcagggcacacacguguauacaugugcccauacauuuacauacaaguacacacaugcagggucccagaagaggcucccagugucccaugcuaaaccuaagcuguguauuuccaucccuuauccucugaaaucaacacacagucuuccacaggcuacaacuuauucagcagaccuauuuccuuuaacaguaguugagaagucccuccuauaaaacgcagcaucuuagaucccaagagugcagcaguaggugcugaacacagggugagugaagaaucaacaaaguaaggggguugguccggggaggggagcugggacauggagguccaggggguagugccacucaccggggacccuuuggagcccuucugucccagagggcccuguggaaagagacagggaauguuggggucucaauaccacccaucaugaugacuuccccaucccuccaauauccccacacucaccaccacaccugggggcccagggugaccuaacgagccaacaggaccagggagacccuagaagaggggacaugggggucacccuuaauaggguccagcucuguuuacacacaccuuucugaagcaauacacaaacuccuaacucuucuagaagacccccaaguacccacacaccuuccuacaugacauuccccaguuacaggcccccauuccccuaacacagcccucccccacuccaaauaccccacccuucaaaaugucccccuugaacauuauuccccugccccaacagugcacacacucacagggucucccugaaggccuggggggcccugcacaccuggcaaccccugaucgccuuucucaccggccuccccugggggaccaaugaggccuauuagcccaauguggcccugaaagagaaagacacacaggacagacaugcugggaucuuuuuucucaugauggcuuggaaggaaugaguucuccuaggccagggcaggagguaaagguugagggaaauguagggaacaucaggagguaggcuuaccuucucccccuuggggccagcaucucccuucaggccagggaggccaggugggcccugggaaaagaugaagugcagcuugggauuccuugaaagccagggaugggaagauuuaccagagucccacccagcuuucaaaugcaaggaaacaggucuggggugacuggacagucaggagacaggaaaugugcuuagaaaaaugggggugaaagagaggacagcugaggauaccaggugacaggaucagggggaguggucaguguagacaucaagguggcagucagcauaaaccaucaagauagggccaauguggaccaccaagauggaggccaucugugugaagggccaauacaggucaugaagauggcacagaggggcuagccuguaccauccgcacuauggcccacucaaugucccuggaugccuaguguggcuuucagagcugugaccacagugauagaaaagucucuuaccaggggcccuggagggccgauuagcccaggaggucccaggagaccugguucacccugagggggagacagaacaggggugucugguuucuaccagcacucaguaugaacauuccaucaucccccaagauugcucaacuaugaugagguccuaagccagaaggcuauccaugcugccccucccccccauuuucacaccacuuaccacaggaccagggaucccuggaagaccaucaggcccaauucguccagggggcccucgagccccaauggggccuguccugccuggggguccaucaggaccagcaucucccugaaauggacaaggguggggggaagcagucucaagagccugccugcugacagcuagaaccucagggggugcaggccuucuuuuggucaggugguacagggaggugcucccaagggggugcucaccuuggcgccuuucucgcccucucuuccuucuggacccaugcggccaggggaacccugaggagggaaagugugaguguuguggggucagugugaagcauccagguuuaugucaagagugggcuggcaaguuggcucagcagauaaaggaccuugccugagacccacaugguggaaggggagaacaaauucccacaauuguucucugaacuauaaaucucuuugugguacaucauacacacacacacacacacaaauaguaaauaaauauaauuuuaaaaugauaagagugggguauguguggagaggggcuauugcauugcugaagacaagguggacaugagacccucaggcaguggaagaccacucacccucuugccagggaggccacgggcaccagguuccccggaagcuccagguggccccuguuuagucaagagcagucacagcaucagcugaaacacagccccacagaugccacccagcaccaucccccucuccaucucaccacucaagaucauggggucagagauaccgcaggaaacccagcagaugcccuggguacccaacucucccaucaacaacuccacuccauauccacacucuacagcccuuugcucuccacucaccggucccccaauaucaccagcauuucccuucuccccugggaugccaucaauacccuagggaggagagacagugggagucuugggauaguugggauagagauggagcuggaggagagugagggccauacacuccucuaagcgggucaaggauaggggcauggggguaaaugcagauacauugauauauuuagggcuaggcuacagggagcauuuacacucaccggaacuccagggucuccugggggcccuagaucuccagggaguccugugggacccuagaauaaaaacugguugcugaucucaucucacugagugaggagucgccccuucacacaccagauaguguccccagaccaacugcaggggacaugucacaaacgaaauacaaaaggaaaggcugggguuuuauauugaggcagugaaguguucacugcaugcauaagaggcugggugugggccagugggagggcucagcuuccacuauguuuucauaguucauucauucauuguuucuucuauucguucagucuuuguuugggugacucagagaguuaacaaacaggaagaaauaggggcuagagagauggugcaguggcugagaacacugucugcucuuccagaggaaaaggguucuguucccagaacccccauguuggcucacacccaucuguaacugcagauaagguaauuccagagaaucuuacauccucuuccgaccucugcagguaccagacauacauguggugcacagauauauguguaggcaaaauacacauacacauaaaauuuaaaaagaaaaauuaaaaacaaacaagaagagaugucuggucugucuuagggaccagguuuuaauguaauaagggccccaaguucucugcucugucuccuccuaagacuuaccauguuccccuuagagccguccucuccuggggguccuuucuugccugggggaccagcagccccugauggacccgaaucccccuuuucaccaauuucaccuuugggccccuuugcagaaacagagaucaggagucaaaggucagagugucauggaccaaagaugaacacaccuugccugggaagucugacaaucuggguuccauccccagaccccaugguagaagagaacugaccuccaaaagcuguccucugaccuccacacaugugccacacucucacacacacaauaaugaauauauauauauauguguguguguguguguguguguguguguguguguguauguguguguauauguauauguguauguguauguguauguguauguguauguguauguguauguguauguguauguguauguguauguguauguguauguguauguguauguguauguguauguguauauguauauguauauguauauguauauguauauguauauguauauguauauguauauguauauguauauguauauguaucagggcuagaaagugccucagugguuaagagcauguggugguuugaauaugcuuggcccauagggacuauuacuguuaggagguguggccugguuggaggaagugugucgcugugggggugggcuuugaagcuccacccaguacagaagaguuagucuguuccuggcuuccuuugggugaagauguagaauucucagauccuccagagccaucccugcauggacacugccgugcuuucugcugugaugauaauggacugaaccucagaaccuguaagccagccccaauuaaauguuguccuuuauaagagcugccuuggucaugggguuucuucacagcaauggaaacccuaacuaagacagaccacauacuacucaugcagagaccaaaaacggagcuccaagcacucgcaucagguaucucacaaccaccugcaauuccagcuccacgggaauccgaugucaucuucuagucuuugggcagugcauuuacacacacacacacaugcacacagagucagguagccuagguaaugcaaguguuagaggucacagagaacuagaacuagcugaguuagggauaauggaucugucacccaugauuagucuguccuggccuauguccugccuuuggguacauaagaaaauggucccccuuugggcagcuuuacccccaauuccauguuuguugcuuugauuuaaaccccuagcugucuccucagcccugugugcuugugggcaacuuuugggacucuacaaagcaccccugagaucuucucagguggagcaucuuucauaucuuucacaacagacagggauaucuguuggucuggauucagcaaugcucuaaggacugccuggaggucaugagagcaugacacgcucuaggucagcaguucccuauggcaaguacaagggcaaugcucuacagacucacagggaugccgggaauuccuggggguccggcgucuccagcauccccuggcucacccugugaaaggcagugaacauagaaagagaucaucucacugaucggcagggaggagcauccccauacaguuguagccgaggagacgggcacuaucuauccccuccauccagggcaaguucaagcccuccucuuaccuucucgcccacagcaccaggcuguccuacuccuccaggcagaccuggggggcccuggagagacaaugaggaaacugugagucccuagagguguggcagacccauagaggcauucuguccaccccagaauucucaccucugauccacugggcccagggggaccccgagggccuggagcuccauguggacccugucaaagaaccaaauagugugcaaugacuccccauuauuccaccagaaaggcuacaguagccacagauaaccuguaaggugugugugacccuuuagaugaccguaaccaguggucacucccauuccaccugucuuccauaucucccagggaguucauaccauggauccuacgucuccaaccucgcccuucucccccggaggacccggcagccccugugaaauagaguaaacuguaguacagacaacuggugagauggccgugcaccucuugcacaaguuuuaggacuugagucugggucucuagaacucauuuccaaaaggccagacacagcagagcuugccugcaacaucagcacugggaggcagggacaagagguccccuagagcuugcuggaagucagugaccaaaucaaggaacuccagauucagugagauagguagccucaaaaauaaguugagaagggccaucaaaauggcuuaguggguaaaggugauugucaccaagccugauggccuggguucaagcccuggacccacuugguagaaguagagaacuaacuccugcaaguugucuucugacacaugugccauggcauaaaugagaaugugaguauacacacaugcacauguacaugugcgugugcgcacacacguauucucucucucucucauuaaauguuaaaaaaauauuaguugggaagcaacaaggaaugcaugaaagcaugcauacaugcauacaugccaaccuccaucuuuuaauuuguuuguugguuuugagauagacucucacuauguagcccugacuggccuagaacucucuacaaagaccaggguggccucaaagucacaggauccaccugccucuaccuccugaguucugggacuaaaggcgccaacuauuacauccagcccucugagcuauucaucuuuauaaaucacuaagacacagggauagcaacacacacaaacaaacacacaccauacaaagauuagcacccuagguaggggguugggggugugguacccccaaacucacacaccuaccugcagaccuggaggaccaauuacaccuacaaagccucgaacuccgucaucccccuucugcccgaagaggccaggggguccccggcgacccugagcgccaucagcacccugugaaaauguuggggacaacacaguugguguccagaucaaaggcugcagacaggguccaaggucaggacugaggcuagggguugggaucaaguuuggugagaaucagguuuuaguuugauguaaagggcaggugauguuucugaguuacugacacagugaaucagggauguggcucagguaagguuaugagcagguaagguuuguaggaggcugggguagguuuuagggcuagguuggaaguuaugaccuaauguuuuggugacacucugaccuggaccagcaggucauucuucagugacaggguccuaagggaaaaaugcccaggagaugggaaggcaaagaagacagagagcuggggacgggggucucgcacaagccaugucuuaugcugaguaagcuuauuaagaaaugcagcaucguauauacaguuguuucugaaaggggaaaugggacaaggucaauagaaagcuaccacaugugguggcgcacgccuuuaaucccagcacucgggaggcagaggcaggaggauuucugaguucgaggccagccuggucuacaaagugaguuccaggacagccagggcuacacagagaaacccugucucgaaaaaagaaaaaagaaagaaaagaaaggaaggaaggaaggaaggaaggaaggaaggaaggaaggaaggaaggaaggaaggaaggcaggcaggcaggcaggcaggcaggcaggcaggcaggcaggcaggcaggcaggcaagcuaccacauaacgaagucagaagaagcuaauaaguugguguugcacaagggggcacaagguuucucaggggcaucagagaccagcacacagcagcuucuuaagaugggaagaguuggguggucagggucugaagccacaacuccccauguuccacauaucagggccucagggaaagccuuggagaagcuuacucaacaacacacaacaacacucaaacguucugguagaacugugagcccagaauucguauguuguuuugaaacaggcucugguggagcccagguggacauaaaacuuacuuuguagcugaggaugaccuugaacucaugaucuuucugcuuccauuucuccagugcugggauuacaggcauggacuacuaugccuuagcuauggagugcuaggauuggaacccaggauuuugagcauggcaggcgagcacucugccaaccaaaucacaccgccagccuccuucagaauuuguauguuaccagaauuuggagguaaggccuuaugaaaguacuaggaucaaaugcagucaugagugugaggcccccacgaugguauauuaguggcuucauaagaagaugaagaccuaaguucacauaacaguuauuaacacacuauguugugauaaagcaaggagacccuggucagaugccaacaacacuauuagggacuucccauccuccagaccaugagucauccaaauaaaucauuuagcuucagauuuuguaacaguaacagaaaauuaacuagggcaaggcuggaguauaacucaaaguucaaguucccauuugaggccggcaguggagggggcagaccugguuggguagaugguaggagaaagcuaggauccagguauuugaguuggacgaaggucaaagcaguaagcagagaguuugagcugagaugggguuggguucaucauggguguuggcacuaaggugaaaccaaggcuggacaaggaugcuaggauuuuauucagaagaguggcacacugucuucacuucaaggacccaggguauagucaccaaguugggagaacucaccgggaggccugaauggccugcuggaccucuuauuccuguugguccaggugggcccugaagaggaaaacaaaauagaaaauucuaucggagcugaacauagugguacaugccuaugaccccagcacucaggaggaucgggagccaaggucaaccucagcuacauagcaaguuugggaagagccuagguuacaugaggaacucuuuuaucugaaaaaaaaaaaaaaaaaaaaaaagcaaaggucuccuuugggauggcguguaacccgaugaugcuggccgcagaccaagguagauucuugccauggagggauuuugaggcccagaggggccuuucucugaauguuuauuacauuuauacauuuuguaugugugugugugcauguguguagcaacuuaugagaggcaauuguuuucuuucaucacgaagguccugggcauggaauucaggucauuggguuuaguggcaaguaccuucacuaacugagcccucuugacagccuagagggcucuuucuuauucuccugggaucucagggcucaaacagagcucagauaaggaucuuuagcccuucaguuccagugagcuuggugucaagauugggcugagguaaccacaaaacauaggcuaccccauaucuccucccaugagcaucacaaccucccugggggucccuacuuacugcaucuccuuuauccccuuugcuuccuuugugaccaggcaucccuacuucccccugcaggacaaacauauuaggaagaguucaggucccagcaugcccaaucucucuguaaacugucucucucccugguccucucaccuugucuccuucuuccccagaaggccccgcagcuccagaggggcccugaagccccggggguccuggaauaccaucuuugccaguaggaccaggaguaccccguucucccugauggaggaagagaaaggauggauguuaggagcuagggaaugggagaggacauuuguguggcaguuucuuuaaaauugagacuauccauccugaagaaagcuccuuaaggcucaggauauaaacagcucacaagucuuagaaaguuccugaaacuuacaggauucaccagccauucuaaagcuauagaaguaguucacaacuaugaggaagagagucuuuggccuuucaagcugacugcaaguuguauagagagcuccagggaugccgcucuucugagccaugagccaggcucagauggccauucagugaugcagcugucuggagucagccuuguuuuauaagucacuccucacccauacuccuguaaguaaucccaauaaacucacagcuugauuaagcuggacuugggaaagguaauuuuaagaauugauuuuuuaaauuuuaauuauauauauauguaugugaaugaguggauaugugcacaugagugcaauugcccaugaaggccagaagaggaugacagauuaccuggagcuggaaauuacaggcagaugugaaccuacccauguggaugcugggaacugaucucagguacucaacaaaagcaguaugugcucuuacccacuugagucaucguuucuccaguccacagaaauagaaguucuuugguaaauggcugauuacuuaucuggaaugaguugauauuuguucaugucuccccagaaaaagucaaccaacagacacuuaccggggaccccuucucgccagcaggaccaauagggccuugcccuccacucuggccaggaagcccaaugccaccagaggggccuacaggaccacgcucucccggggagcccuggaaaagggguggaggacaagaaaugauaaaggauacagggcuucuggcaccaguaucauauuuauacacagccagagggcaccuuaagcacuaagguaugauccucuuuacaauccucaguugucccaaccucuucaauuugaggaccaugcagcccugcaugaacugcccccaucaccuccuuggaauccucuucucauucacucagccccagcuacacagaccucugcagagcaugguccugcccccagggucguugccuuccccagccagccuguuuaaaacacucuccccaacacucugcacucucuuccuuuucguuguuuuccuuccccaucucucuucccuucccuuucccucucuuccccuuucauuuccucucccuuuccuuucuuccuucuuccuuuccuuccaucccuucccuuugacagggccucaguaaguagaucaggcuagccucaaauucacaauccuaccuccucagucucccacaugccagggcacagucaugcaccaccacaugcagccuguguagauuuuucuuuuugcauuugugugugcauguguaguuuuauguauguggacacauguguggguguauguggacacauguauggaugcaugugcacaugugugcacauggaguccugaggcugaugucuggaaucaucccuaaucuuagacugugucauugagucuaucaggcaaacccagagcuggccgacauggcuguuccacuaaccagcuuucucugggaccccuugucucuggcuucccaggcuggaauuaaaggugggccaccaugcccacuggacauucucuggggaucugaacucagaugugcuugcacggccagcacucuguccccugcgucagcucccugcccaauccuaugacaacuauccuacagcaggaagcuuucuggcugacucaggucauggcagucagaagugagugugcuccaggccuuccuuccccaaacgcacagccccauccuggggauaucaaacccugaagacacagcccucuccagcccucacccccccccccccccgccaguguguugauacuuacauuugccccaacagggccugggggaccuuugucacccuucaaaccaaugggucccugggggaagaaauuaccagucagaaaaucucccagggaccccaaggauuugccuuuacuuuuggggacccucaucaucccuagccuuaucugaagaugggccgugaguucuguagaucuguccacuccaggucacugccacuaccaauucugucugugugugcgcgcgcgcucauaccuuccccagcacacggacaacuagccagaguuauugucuccuaucaugugggucuggcugaucaaacucaguucaucaggcucagcagcaacccuuuuucucccgcucugagcucccucaccggccaccacuaacuccuuacacaggcccuucuccuguuugcugccacugcagccacucuuaaggagccuccucuucucuaccccagagccccauacuccaguggacucucccaagauacucacugggucuccgggggcuccuugggggccagggaagccccugggcccagguggccccuccuucccgacggaccccagggguccuagcucacccugcagagagccaaggagaggaaguuaaggucaggaguggggucuccugcagucucugacuacucccagcuguuccccacauggcgugagaccaggggucgaaugaugacuuugaggcaaucuauccaagcucuuaccuuggccccuucucugccuucuaugccuggcagaccuuguucaccaggagguccaggaggcccuggggggccucucucgccuagaggccccacguccccuaccuuucccuggaaacaagcaagagacaucuugagcagccuggagguggggaguacgucagacuuccagcuccauguauuccuuggggauccacucugaccugaggaccaaggacgccagcugguccaggggggccugucagaccuuggaagcccuaaggagagaaauagaaagaggcaccaccugagaagaagaaaaggagagcccacgggacuggggaggcaucucugugcuccaugcaagcaagaagaccugaguucagcuucccagcaccccgcagaaagccaggugugugguggcacaguccccauccagugcuggggaggcagaaaccauggcagccauggcucucuggggcucacuggccagccagucuagccuaaccugugagacccauuugacacagcgagagaccuugucucaaaaaaauaggaugggagccagagagaugacugagugaguaugagcauuugcuauucaagcaaaagaaccugcguuugcauccccagcacccgcggaaaagccaugcacagcucuuaugccuguaaccccagaguggaagcagguggaugugggacuugcuggccagccagccuagcagaaauggaaagcuucaggaugagcccucagcauccuuuccuggcuuccacauguacaugcacgugcaucccaccccauauacaagggcccaacauagucaggggucagaggucaagggucacucaccaauucuccucuuuguccagggugcccagauaucccaucuuuccccugaggacccugggaaacaaaguaagaaggaaugaagauuuagaacuggaaccaccucaccccguacccuucccccaccaacccagagucagggugacaucacucaccggggggccuuuugguccggggaauccuggugggccuugaagaccggguagacccugaaauggaaccagaaauuauuaccuuaucccuccugagugucuugcaccucugucccacaagagcgaccuuaaaagccaguccagugcuggcaggauggcucaguggauaaaggugccugcuuacauuuacucagauaaaaccuguaaccuggguuucauucccagauccugcaagguaggugacauaaaccaauuccuuugaguuguucucugaacuccaaaaucacacaagcacaaagagaguuuuuguuuuguuuuucuuugaagcaaacauguauggaguacccacuccacacaagcaggugcugagcgcucacucaggguauaugauauuauucaccacugcagcccauugaggcauggccaugguuacccgauuuuauaaaagagggaacugaagcaaagagaaguuaagcaagaugcucaaggucacacagcaggcaagaagcacagcugcguauugaacuuaguucucuggucuuagagaccaagcucuuucuauugcauauauaugaugugcugucagcucauggcugguucccugacagugucacacacauacacaugcacucauacucauacaugcacauucacagacacauauacacacccucacacauacacacacauauacucacacauacaccacacacacacucacacauaccacacacacacuuaccuuuucuccagggggcccaggagacccauucuggcccacgucacccuagaacauaugaaaugagcuucaauaccagaacauacucaacuggaagaacuaagcagguagcuaaguuagccugagauagacaaggacccuuggucaucccccaaucgcuacucacucccauaccuuggggccaggcuggccuguggcccccggcuguccccugucuccucgggugcccugcauagaaaaaugaaaaaugaaaaagcaaaaaacagagaugagugggugggugggccuggaagagggcaucacacacaggcucccuccuccaaaaugcccucugacuccaccaggggcagggacgggaccuguccuucccggccgacuccugacgucacuaucccacuuccccucagcccagcaggcugcguggagcagccauccucuccuuaccggugugccgcguucuccuuccucuccuggcuguccugcuuugcccuggaaagcaagucaaaaacagagaaggugagaauugccucgugcuucaugagacacacuugcaugugugcauucacaagugggaauguuugcauacaagaaugucugcaaaaaaacaaaaacaaaaaacaaaggugaaugcagagagugaauccagaccaaaggagagaucuguguugcaggcagcaauacagaggggcagagccaucuagcccauuugaagcuccagacaccagacauggagcuccagaauuuagcauuguccugcugugguugagucuugcguugguccaguauuuccucaccaugccuuuauucuucccuugaggaaugggaauuauaguuuauggcauuguaauuuuuaaaaauuuuuccuuuuaaaacacuggaauuuugaaagacuacaggguuuuuaaaguuagauuauguuuuacauucagagaugagcaugagacguugggacuaggaaguaaguuacgguuuuaaauccauguauuuguguguccaguggacaagggguggaacugugccagacagguuuucuuucuauuugugucugcgucuguguguggguugguacacaaaagugcagguguucccagacgccagaagggggcgcuggauccccuggauccagagcuacagacgguugugagccaccuaauggaguacugggaaccaaacuccagcccucugggagagcagacagggcucuuagcuggugagucagcucuacagcucugggaugguuaguuuucguuguuagcuugaggcagucuagaagcauccagaaagaaagucucaauacgggacuguauagaucagguuacccuguaggcgugucuguggggauugucuugauugccuuaagugagagagcaagauuugcccuaauaagcucagucaaaccaucccagcacccaccuccggcaugccugagcacaccuuccucauacccuuugacacacaacucacccgcuugccuuucucccccaguggucccaaggguccaggaaauccaauagaucccugagcagagagaaugagacaggagacucagggauggugagcauuagguggaauuggucccuggcuccauccuuugagacuuccuuaggcuacagaauccgguggcuuucuuuugccuccuccagccgcagcaucuucagaguggccccgcacccuccuccucaccucauucugguucccacagcagccauacuacccaccuccaaauuccccagguaugccugcauguuccugcccgagagccuuugcacacgucccucccuucaccuuaaaugcucuucucucaaguuuacacaaagccaccagccacccaucauucaccauccuuaugugcauguaugauauguguguacacgugcccauauacacauauagaaaccacaggagagugucagacacccuguucuauuauuguccaaucucaggugguaaagcacuugccuaggaugcaggaauuccugagcaccacacaacacaggugugauggcaucugccuguggucccagcuuccaaggugaaacgcaagggugaggaguucaagcucagccuuuucuacauaccaaguaugaggcuagccugggcuacauaaaacccuaucuuaacaaaagaacuagaggagcuggcuggcagguggauguggcagcccaccuguaaucccagcacucggaaaguagagccagggaguccccaaaggagcaaacugacuaauaaaacaacuagaauuggugagcucuggguucaagugaaagauccugccuccauauauaaggaagaagagauagaggacacuggacaucaaccuccaguuuccaugcuccaguauacugcacacauggaggcaacucacaucuaaacgucaaugcacacacacacaacaagcaacucaaaggccacaaaggggggugggaauucauggcagguuguuaaguuauuaagguccuugaaugggauugggugccaaggucuuugcccucucucuguaccucccuucucucucucucucucucucucuccucccuuucccccuuccucucucucucugucuuacucucuccccucccccucccccucccccuccccccucucuuccucuuccucuuccuuucuuggcugucucuucucuccccgccccucuccucuacacccccccccccucuccugcuucaugauuugagugacugcucucugccaccuuugaccuguuaccaccaucugccaccagaagcugaaagucaaagguccgcucaagaccaugagccaacuacaacuugacugcaaaccuugaucuacagugaguauuaggcaagacaaccaugucaguuccaaacagcaaagauacagaacucuggaagaacucugcuucuggugagauggcucaguggguaagcugcugcugccaguccuaaugguuuggucugcagcauccacgugguggacggagagaacugacgcccucgaguuguccuuuaugugugucugugugugccuggugcccauggggaagagagaaggacacuggauccccuggagcuggaauuauagccuucauguggauguugggaacugaacccagguucuuugcaagagcagcaagagguuuuaacuucugacuaucuuuccaacccauaaacuuaauuuaaaaaaaagaauucugcacucaaauuugcucccaugcaucuuuaagaucccaagggccuuuacacaaacagacaugcucacuaacccaugaugccguccggggugcggcucagacagagagcacaaucuugcacgcacucuuagccuccuaacacuggcacauguguuuccacagagccacauuucuguauaaguacacugugcuggguuauaaugaauucaagauuggaaaggucucaguugugugcauuuccucuguuaggauuccaacaucuuugugugccccacccccuggucugugcugggagcuugauucuugugugcgauuauggaugggguaccuuuaaggggcacaguguagugggaggucuuuaggucauuaggacuaacaggaagggauuaacauaguucucaugggacucagagagauggcucagaggauaagagcacacuggcuguucuugcagaggccuggguuugcuucucccaacacccacauggauggcaggcucacaaccgucuauaacgccaguuccacagaaucugaaguucucuucuagccucugcaggcauugcaugcaucugaugcacagauguguaugcaggcacagaauaugugaacacauucacauaaaauaaaaagaaauaaaauaucaaaaaacauuuagaagaguuuuugguuuuuuuuuuuuaagcauuuugaugggcagcacucgggagauuuuggugcguagaucucuguguccuacacagugagacucugucucgguaaaaccaagaccccuucauuauauuuacuuauuuucugugccacagcaugcauguggaggucagaagacagcuugcaggggucaucucucuuucuaccacuuggguggcagggaucuaacucgggucaucuggcuuggaggaaaggaccuuuaucuuacacagccaagaggauuuuuguuugguguaagugugugcaugugcauguggaagccagaagccaacgcuaggugucuucuuuguacuucacuuuagcguugcacacacauguucaugggugugugugguauaugaacauguguccaagcaggggccagagcacgaugcccaacauccuccuccaucacucgcuguccaucauuccuuucagacagcgucucucacugagcauggaguuagccugcuguccagcaaggcccagggauccuucuguuucaaccccccacaguccuggggugacaggaacacaaacaaggccuugccugacuuuuucccuucauauuuaaaggaguuuuguuuuggugugugucuguguguguguguuguguguuggugugugucuguguguguguguguugugugugagugcugaugacauaggacacacuuuaucagauccccuggagccgagguuguagccaguuguaagcuggcaguguggauguagagcccuaagcucugaggggcagcaaggguucucaacugcugagccauuuccccagcaugggaagugggugauggaaauuugaacuuaggcucaaacucagcaaacucucucuccacugaucuaucuccuuggccccuccuccuuaacucuucgagauaaagucucucacugaaccuggagcuuggucaagugcuagacuuucuguccauugagccccaggaacccuccugccucuaccuccccagugcugaggucacaaauguguaccacacaugguuuuucacaugggugcuggaacucaaauucaggguuucauggcugcauggcaagcacuguacggacagcaaucuggccaguggcccguggguugucauuaggaaguguggccaucccaucucuggcuuccugugcuccuguggggucacucuaacucauaccugcuuuuauaugacaccauuuccuacuaaaguaacucagucagggaggggacuuaacuccggcuaaaucaaugaaguccucugauuuuaaguuauuagccuucaauauuaugcuaacaaaaccucuuuucuucauaaaauauccagcuucagauguuuuuguuauagcaauagaagcagucuaacacaucccucugguugauggaccaaacaaccagaccacaagucaucaagugaauauagacagauaucacagguaccuccacuuagcagcugggaaaaugguuucaagaaccucacucaaggacauggaggucauaagcacuucugagaaugagaccaugaugcucauguuuuccuuaauacucucucaaugccaugagcuguacagccgagcauacccccaucccugccuccucccaccuccuccccccucccccccccccgagugcccugggucacagccuggacccacaggcauccgucucucugccuuuccccugcccaccuccaguuccauggccucuuaccuuagguccugggcguccuggauaaccugggagaccuggcaccccaagcuugcccugcaggagaaaaaagauuguagaacaaaggucacacacugcaggcuggagaccaggggagaaacggugugcaaccugugcaaccgagugagaaccuaggaaacugagguccuacgagggaugugccugccugcgaggggcucauucaccaguauaagccaguguccuccucuguaaggggagggugagcuguuuaccacaggaacuugagagauggcucaguaguuugauucccagcaccguaucaggcagcucacaaccaccugugacuuuggcuccagggauugaccucuggaggcaucuguacucacacagagagacacagaauuaaaaauaaaaauaaaucccccaccccaccccuuuuaaagacagggucgcauuguguagcucuggcuguccuagagauccaaguaccuuuguuccaccccaccccaccaucucuggaauuaaaggaaugcaccacuaugacauaaaauaauucuuuuuaaaagucuaucacacagagucgcuguggggauuaaaacgaaggugcaagcaaguaauugcucugcaaugcucagcaaauaaaugaaguaugccggguuagcucagcccgacaucccuguccagaaucccccagugagcggcuggggugggacucaguguuagggccccugcccagaguccccaguguggggcuggggaguggcuccacaguacaacuguuuucuaacaagugagacguccugguuccauauccagauuggacagugaggcagcagccaggcacggagaugggcaguaaacgacgcaaguggaccaugcaaaucaccuucuccccugcugcuccuggaggacccucaucaccaggcagucccccaggccccuuuuguccuucuggaccauccucuccucugggaccuggggguccgggguuucccugagguagaaaauauaagucaauaaauaaacuguuuaaucacagcccaucccauguuuacaccacacaguccucaucuggagcuggucuuacccggucgccuuuuggucccucaucacccuugaagccaggaaagccauccucucccuggggggagauacagaaauggagacagagcaggcaagagcagggagaaaggaggggagggacagagaaagggacagaggcaggcgaagaguagaagucagggucuuagggaaggaacacgggcaggggcucuuuaugggggcucccucucccucccuuccagugaaccccuuccuccucacccuuucuccuuucucgccuuggagaccccgguuaccagagguacccuaagaaaaaauuuagagagcucucagucuccuucccugcuaaaggaagguuuuagacuuccucccuugaccuaaaauugugagaacaguugcaagacggggauagugugguggggagccccagagggagcagcccugucuccucugagccccucaguggcuccuccaugccugguagccaccccaucccccacccccaccauguucagaugaguggggagaagcaggagagccaaaucucuacgccauucaucucuacuuccugaggacacagugucuacaguuccuucuggcagaagaaagaacauuccagaggccaguuuuauuccaaaggcaggggagaguuuccccauugugcuggccacaaggagacucugugccuggugacagcaugcccaucccgugcagagcgcauacccugggcugacuuccugccuguaccacacugaaaaacugcacuuggcucagacgggaacugagcucaacugaagaaugaacaagcaguuggagcugaugcaacuaugcacuuggaaacagcagggccuucugcagccccgcaguaauucacuggaccucaguaaagaaagcuuuggcugcagccauccucucccuuggcuacaaaguaacucgauucagauacaacacaggcggcagccacagcccuccacuuaucugcaaaauaagaugggacacccccaccccucaccccccaccccccaggaguugccagaagggauuagagccagcccuuaucuauguugccuguucuaugcauacaucaaacuaugauaaaagacaauuuauaaauuaagcaaagaaaaagacgagaaaagaaacuaacaauaaaauagagccauuaauauacuguuuuuucauuuguuuacuuucuguuuuguuuugguuuuugagacaagggacucuuguuuuguuuuugagacaguagucccgccuaccuagccuggaauucacuaugaauaccagaauguccuggaaagcacagagauccuccugccucugccucccagguacuggaguggguuuugcuauuguuauuucuuuauuuugcuuuauuuuguuuugagacacugucucauguagcccuggcugauuuaaaauucaccccauggcuaaagaugacucuggacuuccaaugccucugccucuaccaccuccacacuaggaccacagcauguaccaccaugcugaguuuauagggugcugggauuggaaccugggacacuccauacaugcuaggcaagcauucuguggucugagcuucugccccagccuuuuuaauucuuaguuugaaacaggcuggcuucaaauuuguauagcucaggcugaucuuaaauuccugaucuucuucccucaaguacugugauuacaggguguguuuguguguguuuguguguguguguguguguguguguauuuuguuagugauuaguuugugaaacagggucucaaaauauaauagugcaauacaccucuggcuggcagaauucauuauauagcccaggcuagccuccaacuuggaggaaucuucucaccucugccucccaaauacuggggccacagacaucacaugauaccuggcacuaaguuggucuucugacaccaacacuaaucaacagucccaccuucaagcccucagggguucccuaccuucacaccacgaaguccaggauagccccgagggccugcugauccuggugggcccugauaggaaaacaaggucagcgcuaucuuguucccaguauccugucuccucacuugcuacuccucuuucccaacccagccacucuccuggucacucaccugagccccuuuuucuccugugggacccucguggccuggguggcccugccagagaaacacaucaacucaucaaaggccaaaaugugucaugcagaaacccaaaacuuccccuuccccuugucccagcucguaguucucaccggggggcccucagauccugggacaccuggaauuccgggguuuccagggggacccugaaaaaaaaggggaaaaauaagaguagccugagagucucagugccuacccaggcagcucaaagugagccuagaacacaagcucugcccauguuugcugugugacgcuggugacccagcuugcccucucugagcuucggagauccuccuuaucugggagagaugcaaaagcaaaaugagagucuggguggugguggugguuguggcgcacgccuuuaauccuagcacucgggaugcagaggcagguggaucucugaguucgaggccagccagggcuacacagagaaacccugccuugaaauacaaaugaaacaaaacaaacaaaaaaccauaugagaaggggcaugguguggcucagugguagaucuccuuccuagaauccacuagugacgagcuguauaggcaagcacuaugaugcacaaggccccagguucgaugcccaguaccacagaaagaacaaaaccaguaugaaauaugcucgaguccagacuucucacccacacccccuugucuuguuucuuugcuccauuucauuucauuucauuuauuuagacaaaguucugcaguaagguccagguugcgacaauugcugggacugcaggggugugguaccauaccuggcucuccaguucugguuucccagccucuuaucuaccuuuggaccuaucagauguuuggaccaaucagacauuuuuuugauugaugauugauaugggagggucauaagaaaccaggcugagcaaagccaguuagaagcauuucuccauagccucugcuucaguuccugccucuaggguccugcauuuccacaauaacauggaagcauagguccaugagcccuuuccuccucaagcuggcuuuggucaguguuuuaucgugacagcagaaaagcaaacuaggagacacacauagcuguacacauauacacagguaugcacacaccacaugugagcacacacacaugcagagagccaaagcugaggucuguccuucauuagcuucuugggagucccuuuugugagggcaucugugagggacagagguacuaacaacgccuccucugucugccagccucagugggauucuccuggaaacccucccccaacagugccucugucacucuggacuggcuuccagaaugugacuauucaucacaggaagucccucaaaggagcccuagaguggagcuucuccuggugacagaagcaagucacuuaccuuuuccccgggagugccaaugggccccugggggccuggaauucccugggacauaaaaagaaggugaaagagucacaaaaagagagauggacaauaaaacuggacaagggaggacuguggcucagccccccacaccccauugucaagacagaggcuugaaccugggagccgugguuuccuugcuguccuggggguccugguucuccaggaggacccugugggggaaggguggguucagugaagcaggaaggcgacagaagguggaggguaagggaaguuccaaguagacaaggcuauaaagaucauggguuuggagagucagaagggcaaaaacagaugguaggacgcuuaccacguugccuuuggccccuggugcgccaucacucccugucacacccugcgaggacagaggaugugagaccagaacagaucagaacccgggugugagcugcugagaaacauguauaaaggagacagcagcaacagaaagcuucuuccggcucgggagaugcucagaggguaaaggcacuuguugcacuagcaaugaagcccugaguucaaguccccggaacccaugcaaaagucuaacuaguagcacuggcauuuguaauccccugcagggagaggagaggcuaaagacugauuucccuggaaagcguggaggccagcaaaguggaaaauccagagaaaacccucagacaagcccaggcgaauguucacucaggaggcagcagaggcaggaggaucucuaaauuagaggccagccuggucuacaaagugagcuccaggacagccagggcuauacagagaaacccugucuuuaaaaaaaaaaaaaaaaaaccucaaacaaggugggaaaagaccaacucucacaauugucaucagacuuucacacuugcacacuugcccucuugugcaggcaaucacagucacacagagcaaggacaagagggagcgaggcagaaaggggguggggguuacucaguggauaaugacacuugcugcuaagacugauguccugaguuuaauuccagggauccacauugugaaagaaaagaucugaucuccacaugugggccgugccaacacacacacacacacacacacacacacacacacacacacacuaaagggguggcuuacaggggaagacagguaagaauaaaacauagacagggagucaacaagauucucaccgggcguccuaggggaccugggagaccucuggggccaaucagaccucggggacccugcaaggaaggagccacauaauaccagcaucagagguauauauuccugcaaguuucaugccccaaggggauucuucucuccccugaacagggagucuggggucucccaauacuuaccggcucuccagccuggccagugggcccuggaggucccugcaggcccugaggaaagugucaucauuauuugcacugggcaaguacagacccgagguacaaccuccccucaucuagaagccccuuuaagagucagcuuggugucuucccacucuuaugacggagcucagucuccaggccuugacuuacccucccacauccuaacccaaaagcuagcuaucagcuccaaugcugccuuuuagaggauccugggcuuccugcuccugugguguagaccccaauccccagacaccacucagcuuauuucuggguuuuguuugcuugcuuguuuguuuuuuguuuguuuguuucaaugccagggaaugaagccagggcuucauauaugguaggcaagugcugcaccacugauccccacccccagccucuuuccuaugccccccuccagcuuaccuuuacaccauccucuccugggggaccagguugcccuacucguccaaagucacccuagugcagagaaggagggguucauuugaauaaauuagcauaugcaggagccacucacuucagaauagaaguucagugugggcccugaaggcucagacaguguaugaagcucugaagucaaggaagcauugcacacggaaacaggguguggguauaguaggggcacucacccuuuggcccuucucaccaggcagcccgggcaggccaucaaagccccugucacccuuuuggaagagacagcagcugccuuaaauccuugaccuugacaucuccccacccugcaaugccccccucaacccguccuggccccaguacccaccuuagguccugugucucccgggagcccccgagccccaucugcuccagcucggcccuaugaagaaaaugaaccaaggauggaugaaccucccagagcucuccccucuaaauguccugccauccaguguggcuacugugcacuaccuuuuacugucucccgaggacugcuuucuuaaauuuuuggugguggugguggugguggugguugagccaaggucucacugugcagcccugguuggccugguacucacuauuuaugcuaggaucacaggccugcccagagaucuaccugccucugacuccugagugccgggguuaaagucaccaagccuggcuaguguauucagugugugugugugugugugugugugcguguacaugugcauguacgugccauggcacacguguggagauguggaggucagaagacgacuuguggaagucaguucucuucucccgugaggugacucucaggacugaacuccagauaggcagcaaguacuuuccccuaugcaaaguuaaaggaugaccuuggguuucuaauccuccugccucaucucccaaaugaccuuuuuguaugugugcugcuuagguuguucuucacuugcuccuaaccauacuugggccccugccaagcguugucccuguucucaaguccuccugaagcugccaccugccccaucccuucacugugcacccagcugagcaucugcugcagucuuccgagcucaggucccucugauaacacaggaagaccagagaggacgaaggcagguuuuuuuguuuggugcugacgguaagcaaagaauaacuuaagaaccuagacauuacucacugucuugccuucccguccaggaggcccaggagggcccuguaauccucgggggcccugugguggggaacaagaaggaagaauuaaaagaaaaggcguaugcuucuuuuguuuguuuuuuguuucguuuugacaaggucuaccaugcaacucuggcuggccuagaacucacuauauagaccaagcuggccuugaauuuacagagaccccccugccucagccuccugagauuaaagaugugcaccaccgccucaguagauacgcacaccuuugaucacagggcucgggaagcggaggcagggggaucuuuguguuuuaggcuaggccuugcccuccugguccuccagccucuaccccaccaagugcugggaugacaggugugcaccccacaccugguuuaugcagagcugggggcugggacucaggguuucauucaugcuuggcaaaugcuuuaccagcugaacccagccccuagcccagaaccuauuuuauuuaucuuuauuucaugugcauugguguuuuuuaccugcauguaugucuaugugagggugccuauggaaauggaauugcagacaaucauggaccacuauaugaguacugggaauuaaacccagguucucuggaagaacagccaguguuucuaaccacuagaccaucuuuccaacucccuuagagccuauuuuaaaucacuccccaggaggggcagaaguuucaaagguauauuucuauuccauuuguuauguuccccagcuggccuuuuauccuguaaccuuuggagaaagcguuucccaucuaauccguucuccccccauaucccuccaaacucaccuguggccccacuucucccaguucaccuuucagaccuggauauccagggaggcccuugggggaggagagaugggggaggagcacaguuugagcaauguggcuaucuggcacggaugcacucucuccccagagcagaccccuuacucaccacagggccugggcgcccagugagcccuacuggaccagggggcccuuucauggacagcuggaaagacagacagagcaagaguucccccauaagaccacagaaucacuacuagagguaggagugugccuccuccacagguuguaaaucucuuccccgauucauguguugauaacacuuugaggggagccuuuuggaagaugauugggauuaggugaaaucagaagggugggguaccccauccugacaaucaguaccuuuaggagaguaaggcuuauccucauguaugcaccaucuugccuugcacugccccccaccaguuacaaugcacccagcuaggcggcagcauggugcucugggacuucccagccuccagaaucauuagccuggauccucuguucuccauuaaccacccaggcucaggacuuuacaauaacaacagaaacucacagcaagcaucuucaggagagagauauccucggucuccaaccaguccugcacgagccuuuauuuaugcugucccucacuuaacacauggcccuuaccccacucaccugagccuguugcaauacugccugggccugggccugcuggaaggacacugggggucccuucaucgagcugcuugcaaaauggaacuaaggaacaacuauggaugaguagagaugcacaggaaggcauccccuggggucaggacuccacugcccagggaugggacucucccuccucaccggcaucauaaucacugugcccggcaggccccgggcuccaucgaugccugggauuccugggaggccggcaggacccugagagaaggagcaagacagagggguggauggaugagguaaggacagcagauggaagaugagaggggacagagggggagcagagacugagaaggagccugaugaucugaguuuggcugcccgagauccacaugguagaaggagagaacugagucuggcaagguguccuuugaccucugaucaggugccaggguacaugccacuaccggccaugugugugcacaugcauaaaguagauaaaugaaaaugacaugaaaaauuuaaagaugcaccaaaacagaagagaagucaggguuuacggaguucacagauggaggcaacaucacuucugggaugguguuccuaaucccagccccgcacacccccauucaaaucuacacacccccauccugaaaucccaccccaacacaggcauacacuccaguggggagucucuuaccgguagaccacgguccccagggaagcccggaggcccaggagggccugaaggaccagauauucccuguggagacagaaaucagaggucacaggagauguagaacaugagccuagcuggcuucugacccaccgaugaucuugucuucaagcauaccuccugacuaccacuuagccagcucugcucccaccgugaucuauugcccucucaacuuuguacccuaaaucuuuuuugacauaucuuuuggguauugacuauccaaugaccuucaggcaacacuauaacccaaaucuucuccccaucuagaagagagucaggaaccauggugcacaccuguaaucccaaugaucaggaggcugaggcagaaggaucaagagacagaguccagccuaggcuacauagugagaugaagacagccugggcuauguaaaagaaaaggaaaggaagagagcagcuaugugagcaacuagugccauagcugguuugugcaugggcccuaggaggcagggcauggggaagagguuggaauacgggacuagaaccaguacucacccgggguccuggagcuccugcaggccccucaaacugcugucccugggguggaaacaagugugaccccuguucucacggagccccuuaaccuccucacagccccccccccucaccugcucuacugucgcaggcucuccuuucgcucccuuuucuccagcacccuagggacagugaggagagaggaaacaggacauaagggcagagacagacagagacauggcggcagagagguugcucuuuguaaacacacaggccauccaagccugaacucaggcucuggacuccacaguggacggagagaacugacuccugaaagucguccaaggugaagggcgugaacuccaaagaacuuaucauggcucugucucucucccagugaugcugggaccuuauucaaaccuguggccaucugcagauaacucaugaagucauuuaaugugugacacacauacaacaaaugagguucaagccugacacacgugaugacuuagccucuuuguuaaccugacuggauuugaaauugccuaggaggggccagguguggucucaugcuuuagucccagcacucggaggcaguggcaggcacaucucugggaguucaaggccagauggaucuacauagcaaauuccaggauaaccaaccagaguuacacaguaagagucugucucagugaguggaugaaugaaugaaugaaugaaugaaugaaugaauccgacagcaacaaaaauggaaugacccaggagauuggugagaugaaacuauggugugucuggaugcuuccagagagaauuuacugagggaggcauccagaggaacuguggugcuuccccagauagaguuaaaggggaggagagcgccaggccagcgagaacagcuuucccuacucauugcuuccccuucuccaagaacggaagccucccaccacauguuucuguccccaugaugaugcucaacuggcaacuguaggaacccuuugcagugggagcaaagcgaccccuccucuaguugacucuaucagguauuuucuccuagcacaagaaaguaacagagcaggaagucagugcagucucaagucugacuccgccucugccaacaccaaggaggaacagggcugccugccccucuagccuuguccacccaaggcuuuaugacuaagucagccccaagucuuucuccucagccuggaugggcuccccuggacucuagaaucuucuagccaucccuggucugaagucucacuuaaaugucaaacagauguuacaaguucaagacaccaccaggagaugacaaccauccaucuccagcgacaagagaaggaaccauguccuccaacuggaguauucucucucccauugcuugcuaacucuacaagcuuccccacugacucucuggcucccccuacuguccacucagcaggcagggcacgcagagagcucgaaguccaaaucuccccugcuuagacuaaaggccacuugcaucaccagcccugucacacugcaagugcuugguaaacauuuugcagcuguaacugugccagggucacacaaagguaguugacccaaaacaaacacagucaagaacaagaauguaucuacagccccucuccuggcccagcgucuguagacucacaggaaagaucuggaacucagucuguaaggacugcucugcugcccggaacuuggggcccaugguggggccaccuccuucacccuccucaguagaguccaccucuggagucgucugcucgguuucaguaccggaguccaaccccuguggaggacacugggaacgucaagguuugcucuuggccauccccuucaccaccucacccccuggcccagugccauccacuucccaccaaccugcgagacuguggcauuuuguccaaucgugacagugguggugauggccagaggugugggagucagaggcagguggggaacugucuucucugucucagggauguggagggaggucugcagcagacauggaaggagugucagaucuggggugaggccaaucaagacaaaggaaacaaaggaggagccagggcucucccuuaggggaauccccaguucaggggugaguagacagagguagcuucucggcaaauuuagaggcuggugggggaaaagacaggugccccguacaaccugcccaagguggccagaggggaaaccuccuuggauacaagaggagcaaagcagggccaaaucucccaggccugggagcagaacuagauuggcuccagggcccaguggcuaaagucaaaagccagcacucggggccagacucccggaagcccagccccacaugucuucuccccugacaacucagccaucagccagccaggcugcaacucauccaaccuggacagcugcagaagaacugggucaaggcagagaacuugguagucauacugugggacagaaagauccagaacugauaucuaauuacaacccgugaccccuccaaccaaggacuucaagcaaugacccaaccgaugacuuaggaccccugcccaguaauuuaccagucaauaaccuacacaauuaacccaaauuauuccaagcugagugagcccugccugccuuuaugauucccgucgacggcucugaagagaaagccuuucauccagggacucaaguaugaccccaaguaguagaauccuccaacaaaaaucacuauuuagugacccccuaaauaaugaacccucucugggauccucaauuaagcauuccacuaacaaugaccccauuaugucuucuagcaaucucccuaauuaauaacccuuaaccuucaacauucaacuagugcauuggcuuaucuaaauggccuccugacacagccuagagucacccgggaaggaugucugugaguguuuagacgaggugggccagggggcugucucuggaagguugucuugaguguuaacugaagauccagccuacuguaguuggccccuccuacaggagguucugaacagcuuaagaacagccagcgcuggcugagaucgagcaagcaggcgggaacucauggauuuccucucucugcuuguaauuguggaugcaaugcuuuaaguugcugccugaguucccccagacaagggacuguaaccuggaauguaagccgaaauaaccccucucuccucuaaguugcuuuugaucaggacagggguuuuuguuguuucgcuuuuugauuuuuuaaaaauguguauguaugugugcacgugcacacacucacacaugcgacacgugagugcagguccccugagcagggagggcgucagauuccuucuaauuggaauuacaggcugucaugagucaugucaggggacaguguugccaucaaaggcaacuguagguaugaaagacccucaaggcccagccugugccauucccuuguggaaagaggucggaggcaggcaugggcuccucaucugagaugccagccacucucuucugggccccucccagcuaucuguaaucugcccaggaugcacguggucuccuggucucugggaaggugagagugcugaguguggaggcuaacugugggcccuccaucugugcagcuaaggggaaauucgguagccaugcuuagggagacugcuuaggggucaccacaccccaguacggaacgccucacuuuagcugucgguaaguacgguuucccaagcuagauuugagugaaaucauaccuugguuggccauuacuucccuaucuauugcucaugucuaccgggaaaaguucacacacaacaaagaccagucaaaauaucaacagugaccuuuaucaacgaccuuuaccaaaggccuccaacuaggccuccaagggaagaccuccagcuaggaacuccuuacauauucaccuuaaugagcaaccuccucaaccagcaauccuaaauaguacccucaagaaguaaggguggggaggggagaccuggaaagggggaaacauuugaaauguaaauaaagaaaauauccaauuuaaaaaauuaaauaaaacauuuuuaaaagaaaaaaaaaaggugagggugaucagaauaugacaucugucaucacacuggucuccaggacugacuuugcuagucuagcucgauaggcagcuguccccuuccucccuugcugcuccaugugucgcucccaaaggugcaaauuuaaagaggauagccuucccugacagggggcugggagugucugugcccccugcuagaaccuccagaugaguuuccaaacagggccaucaagggaaaaauccccaccgguggccccagcagugaaccccacauacugacacaauaaccaaugcgccugaaaccaguuacccgagcugaugaucccccacuaggacuccacuaugacccuucuaaucaugggguccucuuguguugagaggugcuuccuccucuagcuccccacgaguacagaguguggaacagacaugaaagagccccugacacaggaccugccauacccuuccgcugagagaauuagaccucaggagucaggcccugaggaccaacacaaagaugaggggcuagagguggguggccaucaggcagcgaagagcaaagcagaagguuccggguucuuaccugguucucaggggcaccaggggucggacucagcucugaggucuccuuguuuuucuuucuucccuugcccuuucgaccccgcccuuuuuucuucccuuugcccuuucgacgacgaggggcagggguuucugguucaucgucuuugggggccugaggaaaggguccuaguuagggcuauaaucucuccccauugggaaugccaucacuugcgucacugagggcuaacuugugguuuacuuaccucucucucucucucucucucucucucucucucucucugugugugugugugugugugugaccauccacauagccauguugacuggccagugaaccccaggaauccuccugccuccgccuuuccagcacugggauacaaauguuccaccgugcucagcguuuccacacagacucuggagauaaaacagguccuagugcuugaaacugaagguucuugacugacugagccaucuccccgugcccaggcaggaggcaggauauuuuguuauuguugauauuuuggagacaggauuuugcuuuguaaccuaggcuagccccaaagucaguccucgucaucagccucuugaauacagaggggacugagaugugccucaccacaucuggccugauguguugucuucugugaucugcccugaguuuccagucuaaaguuguucaccucuuuguuucugggucaucguccacucucucuugauaccuacagacagaagugccaccuggaacuccccacucaccccugugguuguggaaucgaggguuucacaaccagggagguagcucucacaggccuggaaggcagccugagggucuggaauuaacagcagcuccuggaugucucccuagaaaggaggaaaaggagccccaggcugauucuggucugaguuucccagcaugccucugcccaccucccucccagagcacccuaaggaagggaaaaccuacagcaucuacagguagcaaagaagcaacgaucucaccagccccgggacaccacagaacaaaacacacccagugugaggguuaagcuugucaacuuuuuaaaauggcauuuaucuacuuaacgugugugcaugcacaggcacaggugugccacgucacuccugugugcagcugagaggacaaccgacaggauuuguuucucuccuuccaccacauacauuucagguucaagcucaggucaacagacuuagcagcaagcaucuuugcugacggagccauccugcggggcggggccccuagacagucaagucaucuagacuaggguccuggacuaggaagaaggugagcuggguaccaguacccgucucuguuuccggaccugagaugcagucuggccugcucccucacacaccucuccaggaugggcagugcccucaagcugcaagcccaaggaaaccuucaugcuucugccuuguauuuugucacagcaaugaaaaacgugaccauuauagucagcaucucccugaagcugaaggacccuguccucucaugucaacucuguaugcaagguacuagacagcgguggcucacuagagagaugagguccccagcaugggcauacacuauccuggccaccagaccaucgugugguggucucagccaucugccacaagcauuuacuccagcagggaccaugugugaggagaccugacaucuugacgauuuacugacucucuugcgugacacucccucccuucagcucuguggggcuagguggaaacugggcacuuuccuuuucuguucuuuuccaguuuaggcuggggacaaaacuccccacccucugccucaguuuccccuaccacugaacuacauaccucaaaagacucuucccugguguccuggguucccaucacagugaguccagcuguacuuauaaaccgaggccccugaccaaauguugggggcugcgguucacagucaaccaccagggucaccuuguuaccacugaugcugacugccacacggugccaccugcaaaaggaacaagucucagugcaggaauuuccacagggcgucccuuucccuucccccauacucaccugccauccauaauguugacuugcuuggggaggggccugaaggagucaccaaggaggcccagagcuggccccagugccagccccagcugccggacacccuucucaucauaaauagacagaaggacagacugauuggcuggcugggcccucagugugagcagcacagaaaaguucucaggaaaaugcccaucuguguagacagguaaagggaacagguuagacaguguagauccuuccaggaugacccccucccaagccuuccuguccuaacucaccugggaagagcugccacguggggacacugagaaggcuggacuugcccacccugaaugcucggucacccuguggaauccucagggggcagaagccaggcccuucagccaccccagccuggucucuaugcacaccccaggcuuccaguacguccacagguucugcuguagaaagacaccaggaugagaagguuuggccagaaccgcauaggaauugggccugauuguauaaucuccaguccugauagcuacucagaaggcugaggugggaggcucuucuaccugcucuacacagugaguucaaggccagccugagcaacuuaaugagauucugucugaaaaucgagaaguuaaaaaaaaaaaaaaaagggccccaaacuccauaauacuugcuuagauuuggggauuccuguccucacaguucaggaggaagcgaguggccugggacuagcagcaccucccccacugccccacagauguugcugguacauccgucuguugacugguuguuucuuucccccuaaguuuuuggugagaaaaaaaaagcugaccuaguucuaggaugaaucaagucuuccuggcuggagccccagagccaagccuucccugcucccuacacccccacacugguuccuugggcagcuucccggcauggagcccccuugcaagggaaaauccacaaaggagaaaggggugugcagggguacacucuucuuagaccucauagccuccucccucugauccccagcuccauggcgucucccugagauucccaggacccacagccuucucccucuuauuccuucaucuaacucucccugacuuccuccaucugacuccucaucuaacucccccugaccuccuccaucugaccuggaccauuuuuaucaccuucugaucaucuauuucugauaacccccugaucucccucucucaucccagaaaagaaagaauaggucugaucucacagaccucuaauccaagccaucuuugcagccccacccagucaucuuggccaguguuaacugaauccacaugguuugugcagggugggugagggcuuccccugggcccaaaaccccuggccugucccuuccccuagcaaacugucccacuaacccccugacccagacucuuggcagagccagguucugcuaaaucugccaggucgucacuucagaguagcucagcugaccucaccacugaaaauuggguugggggacuagacuuggagaggaagggacauggaugaagacagcccccaucccagcuaccccccuuuacccucugaacuuuguagaguccuguucaggucccuguauccucaccucucuccauucuaccuucucucugucccacuccauggcucaggucugaaaucagucaacaaucaauuuugcuuucuugguauucucucucuccaucuguucuccccguucccuguccccaucuauaacugucucuucaguggccaggcugucauuaagaaguauuuggauuacaauuuccccaccaccccugaggcugaguuugggcucucaggcucugcuaaccacaaggucaucccguuaggacaucccagcuuucccuauggacuaggagcccagggaagauuuagauccacaacaucauccgguagaaggacuuugcccagcucaguuuaugguuuuuguuuucaagauaaggucuacuguagaucaggcaggucuugaacucuuaacccucuguuguucaccuccagagugcugggaugacagacgugcuccaccaugccccauuuaugcagugcugggauggaacacagggaugugugcaugcuagguggauacuuuaccaacugagcucccuccugacguagaucccagcuucuaugcaguaggaaaagggggcucccuuggucacugcucacucccauuucaaaaguccucccuggcaucuaacucagaagacucuugcuucagccuugaguccucuuggcagugaccuuucaauggcugacugcccuuucucucucacgguuccacaacaagaaauacacaagagccauugagccugcggggcacgcaggaggggucagaagcugcccaaacucuucccccacauacacacccucucccugccuuggucaaggcucuagggagauguuugguggggucuaggauguggagggaggcaggugggaugcagcugggucauugcaggaaaaugugcaagcacaggacuugccacugguugagguauaggcaguuaauuagaugaaaguuuucaggauugguaagauggcucagcagguaaaggcacugcugccuaguccaauaauguuagcuugagcccaguaacccacgugcugagaggagagaacuggcuccuucagguugucugacuuccacaugugcacacaugcacaaugaagaaguguaaaaaaagaaggaaaaaauguaaauuugaugccauuguucaucaggaguggcagcaagaucuccacggcguuuacuucacaggccaggcguguaacaggagauggagguuuuaacccccagauuucucccacgcaaugcaagggaaaauaugaccaagucacugagugggcgacugcuuguggaagaugacagcaucggucugugggccauagagaagcaugugugagaagcugaaaacccaggaggguccugucuggguggcagaugggguugccuggguguggccaugaguugcacauuccuggagucccagggguguuguauucugaaugaaugccugagguugcaugacccugagguugugugagcgugggaauggggcauaggccaacacggaguuccccacguggucugcaaccuccccagacucagcagaaauugggaaaguagagucaguguaugcauguggccucugggggcagaacgcaccuuccuuuccuucugggaugugaucuaggucauagaugcccuggucauccaucacuuggagagucaucguguccucucaccauugccacccggagaacccugagaggcguggcugaggcaucaggccacaugcucacagcugggcaugcgucagcggugacucaccagucccuuagcccugggggacccccuugggggcccugagaaauucuucaggaaaaaucaccccaggaucuugcagcugggguacuaugaaacuuccacuuggccgcuccagcgggcgcucagccccaccccuccucgugccgcaccccgccucgccccucaaugcagcccucccgugggcccuguccauggugcugaugccguggcucuagggagaagggggugggggaggggaggaggaaggaggggugggagccaguuucgggcaaagagaggaaaauguaaagcccuugggagaagugcaaaagggaacugugugggucagugagacggcuggagcagguugcuugcugcaaagucuaaugaccugaguucgauuccugggaccuacaugguagaaggagagacugacccucauaaguuaguuguucaucugaccugcacacucacucuguggcacaaggguacagagagagagacagagacagaggcagagacagagacagagacagagacagagacagagacagacacagagacagagacagagacagagacagacagagacagagggacagagagagacagagacagagacagagagacagagauguaauguuuaaaagaaaacugugaauucuugauuuguccaucccacucaccaccaaccucagaaucagccauucauggucccgugggcaauaauauaaaccccuaaaucccaacuacagccaaccaaaaacaaauaaacacaucuguaacacaugauuacucucaaaaauaaucucagugggguuagggaugaaacuugguagagagcaugcuagccuagcaugcuggaagccccaaguuccauccccgguaccacacgaucugcagucccagcacucggaggauagaggaggguuagaaguucaaagguacagccuggauuccauaguaagugugaagccagccugagccccaugagacccuguuucauacaacagaggagaaaggagggagagaaucacagacccacagacccacugaccucucacacccuccuaagaacugcccugucacccacacuuacgccaucgcagucaaccaucacacccaagauuuuggugggggagggguuguuuugugcuuguuuguuuguuuguuuguuuguuuaagacaguguagccagccauggaugucuuggauucacuuuguagaccaagcuagccuugaacucacagagacuugccugccucugccucaugaaugcugggauuaaaggcaugugccacaaugccuagcuuaaaauacgguuuuuuaaaggcaagcucucauauagcccaugcuggccucaaauucucuauguaguucagacuggcuccuaacucuuuaugcuccugcuuucauggucccaguccugggguuguggguaugcaccacugugcugagaauggaauccagagccugguguguguuagaaaagccauuuccaaccgaguuacagucccaugucucauacacucacccuggcccuuuuuagagacagggucugcuuaugcagcccaagaugcccuucaauucaguaaguagcccagacaagucuugaccgugcaaaccaccuaacucugccucuuaaauguugggauugcacuauaccaaggagcauucaucuucacacaccagcuuguaaacacugcccacacuuuuccuggcaacaucucccuccucacaugcaucugucagcuagagcuagacccuagggccuccacaucaccauggcacccauuaugaaacacuucucccuugcacacacguuuugggaucucccuugcgcccucaaaugcuauuccagcccuucgucccugcucaccagccagcguccaggacacgagcugcagggaggccaggagcaggcagaggccggccugaagcugauccagucuccggcagcuucucaucccagcggggccuggugcaccaaggccaagggggauguggacuggucuuccugggagcagucacucuggacagccggaggcugugaggaucugcuggagacugcccgagaccccg

SEQ ID NO: 4938 - RNA, 45020 nt, Mus musculus
cggggucucgggcagucuccagcagauccucacagccuccggcuguccagagugacugcucccaggaagaccaguccacaucccccuuggccuuggugcaccaggccccgcugggaugagaagcugccggagacuggaucagcuucaggccggccucugccugcuccuggccucccugcagcucguguccuggacgcuggcuggugagcagggacgaagggcuggaauagcauuugagggcgcaagggagaucccaaaacgugugugcaagggagaaguguuucauaaugggugccauggugauguggaggcccuagggucuagcucuagcugacagaugcaugugaggagggagauguugccaggaaaagugugggcaguguuuacaagcuggugugugaagaugaaugcuccuugguauagugcaaucccaacauuuaagaggcagaguuaggugguuugcacggucaagacuugucugggcuacuuacugaauugaagggcaucuugggcugcauaagcagacccugucucuaaaaagggccagggugaguguaugagacaugggacuguaacucgguuggaaauggcuuuucuaacacacaccaggcucuggauuccauucucagcacaguggugcauacccacaaccccaggacugggaccaugaaagcaggagcauaaagaguuaggagccagucugaacuacauagagaauuugaggccagcaugggcuauaugagagcuugccuuuaaaaaaccguauuuuaagcuaggcauuguggcacaugccuuuaaucccagcauucaugaggcagaggcaggcaagucucugugaguucaaggcuagcuuggucuacaaagugaauccaagacauccauggcuggcuacacugucuuaaacaaacaaacaaacaaacaaacaagcacaaaacaaccccucccccaccaaaaucuugggugugaugguugacugcgauggcguaagugugggugacagggcaguucuuaggagggugugagaggucagugggucugugggucugugauucucucccuccuuucuccucuguuguaugaaacagggucucauggggcucaggcuggcuucacacuuacuauggaauccaggcuguaccuuugaacuucuaacccuccucuauccuccgagugcugggacugcagaucgugugguaccggggauggaacuuggggcuuccagcaugcuaggcuagcaugcucucuaccaaguuucaucccuaaccccacugagauuauuuuugagaguaaucauguguuacagauguguuuauuuguuuuugguuggcuguaguugggauuuagggguuuauauuauugcccacgggaccaugaauggcugauucugagguugguggugagugggauggacaaaucaagaauucacaguuuucuuuuaaacauuacaucucugucucucugucucugucucugucucucucugucccucugucucugucugucucugucucugucucugucucugugucugucucugucucugucucugucucugucucugucucugccucugucucugucucucucucuguacccuugugccacagagugagugugcaggucagaugaacaacuaacuuaugagggucagucucuccuucuaccauguaggucccaggaaucgaacucaggucauuagacuuugcagcaagcaaccugcuccagccgucucacugacccacacaguucccuuuugcacuucucccaagggcuuuacauuuuccucucuuugcccgaaacuggcucccaccccuccuuccuccuccccucccccacccccuucucccuagagccacggcaucagcaccauggacagggcccacgggagggcugcauugaggggcgaggcggggugcggcacgaggagggguggggcugagcgcccgcuggagcggccaaguggaaguuucauaguaccccagcugcaagauccuggggugauuuuuccugaagaauuucucagggcccccaagggggucccccagggcuaagggacuggugagucaccgcugacgcaugcccagcugugagcauguggccugaugccucagccacgccucucaggguucuccggguggcaauggugagaggacacgaugacucuccaagugauggaugaccagggcaucuaugaccuagaucacaucccagaaggaaaggaaggugcguucugcccccagaggccacaugcauacacugacucuacuuucccaauuucugcugagucuggggagguugcagaccacguggggaacuccguguuggccuaugccccauucccacgcucacacaaccucagggucaugcaaccucaggcauucauucagaauacaacaccccugggacuccaggaaugugcaacucauggccacacccaggcaaccccaucugccacccagacaggacccuccuggguuuucagcuucucacacaugcuucucuauggcccacagaccgaugcugucaucuuccacaagcagucgcccacucagugacuuggucauauuuucccuugcauugcgugggagaaaucuggggguuaaaaccuccaucuccuguuacacgccuggccugugaaguaaacgccguggagaucuugcugccacuccugaugaacaauggcaucaaauuuacauuuuuuccuucuuuuuuuacacuucuucauugugcaugugugcacauguggaagucagacaaccugaaggagccaguucucuccucucagcacguggguuacugggcucaagcuaacauuauuggacuaggcagcagugccuuuaccugcugagccaucuuaccaauccugaaaacuuucaucuaauuaacugccuauaccucaaccaguggcaaguccugugcuugcacauuuuccugcaaugacccagcugcaucccaccugccucccuccacauccuagaccccaccaaacaucucccuagagccuugaccaaggcagggagaggguguguaugugggggaagaguuugggcagcuucugaccccuccugcgugccccgcaggcucaauggcucuuguguauuucuuguuguggaaccgugagagagaaagggcagucagccauugaaaggucacugccaagaggacucaaggcugaagcaagagucuucugaguuagaugccagggaggacuuuugaaaugggagugagcagugaccaagggagcccccuuuuccuacugcauagaagcugggaucuacgucaggagggagcucaguugguaaaguauccaccuagcaugcacacaucccuguguuccaucccagcacugcauaaauggggcaugguggagcacgucugucaucccagcacucuggaggugaacaacagaggguuaagaguucaagaccugccugaucuacaguagaccuuaucuugaaaacaaaaaccauaaacugagcugggcaaaguccuucuaccggaugauguuguggaucuaaaucuucccugggcuccuaguccauagggaaagcugggauguccuaacgggaugaccuugugguuagcagagccugagagcccaaacucagccucaggggugguggggaaauuguaauccaaauacuucuuaaugacagccuggccacugaagagacaguuauagauggggacagggaacggggagaacagauggagagagagaauaccaagaaagcaaaauugauuguugacugauuucagaccugagccauggagugggacagagagaagguagaauggagagaggugaggauacagggaccugaacaggacucuacaaaguucagaggguaaagggggguagcugggaugggggcugucuucauccaugucccuuccucuccaagucuagucccccaacccaauuuucaguggugaggucagcugagcuacucugaagugacgaccuggcagauuuagcagaaccuggcucugccaagagucugggucaggggguuagugggacaguuugcuaggggaagggacaggccagggguuuugggcccaggggaagcccucacccacccugcacaaaccauguggauucaguuaacacuggccaagaugacuggguggggcugcaaagauggcuuggauuagaggucugugagaucagaccuauucuuucuuuucugggaugagagagggagaucaggggguuaucagaaauagaugaucagaaggugauaaaaaugguccaggucagauggaggaggucagggggaguuagaugaggagucagauggaggaagucagggagaguuagaugaaggaauaagagggagaaggcuguggguccugggaaucucagggagacgccauggagcuggggaucagagggaggaggcuaugaggucuaagaagaguguaccccugcacaccccuuucuccuuuguggauuuucccuugcaagggggcuccaugccgggaagcugcccaaggaaccaguguggggguguagggagcagggaaggcuuggcucuggggcuccagccaggaagacuugauucauccuagaacuaggucagcuuuuuuuuucucaccaaaaacuuagggggaaagaaacaaccagucaacagacggauguaccagcaacaucuguggggcagugggggaggugcugcuagucccaggccacucgcuuccuccugaacugugaggacaggaauccccaaaucuaagcaaguauuauggaguuuggggcccuuuuuuuuuuuuuuuuaacuucucgauuuucagacagaaucucauuaaguugcucaggcuggccuugaacucacuguguagagcagguagaagagccucccaccucagccuucugaguagcuaucaggacuggagauuauacaaucaggcccaauuccuaugcgguucuggccaaaccuucucauccuggugucuuucuacagcagaaccuguggacguacuggaagccuggggugugcauagagaccaggcugggguggcugaagggccuggcuucugcccccugaggauuccacagggugaccgagcauucagggugggcaaguccagccuucucaguguccccacguggcagcucuucccaggugaguuaggacaggaaggcuugggagggggucauccuggaaggaucuacacugucuaaccuguucccuuuaccugucuacacagaugggcauuuuccugagaacuuuucugugcugcucacacugagggcccagccagccaaucagucuguccuucugucuauuuaugaugagaaggguguccggcagcuggggcuggcacuggggccagcucugggccuccuuggugacuccuucaggccccuccccaagcaagucaacauuauggauggcaggugaguaugggggaagggaaagggacgcccuguggaaauuccugcacugagacuuguuccuuuugcagguggcaccguguggcagucagcaucagugguaacaaggugacccuggugguugacugugaaccgcagcccccaacauuuggucaggggccucgguuuauaaguacagcuggacucacugugaugggaacccaggacaccagggaagagucuuuugagguauguaguucagugguaggggaaacugaggcagaggguggggaguuuuguccccagccuaaacuggaaaagaacagaaaaggaaagugcccaguuuccaccuagccccacagagcugaagggagggagugucacgcaagagagucaguaaaucgucaagaugucaggucuccucacacauggucccugcuggaguaaaugcuuguggcagauggcugagaccaccacacgauggucugguggccaggauaguguaugcccaugcuggggaccucaucucucuagugagccaccgcugucuaguaccuugcauacagaguugacaugagaggacaggguccuucagcuucagggagaugcugacuauaauggucacguuuuucauugcugugacaaaauacaaggcagaagcaugaagguuuccuugggcuugcagcuugagggcacugcccauccuggagaggugugugagggagcaggccagacugcaucucagguccggaaacagagacggguacugguacccagcucaccuucuuccuaguccaggacccuagucuagaugacuugacugucuaggggccccgccccgcaggauggcuccgucagcaaagaugcuugcugcuaagucuguugaccugagcuugaaccugaaauguaugugguggaaggagagaaacaaauccugucgguuguccucucagcugcacacaggagugacguggcacaccugugccugugcaugcacacacguuaaguagauaaaugccauuuuaaaaaguugacaagcuuaacccucacacuggguguguuuuguucuguggugucccggggcuggugagaucguugcuucuuugcuaccuguagaugcuguagguuuucccuuccuuagggugcucugggagggaggugggcagaggcaugcugggaaacucagaccagaaucagccuggggcuccuuuuccuccuuucuagggagacauccaggagcugcuguuaauuccagacccucaggcugccuuccaggccugugagagcuaccucccugguugugaaacccucgauuccacaaccacaggggugaguggggaguuccagguggcacuucugucuguagguaucaagagagaguggacgaugacccagaaacaaagaggugaacaacuuuagacuggaaacucagggcagaucacagaagacaacacaucaggccagauguggugaggcacaucucaguccccucuguauucaagaggcugaugacgaggacugacuuuggggcuagccuagguuacaaagcaaaauccugucuccaaaauaucaacaauaacaaaauauccugccuccugccugggcacggggagauggcucagucagucaagaaccuucaguuucaagcacuaggaccuguuuuaucuccagagucuguguggaaacgcugagcacgguggaacauuuguaucccagugcuggaaaggcggaggcaggaggauuccugggguucacuggccagucaacauggcuauguggauggucacacacacacacacacacacagagagagagagagagagagagagagagagagagagagguaaguaaaccacaaguuagcccucagugacgcaagugauggcauucccaauggggagagauuauagcccuaacuaggacccuuuccucaggcccccaaagacgaugaaccagaaaccccugccccucgucgucgaaagggcaaagggaagaaaaaagggcggggucgaaagggcaagggaagaaagaaaaacaaggagaccucagagcugaguccgaccccuggugccccugagaaccagguaagaacccggaaccuucugcuuugcucuucgcugccugauggccacccaccucuagccccucaucuuuguguugguccucagggccugacuccugaggucuaauucucucagcggaaggguauggcagguccugugucaggggcucuuucaugucuguuccacacucuguacucguggggagcuagaggaggaagcaccucucaacacaagaggaccccaugauuagaagggucauaguggaguccuagugggggaucaucagcucggguaacugguuucaggcgcauugguuauugugucaguaugugggguucacugcuggggccaccgguggggauuuuucccuugauggcccuguuuggaaacucaucuggagguucuagcagggggcacagacacucccagcccccugucagggaaggcuauccucuuuaaauuugcaccuuugggagcgacacauggagcagcaagggaggaaggggacagcugccuaucgagcuagacuagcaaagucaguccuggagaccagugugaugacagaugucauauucugaucacccucaccuuuuuuuuuucuuuuaaaaauguuuuauuuaauuuuuuaaauuggauauuuucuuuauuuacauuucaaauguuucccccuuuccaggucuccccuccccacccuuacuucuugaggguacuauuuaggauugcugguugaggagguugcucauuaaggugaauauguaaggaguuccuagcuggaggucuucccuuggaggccuaguuggaggccuuugguaaaggucguugauaaaggucacuguugauauuuugacuggucuuuguugugugugaacuuuucccgguagacaugagcaauagauagggaaguaauggccaaccaagguaugauuucacucaaaucuagcuugggaaaccguacuuaccgacagcuaaagugaggcguuccguacugggguguggugaccccuaagcagucucccuaagcauggcuaccgaauuuccccuuagcugcacagauggagggcccacaguuagccuccacacucagcacucucaccuucccagagaccaggagaccacgugcauccugggcagauuacagauagcugggaggggcccagaagagaguggcuggcaucucagaugaggagcccaugccugccuccgaccucuuuccacaagggaauggcacaggcugggccuugagggucuuucauaccuacaguugccuuugauggcaacacuguccccugacaugacucaugacagccuguaauuccaauuagaaggaaucugacgcccucccugcucaggggaccugcacucacgugucgcaugugugagugugugcacgugcacacauacauacacauuuuuaaaaaaucaaaaagcgaaacaacaaaaaccccuguccugaucaaaagcaacuuagaggagagagggguuauuucggcuuacauuccagguuacagucccuugucugggggaacucaggcagcaacuuaaagcauugcauccacaauuacaagcagagagaggaaauccaugaguucccgccugcuugcucgaucucagccagcgcuggcuguucuuaagcuguucagaaccuccuguaggaggggccaacuacaguaggcuggaucuucaguuaacacucaagacaaccuuccagagacagcccccuggcccaccucgucuaaacacucacagacauccuucccgggugacucuaggcugugucaggaggccauuuagauaagccaaugcacuaguugaauguugaagguuaaggguuauuaauuagggagauugcuagaagacauaauggggucauuguuaguggaaugcuuaauugaggaucccagagaggguucauuauuuagggggucacuaaauagugauuuuuguuggaggauucuacuacuuggggucauacuugagucccuggaugaaaggcuuucucuucagagccgucgacgggaaucauaaaggcaggcagggcucacucagcuuggaauaauuuggguuaauuguguagguuauugacugguaaauuacugggcagggguccuaagucaucgguugggucauugcuugaaguccuugguuggaggggucacggguuguaauuagauaucaguucuggaucuuucugucccacaguaugacuaccaaguucucugccuugacccaguucuucugcagcuguccagguuggaugaguugcagccuggcuggcugauggcugaguugucaggggagaagacauguggggcugggcuuccgggagucuggccccgagugcuggcuuuugacuuuagccacugggcccuggagccaaucuaguucugcucccaggccugggagauuuggcccugcuuugcuccucuuguauccaaggagguuuccccucuggccaccuugggcagguuguacggggcaccugucuuuucccccaccagccucuaaauuugccgagaagcuaccucugucuacucaccccugaacuggggauuccccuaagggagagcccuggcuccuccuuuguuuccuuugucuugauuggccucaccccagaucugacacuccuuccaugucugcugcagaccucccuccacaucccugagacagagaagacaguuccccaccugccucugacucccacaccucuggccaucaccaccacugucacgauuggacaaaaugccacagucucgcagguuggugggaaguggauggcacugggccagggggugagguggugaaggggauggccaagagcaaaccuugacguucccaguguccuccacagggguuggacuccgguacugaaaccgagcagacgacuccagagguggacucuacugaggagggugaaggagguggccccaccaugggccccaaguuccgggcagcagagcaguccuuacagacugaguuccagaucuuuccugugagucuacagacgcugggccaggagaggggcuguagauacauucuuguucuugacuguguuuguuuugggucaacuaccuuugugugacccuggcacaguuacagcugcaaaauguuuaccaagcacuugcagugugacagggcuggugaugcaaguggccuuuagucuaagcaggggagauuuggacuucgagcucucugcgugcccugccugcugaguggacaguagggggagccagagagucaguggggaagcuuguagaguuagcaagcaaugggagagagaauacuccaguuggaggacaugguuccuucucuugucgcuggagauggaugguugucaucuccugguggugucuugaacuuguaacaucuguuugacauuuaagugagacuucagaccagggauggcuagaagauucuagaguccaggggagcccauccaggcugaggagaaagacuuggggcugacuuagucauaaagccuuggguggacaaggcuagaggggcaggcagcccuguuccuccuugguguuggcagaggcggagucagacuugagacugcacugacuuccugcucuguuacuuucuugugcuaggagaaaauaccugauagagucaacuagaggaggggucgcuuugcucccacugcaaaggguuccuacaguugccaguugagcaucaucauggggacagaaacauguggugggaggcuuccguucuuggagaaggggaagcaaugaguagggaaagcuguucucgcuggccuggcgcucuccuccccuuuaacucuaucuggggaagcaccacaguuccucuggaugccucccucaguaaauucucucuggaagcauccagacacaccauaguuucaucucaccaaucuccugggucauuccauuuuuguugcugucggauucauucauucauucauucauucauucauucauccacucacugagacagacucuuacuguguaacucugguugguuauccuggaauuugcuauguagauccaucuggccuugaacucccagagaugugccugccacugccuccgagugcugggacuaaagcaugagaccacaccuggccccuccuaggcaauuucaaauccagucagguuaacaaagaggcuaagucaucacgugugucaggcuugaaccucauuuguuguaugugugucacacauuaaaugacuucaugaguuaucugcagauggccacagguuugaauaaggucccagcaucacugggagagagacagagccaugauaaguucuuuggaguucacgcccuucaccuuggacgacuuucaggagucaguucucuccguccacuguggaguccagagccugaguucaggcuuggauggccuguguguuuacaaagagcaaccucucugccgccaugucucugucugucucugcccuuauguccuguuuccucucuccucacugucccuagggugcuggagaaaagggagcgaaaggagagccugcgacaguagagcaggugaggggggggggcugugaggagguuaaggggcuccgugagaacaggggucacacuuguuuccaccccagggacagcaguuugaggggccugcaggagcuccaggaccccgggugaguacugguucuagucccguauuccaaccucuuccccaugcccugccuccuagggcccaugcacaaaccagcuauggcacuaguugcucacauagcugcucucuuccuuuccuuuucuuuuacauagcccaggcugucuucaucucacuauguagccuaggcuggacucugucucuugauccuucugccucagccuccugaucauugggauuacaggugugcaccaugguuccugacucucuucuagauggggagaagauuuggguuauaguguugccugaaggucauuggauagucaauacccaaaagauaugucaaaaaagauuuaggguacaaaguugagagggcaauagaucacggugggagcagagcuggcuaagugguagucaggagguaugcuugaagacaagaucaucggugggucagaagccagcuaggcucauguucuacaucuccugugaccucugauuucugucuccacagggaauaucugguccuucaggcccuccugggccuccgggcuucccuggggaccguggucuaccgguaagagacuccccacuggaguguaugccuguguuggggugggauuucaggauggggguguguagauuugaaugggggugugcggggcugggauuaggaacaccaucccagaagugauguugccuccaucugugaacuccguaaacccugacuucucuucuguuuuggugcaucuuuaaauuuuucaugucauuuucauuuaucuacuuuaugcaugugcacacacauggccgguaguggcauguacccuggcaccugaucagaggucaaaggacaccuugccagacucaguucucuccuucuaccauguggaucucgggcagccaaacucagaucaucaggcuccuucucagucucugcucccccucuguccccucucaucuuccaucugcuguccuuaccucauccauccaccccucugucuugcuccuucucucaggguccugccggccucccaggaaucccaggcaucgauggagcccggggccugccgggcacagugauuaugaugccggugaggagggagagucccaucccugggcaguggaguccugaccccaggggaugccuuccugugcaucucuacucauccauaguuguuccuuaguuccauuuugcaagcagcucgaugaagggacccccaguguccuuccagcaggcccaggcccaggcaguauugcaacaggcucaggugagugggguaagggccauguguuaagugagggacagcauaaauaaaggcucgugcaggacugguuggagaccgaggauaucucucuccugaagaugcuugcugugaguuucuguuguuauuguaaaguccugagccugggugguuaauggagaacagaggauccaggcuaaugauucuggaggcugggaagucccagagcaccaugcugccgccuagcugggugcauuguaacugguggggggcagugcaaggcaagauggugcauacaugaggauaagccuuacucuccuaaagguacugauugucaggaugggguaccccacccuucugauuucaccuaaucccaaucaucuuccaaaaggcuccccucaaaguguuaucaacacaugaaucggggaagagauuuacaaccuguggaggaggcacacuccuaccucuaguagugauucuguggucuuaugggggaacucuugcucugucugucuuuccagcuguccaugaaagggcccccugguccaguagggcucacugggcgcccaggcccuguggugaguaaggggucugcucuggggagagagugcauccgugccagauagccacauugcucaaacugugcuccucccccaucucuccucccccaagggccucccuggauauccaggucugaaaggugaacugggagaaguggggccacaggugaguuuggagggauauggggggagaacggauuagaugggaaacgcuuucuccaaagguuacaggauaaaaggccagcuggggaacauaacaaauggaauagaaauauaccuuugaaacuucugccccuccuggggagugauuuaaaauaggcucuaagggaguuggaaagauggucuagugguuagaaacacuggcuguucuuccagagaaccuggguuuaauucccaguacucauauagugguccaugauugucugcaauuccauuuccauaggcacccucacauagacauacaugcagguaaaaaacaccaaugcacaugaaauaaagauaaauaaaauagguucugggcuaggggcuggguucagcugguaaagcauuugccaagcaugaaugaaacccugagucccagcccccagcucugcauaaaccagguguggggugcacaccugucaucccagcacuuggugggguagaggcuggaggaccaggagggcaaggccuagccuaaaacacaaagaucccccugccuccgcuucccgagcccugugaucaaaggugugcguaucuacugaggcgguggugcacaucuuuaaucucaggaggcugaggcaggggggucucuguaaauucaaggccagcuuggucuauauagugaguucuaggccagccagaguugcaugguagaccuugucaaaacgaaacaaaaaacaaacaaaagaagcauacgccuuuucuuuuaauucuuccuucuuguuccccaccacagggcccccgaggauuacagggcccuccugggccuccuggacgggaaggcaagacagugaguaaugucuagguucuuaaguuauucuuugcuuaccgucagcaccaaacaaaaaaaccugccuucguccucucuggucuuccuguguuaucagagggaccugagcucggaagacugcagcagaugcucagcugggugcacagugaagggauggggcagguggcagcuucaggaggacuugagaacagggacaacgcuuggcaggggcccaaguaugguuaggagcaagugaagaacaaccuaagcagcacacauacaaaaaggucauuugggagaugaggcaggaggauuagaaacccaaggucauccuuuaacuuugcauaggggaaaguacuugcugccuaucuggaguucaguccugagagucaccucacgggagaagagaacugacuuccacaagucgucuucugaccuccacaucuccacacgugugccauggcacguacaugcacauguacacgcacacacacacacacacacacacacugaauacacuagccaggcuuggugacuuuaaccccggcacucaggagucagaggcagguagaucucugggcaggccugugauccuagcauaaauagugaguaccaggccaaccagggcugcacagugagaccuuggcucaaccaccaccaccaccaccaccaccaaaaauuuaagaaagcaguccucgggagacaguaaaagguagugcacaguagccacacuggauggcaggacauuuagaggggagagcucugggagguucauccauccuugguucauuuucuucauagggccgagcuggagcagauggggcucgggggcucccgggagacacaggaccuaagguggguacuggggccaggacggguugaggggggcauugcaggguggggagaugucaaggucaaggauuuaaggcagcugcugucucuuccaaaagggugacaggggcuuugauggccugcccgggcugccuggugagaagggccaaagggugagugccccuacuauacccacacccuguuuccgugugcaaugcuuccuugacuucagagcuucauacacugucugagccuucagggcccacacugaacuucuauucugaagugaguggcuccugcauaugcuaauuuauucaaaugaaccccuccuucucugcacuagggugacuuuggacgaguagggcaaccuggucccccaggagaggaugguguaaagguaagcuggaggggggcauaggaaagaggcuggggguggggaucaguggugcagcacuugccuaccauauaugaagcccuggcuucauucccuggcauugaaacaaacaaacaaaaaacaaacaagcaagcaaacaaaacccagaaauaagcugaguggugucuggggauuggggucuacaccacaggagcaggaagcccaggauccucuaaaaggcagcauuggagcugauagcuagcuuuuggguuaggaugugggaggguaagucaaggccuggagacugagcuccgucauaagagugggaagacaccaagcugacucuuaaaggggcuucuagaugaggggagguuguaccucgggucuguacuugcccagugcaaauaaugaugacacuuuccucagggccugcagggaccuccagggcccacuggccaggcuggagagccgguaaguauugggagaccccagacucccuguucaggggagagaagaauccccuuggggcaugaaacuugcaggaauauauaccucugaugcugguauuauguggcuccuuccuugcaggguccccgaggucugauuggccccagaggucucccagguccccuaggacgcccggugagaaucuuguugacucccugucuauguuuuauucuuaccugucuuccccuguaagccaccccuuuaguguguguguguguguguguguguguguguguguguguguguuggcacggcccacauguggagaucagaucuuuucuuucacaauguggaucccuggaauuaaacucaggacaucagucuuagcagcaagugucauuauccacugaguaacccccacccccuuucugccucgcucccucuuguccuugcucugugugacugugauugccugcacaagagggcaagugugcaagugugaaagucugaugacaauugugagaguuggucuuuucccaccuuguuugagguuuuuuuuuuuuuuuuuuaaagacaggguuucucuguauagcccuggcuguccuggagcucacuuuguagaccaggcuggccucuaauuuagagauccuccugccucugcugccuccugagugaacauucgccugggcuugucugaggguuuucucuggauuuuccacuuugcuggccuccacgcuuuccagggaaaucagucuuuagccucuccucucccugcaggggauuacaaaugccagugcuacuaguuagacuuuugcauggguuccggggacuugaacucagggcuucauugcuagugcaacaagugccuuuacccucugagcaucucccgagccggaagaagcuuucuguugcugcugucuccuuuauacauguuucucagcagcucacacccggguucugaucuguucuggucucacauccucuguccucgcagggugugacagggagugauggcgcaccaggggccaaaggcaacgugguaagcguccuaccaucuguuuuugcccuucugacucuccaaacccaugaucuuuauagccuugucuacuuggaacuucccuuacccuccaccuucugucgccuuccugcuucacugaacccacccuucccccacaggguccuccuggagaaccaggacccccaggacagcaaggaaaccacggcucccagguucaagccucugucuugacaaugggguguggggggcugagccacaguccucccuuguccaguuuuauuguccaucucucuuuuugugacucuuucaccuucuuuuuaugucccagggaauuccaggcccccaggggcccauuggcacucccggggaaaagguaagugacuugcuucugucaccaggagaagcuccacucuagggcuccuuugagggacuuccugugaugaauagucacauucuggaagccaguccagagugacagaggcacuguugggggaggguuuccaggagaaucccacugaggcuggcagacagaggaggcguuguuaguaccucugucccucacagaugcccucacaaaagggacucccaagaagcuaaugaaggacagaccucagcuuuggcucucugcaugugugugugcucacauguggugugugcauaccuguguauauguguacagcuaugugugucuccuaguuugcuuuucugcugucacgauaaaacacugaccaaagccagcuugaggaggaaagggcucauggaccuaugcuuccauguuauuguggaaaugcaggacccuagaggcaggaacugaagcagaggcuauggagaaaugcuucuaacuggcuuugcucagccugguuucuuaugacccucccauaucaaucaucaaucaaaaaaaugucugauugguccaaacaucugauagguccaaagguagauaagaggcugggaaaccagaacuggagagccagguaugguaccacaccccugcagucccagcaauugucgcaaccuggaccuuacugcagaacuuugucuaaauaaaugaaaugaaaugaaauggagcaaagaaacaagacaagggggugugggugagaagucuggacucgagcauauuucauacugguuuuguucuuucugugguacugggcaucgaaccuggggccuugugcaucauagugcuugccuauacagcucgucacuaguggauucuaggaaggagaucuaccacugagccacaccaugccccuucucauaugguuuuuuguuuguuuuguuucauuuguauuucaaggcaggguuucucuguguagcccuggcuggccucgaacucagagauccaccugccucugcaucccgagugcuaggauuaaaggcgugcgccacaaccaccaccaccacccagacucucauuuugcuuuugcaucucucccagauaaggaggaucuccgaagcucagagagggcaagcugggucaccagcgucacacagcaaacaugggcagagcuuguguucuaggcucacuuugagcugccuggguaggcacugagacucucaggcuacucuuauuuuuccccuuuuuuuucagggucccccuggaaaccccggaauuccaggugucccaggaucugagggccccccggugagaacuacgagcugggacaaggggaaggggaaguuuuggguuucugcaugacacauuuuggccuuugaugaguugauguguuucucuggcagggccacccaggccacgagggucccacaggagaaaaaggggcucaggugagugaccaggagaguggcuggguugggaaagaggaguagcaagugaggagacaggauacugggaacaagauagcgcugaccuuguuuuccuaucagggcccaccaggaucagcaggcccucggggcuauccuggacuucguggugugaagguagggaaccccugagggcuugaaggugggacuguugauuaguguuggugucagaagaccaacuuagugccagguaucaugugaugucuguggccccaguauuugggaggcagaggugagaagauuccuccaaguuggaggcuagccugggcuauauaaugaauucugccagccagagguguauugcacuauuauauuuugagacccuguuucacaaacuaaucacuaacaaaauacacacacacacacacacacacacaaacacacacaaacacacccuguaaucacaguacuugagggaagaagaucaggaauuuaagaucagccugagcuauacaaauuugaagccagccuguuucaaacuaagaauuaaaaaggcuggggcagaagcucagaccacagaaugcuugccuagcauguauggagugucccagguuccaaucccagcacccuauaaacucagcauggugguacaugcugugguccuaguguggaggugguagaggcagaggcauuggaaguccagagucaucuuuagccauggggugaauuuuaaaucagccagggcuacaugagacagugucucaaaacaaaauaaagcaaaauaaagaaauaacaauagcaaaacccacuccaguaccugggaggcagaggcaggaggaucucugugcuuuccaggacauucugguauucauagugaauuccaggcuagguaggcgggacuacugucucaaaaacaaaacaagagucccuugucucaaaaaccaaaacaaaacagaaaguaaacaaaugaaaaaacaguauauuaauggcucuauuuuauuguuaguuucuuuucucgucuuuuucuuugcuuaauuuauaaauugucuuuuaucauaguuugauguaugcauagaacaggcaacauagauaagggcuggcucuaaucccuucuggcaacuccugggggguggggggugaggggugggggugucccaucuuauuuugcagauaaguggagggcuguggcugccgccuguguuguaucugaaucgaguuacuuuguagccaagggagaggauggcugcagccaaagcuuucuuuacugagguccagugaauuacugcggggcugcagaaggcccugcuguuuccaagugcauaguugcaucagcuccaacugcuuguucauucuucaguugagcucaguucccgucugagccaagugcaguuuuucagugugguacaggcaggaagucagcccaggguaugcgcucugcacgggaugggcaugcugucaccaggcacagagucuccuuguggccagcacaauggggaaacucuccccugccuuuggaauaaaacuggccucuggaauguucuuucuucugccagaaggaacuguagacacuguguccucaggaaguagagaugaauggcguagagauuuggcucuccugcuucuccccacucaucugaacauggugggggugggggaugggguggcuaccaggcauggaggagccacugaggggcucagaggagacagggcugcucccucuggggcuccccaccacacuauccccgucuugcaacuguucucacaauuuuaggucaagggaggaagucuaaaaccuuccuuuagcagggaaggagacugagagcucucuaaauuuuuucuuaggguaccucugguaaccggggucuccaaggcgagaaaggagaaagggugaggaggaagggguucacuggaagggagggagagggagcccccauaaagagccccugcccguguuccuucccuaagacccugacuucuacucuucgccugccucugucccuuucucugucccuccccuccuuucucccugcucuugccugcucugucuccauuucuguaucuccccccagggagaggauggcuuuccuggcuucaagggugaugagggaccaaaaggcgaccggguaagaccagcuccagaugaggacugugugguguaaacaugggaugggcugugauuaaacaguuuauuuauugacuuauauuuucuaccucagggaaaccccggacccccaggucccagaggagaggaugguccagaaggacaaaaggggccugggggacugccuggugaugaggguccuccaggagcagcaggggagaaggugauuugcaugguccacuugcgucguuuacugcccaucuccgugccuggcugcugccucacuguccaaucuggauauggaaccaggacgucucacuuguuagaaaacaguuguacuguggagccacuccccagccccacacuggggacucugggcaggggcccuaacacugagucccaccccagccgcucacugggggauucuggacagggaugucgggcugagcuaacccggcauacuucauuuauuugcugagcauugcagagcaauuacuugcuugcaccuucguuuuaauccccacagcgacucugugugauagacuuuuaaaaagaauuauuuuaugucauaguggugcauuccuuuaauuccagagaugguggggugggguggaacaaagguacuuggaucucuaggacagccagagcuacacaaugcgacccugucuuuaaaagggguggggugggggauuuauuuuuauuuuuaauucugugucucucugugugaguacagaugccuccagaggucaaucccuggagccaaagucacaggugguugugagcugccugauacggugcugggaaucaaacuacugagccaucucucaaguuccugugguaaacagcucacccuccccuuacagaggaggacacuggcuuauacuggugaaugagccccucgcaggcaggcacaucccucguaggaccucaguuuccuagguucucacucgguugcacagguugcacaccguuucuccccuggucuccagccugcagugugugaccuuuguucuacaaucuuuuuucuccugcagggcaagcuuggggugccaggucucccagguuauccaggacgcccaggaccuaagguaagaggccauggaacuggaggugggcaggggaaaggcagagagacggaugccuguggguccaggcugugacccagggcacucgggggggggggaggggggaggaggugggaggaggcagggauggggguaugcucggcuguacagcucauggcauugagagaguauuaaggaaaacaugagcaucauggucucauucucagaagugcuuaugaccuccauguccuugagugagguucuugaaaccauuuucccagcugcuaaguggagguaccugugauaucugucuauauucacuugaugacuuguggucugguuguuugguccaucaaccagagggauguguuagacugcuucuauugcuauaacaaaaacaucugaagcuggauauuuuaugaagaaaagagguuuuguuagcauaauauugaaggcuaauaacuuaaaaucagaggacuucauugauuuagccggaguuaaguccccucccugacugaguuacuuuaguaggaaauggugucauauaaaagcagguaugaguuagagugaccccacaggagcacaggaagccagagaugggauggccacacuuccuaaugacaacccacgggccacuggccagauugcuguccguacagugcuugccaugcagccaugaaacccugaauuugaguuccagcacccaugugaaaaaccaugugugguacacauuugugaccucagcacuggggagguagaggcaggaggguuccuggggcucaauggacagaaagucuagcacuugaccaagcuccagguucagugagagacuuuaucucgaagaguuaaggaggaggggccaaggagauagaucaguggagagagaguuugcugaguuugagccuaaguucaaauuuccaucacccacuucccaugcuggggaaauggcucagcaguugagaacccuugcugccccucagagcuuagggcucuacauccacacugccagcuuacaacuggcuacaaccucggcuccaggggaucugauaaaguguguccuaugucaucagcacucacacacaacacacacacacacagacacacaccaacacacaacacacacacacagacacacaccaaaacaaaacuccuuuaaauaugaagggaaaaagucaggcaaggccuuguuuguguuccugucaccccaggacugugggggguugaaacagaaggaucccugggccuugcuggacagcaggcuaacuccaugcucagugagagacgcugucugaaaggaaugauggacagcgagugauggaggaggauguugggcaucgugcucuggccccugcuuggacacauguucauauaccacacacacccaugaacaugugugugcaacgcuaaagugaaguacaaagaagacaccuagcguuggcuucuggcuuccacaugcacaugcacacacuuacaccaaacaaaaauccucuuggcuguguaagauaaagguccuuuccuccaagccagaugacccgaguuagaucccugccacccaagugguagaaagagagaugaccccugcaagcugucuucugaccuccacaugcaugcuguggcacagaaaauaaguaaauauaaugaaggggucuugguuuuaccgagacagagucucacuguguaggacacagagaucuacgcaccaaaaucucccgagugcugcccaucaaaaugcuuaaaaaaaaaaaaccaaaaacucuucuaaauguuuuuugauauuuuauuucuuuuuauuuuaugugaauguguucacauauucugugccugcauacacaucugugcaucagaugcaugcaaugccugcagaggcuagaagagaacuucagauucuguggaacuggcguuauagacgguugugagccugccauccauguggguguugggagaagcaaacccaggccucugcaagaacagccagugugcucuuauccucugagccaucucucugagucccaugagaacuauguuaaucccuuccuguuaguccuaaugaccuaaagaccucccacuacacugugccccuuaaagguaccccauccauaaucgcacacaagaaucaagcucccagcacagaccaggggguggggcacacaaagauguuggaauccuaacagaggaaaugcacacaacugagaccuuuccaaucuugaauucauuauaacccagcacaguguacuuauacagaaauguggcucuguggaaacacaugugccaguguuaggaggcuaagagugcgugcaagauugugcucucugucugagccgcaccccggacggcaucauggguuagugagcaugucuguuuguguaaaggcccuugggaucuuaaagaugcaugggagcaaauuugagugcagaauucuuuuuuuuaaauuaaguuuauggguuggaaagauagucagaaguuaaaaccucuugcugcucuugcaaagaaccuggguucaguucccaacauccacaugaaggcuauaauuccagcuccaggggauccaguguccuucucucuuccccaugggcaccaggcacacacagacacacauaaaggacaacucgagggcgucaguucucuccguccaccacguggaugcugcagaccaaaccauuaggacuggcagcagcagcuuacccacugagccaucucaccagaagcagaguucuuccagaguucuguaucuuugcuguuuggaacugacaugguugucuugccuaauacucacuguagaucaagguuugcagucaaguuguaguuggcucauggucuugagcggaccuuugacuuucagcuucugguggcagauggugguaacaggucaaagguggcagagagcagucacucaaaucaugaagcaggagaggggggggggguguagaggagaggggcggggagagaagagacagccaagaaaggaagaggaagaggaagagaggggggagggggagggggagggggaggggagagaguaagacagagagagagaggaagggggaaagggaggagagagagagagagagagagagaagggagguacagagagagggcaaagaccuuggcacccaaucccauucaaggaccuuaauaacuuaacaaccugccaugaauucccaccccccuuuguggccuuugaguugcuuguugugugugugugcauugacguuuagaugugaguugccuccaugugugcaguauacuggagcauggaaacuggagguugauguccaguguccucuaucucuucuuccuuauauauggaggcaggaucuuucacuugaacccagagcucaccaauucuaguuguuuuauuagucaguuugcuccuuuggggacucccuggcucuacuuuccgagugcugggauuacaggugggcugccacauccaccugccagccagcuccucuaguucuuuuguuaagauaggguuuuauguagcccaggcuagccucauacuugguauguagaaaaggcugagcuugaacuccucacccuugcguuucaccuuggaagcugggaccacaggcagaugccaucacaccuguguuguguggugcucaggaauuccugcauccuaggcaagugcuuuaccaccugagauuggacaauaauagaacagggugucugacacucuccugugguuucuauauguguauaugggcacguguacacacauaucauacaugcacauaaggauggugaaugauggguggcugguggcuuuguguaaacuugagagaagagcauuuaaggugaagggagggacgugugcaaaggcucucgggcaggaacaugcaggcauaccuggggaauuuggagguggguaguauggcugcugugggaaccagaaugaggugaggaggagggugcggggccacucugaagaugcugcggcuggaggaggcaaaagaaagccaccggauucuguagccuaaggaagucucaaaggauggagccagggaccaauuccaccuaaugcucaccaucccugagucuccugucucauucucucugcucagggaucuauuggauuuccuggacccuugggaccacugggggagaaaggcaagcgggugaguugugugucaaaggguaugaggaaggugugcucaggcaugccggaggugggugcugggaugguuugacugagcuuauuagggcaaaucuugcucucucacuuaaggcaaucaagacaauccccacagacacgccuacaggguaaccugaucuauacagucccguauugagacuuucuuucuggaugcuucuagacugccucaagcuaacaacgaaaacuaaccaucccagagcuguagagcugacucaccagcuaagagcccugucugcucucccagagggcuggaguuugguucccaguacuccauuagguggcucacaaccgucuguagcucuggauccaggggauccagcgcccccuucuggcgucugggaacaccugcacuuuuguguaccaacccacacacagacgcagacacaaauagaaagaaaaccugucuggcacaguuccaccccuuguccacuggacacacaaauacauggauuuaaaaccguaacuuacuuccuagucccaacgucucaugcucaucucugaauguaaaacauaaucuaacuuuaaaaacccuguagucuuucaaaauuccaguguuuuaaaaggaaaaauuuuuaaaaauuacaaugccauaaacuauaauucccauuccucaagggaagaauaaaggcauggugaggaaauacuggaccaacgcaagacucaaccacagcaggacaaugcuaaauucuggagcuccaugucuggugucuggagcuucaaaugggcuagauggcucugccccucuguauugcugccugcaacacagaucucuccuuuggucuggauucacucucugcauucaccuuuguuuuuuguuuuuguuuuuuugcagacauucuuguaugcaaacauucccacuugugaaugcacacaugcaagugugucucaugaagcacgaggcaauucucaccuucucuguuuuugacuugcuuuccagggcaaagcaggacagccaggagaggaaggagaacgcggcacaccgguaaggagaggauggcugcuccacgcagccugcugggcugaggggaagugggauagugacgucaggagucggccgggaaggacaggucccgucccugccccugguggagucagagggcauuuuggaggagggagccugugugugaugcccucuuccaggcccacccacccacucaucucuguuuuuugcuuuuucauuuuucauuuuucuaugcagggcacccgaggagacaggggacagccgggggccacaggccagccuggccccaagguaugggagugaguagcgauugggggaugaccaaggguccuugucuaucucaggcuaacuuagcuaccugcuuaguucuuccaguugaguauguucugguauugaagcucauuucauauguucuagggugacgugggccagaaugggucuccugggcccccuggagaaaagguaagugugugugugguaugugugagugugugugugguguaugugugaguauauguguguguaugugugaggguguguauaugugucugugaaugugcauguaugaguaugagugcauguguaugugugugacacugucagggaaccagccaugagcugacagcacaucauauauaugcaauagaaagagcuuggucucuaagaccagagaacuaaguucaauacgcagcugugcuucuugccugcugugugaccuugagcaucuugcuuaacuucucuuugcuucaguucccucuuuuauaaaaucggguaaccauggccaugccucaaugggcugcaguggugaauaauaucauauacccugagugagcgcucagcaccugcuuguguggaguggguacuccauacauguuugcuucaaagaaaaacaaaacaaaaacucucuuugugcuugugugauuuuggaguucagagaacaacucaaaggaauugguuuaugucaccuaccuugcaggaucugggaaugaaacccagguuacagguuuuaucugaguaaauguaagcaggcaccuuuauccacugagccauccugccagcacuggacuggcuuuuaaggucgcucuugugggacagaggugcaagacacucaggagggauaagguaauaauuucugguuccauuucagggucuacccggucuucaaggcccaccaggauuccccggaccaaaaggccccccggugagugaugucacccugacucuggguuggugggggaaggguacggggugaggugguuccaguucuaaaucuucauuccuucuuacuuuguuucccaggguccucaggggaaagaugggauaucugggcacccuggacaaagaggagaauuggugagugacccuugaccucugaccccugacuauguugggcccuuguauauggggugggaugcacgugcauguacauguggaagccaggaaaggaugcugagggcucauccugaagcuuuccauuucugcuaggcuggcuggccagcaagucccacauccaccugcuuccacucugggguuacaggcauaagagcugugcauggcuuuuccgcgggugcuggggaugcaaacgcagguucuuuugcuugaauagcaaaugcucauacucacucagucaucucucuggcucccauccuauuuuuuugagacaaggucucucgcugugucaaaugggucucacagguuaggcuagacuggcuggccagugagccccagagagccauggcugccaugguuucugccuccccagcacuggauggggacugugccaccacacaccuggcuuucugcggggugcugggaagcugaacucaggucuucuugcuugcauggagcacagagaugccuccccagucccgugggcucuccuuuucuucuucucagguggugccucuuucuauuucucuccuuagggcuuccaaggucugacaggccccccuggaccagcuggcguccuugguccucaggucagaguggauccccaaggaauacauggagcuggaagucugacguacuccccaccuccaggcugcucaagaugucucuugcuuguuuccagggaaagguaggggacguggggccucuaggcgagagaggccccccagggccuccuggaccuccuggugaacaaggucugccaggcauagaaggcagagaaggggccaagguaagagcuuggauagauugccucaaagucaucauucgaccccuggucucacgccauguggggaacagcugggaguagucagagacugcaggagaccccacuccugaccuuaacuuccucuccuuggcucucugcagggugagcuaggaccccugggguccgucgggaaggaggggccaccugggcccaggggcuucccuggcccccaaggagcccccggagacccagugaguaucuugggagaguccacuggaguauggggcucugggguagagaagaggaggcuccuuaagaguggcugcaguggcagcaaacaggagaagggccuguguaaggaguuagugguggccggugagggagcucagagcgggagaaaaaggguugcugcugagccugaugaacugaguuugaucagccagacccacaugauaggagacaauaacucuggcuaguuguccgugugcuggggaagguaugagcgcgcgcgcacacacagacagaauugguaguggcagugaccuggaguggacagaucuacagaacucacggcccaucuucagauaaggcuagggaugaugaggguccccaaaaguaaaggcaaauccuuggggucccugggagauuuucugacugguaauuucuucccccagggacccauugguuugaagggugacaaaggucccccaggcccuguuggggcaaauguaaguaucaacacacuggcgggggggggggggggugagggcuggagagggcugugucuucaggguuugauauccccaggauggggcugugcguuuggggaaggaaggccuggagcacacucacuucugacugccaugaccugagucagccagaaagcuuccugcuguaggauaguugucauaggauugggcagggagcugacgcaggggacagagugcuggccgugcaagcacaucugaguucagauccccagagaauguccagugggcaugguggcccaccuuuaauuccagccugggaagccagagacaaggggucccagagaaagcugguuaguggaacagccaugucggccagcucuggguuugccugauagacucaaugacacagucuaagauuagggaugauuccagacaucagccucaggacuccaugugcacacaugugcacaugcauccauacauguguccacauacacccacacauguguccacauacauaaaacuacacaugcacacacaaaugcaaaaagaaaaaucuacacaggcugcaugugguggugcaugacugugcccuggcaugugggagacugaggagguaggauugugaauuugaggcuagccugaucuacuuacugaggcccugucaaagggaagggauggaaggaaaggaagaaggaagaaaggaaagggagaggaaaugaaaggggaagagagggaaagggaagggaagagagauggggaaggaaaacaacgaaaaggaagagagugcagaguguuggggagaguguuuuaaacaggcuggcuggggaaggcaacgacccugggggcaggaccaugcucugcagaggucuguguagcuggggcugagugaaugagaagaggauuccaaggaggugaugggggcaguucaugcagggcugcaugguccucaaauugaagagguugggacaacugaggauuguaaagaggaucauaccuuagugcuuaaggugcccucuggcuguguauaaauaugauacuggugccagaagcccuguauccuuuaucauuucuuguccuccaccccuuuuccagggcuccccgggagagcgugguccuguaggccccucugguggcauugggcuuccuggccagaguggagggcaaggcccuauugguccugcuggcgagaagggguccccgguaagugucuguugguugacuuuuucuggggagacaugaacaaauaucaacucauuccagauaaguaaucagccauuuaccaaagaacuucuauuucuguggacuggagaaacgaugacucaaguggguaagagcacauacugcuuuuguugaguaccugagaucaguucccagcauccacauggguagguucacaucugccuguaauuuccagcuccagguaaucugucauccucuucuggccuucaugggcaauugcacucaugugcacauauccacucauucacauacauauauauauaauuaaaauuuaaaaaaucaauucuuaaaauuaccuuucccaaguccagcuuaaucaagcugugaguuuauugggauuacuuacaggaguaugggugaggagugacuuauaaaacaaggcugacuccagacagcugcaucacugaauggccaucugagccuggcucauggcucagaagagcggcaucccuggagcucucuauacaacuugcagucagcuugaaaggccaaagacucucuuccucauaguugugaacuacuucuauagcuuuagaauggcuggugaauccuguaaguuucaggaacuuucuaagacuugugagcuguuuauauccugagccuuaaggagcuuucuucaggauggauagucucaauuuuaaagaaacugccacacaaauguccucucccauucccuagcuccuaacauccauccuuucucuuccuccaucagggagaacgggguacuccugguccuacuggcaaagaugguauuccaggacccccggggcuucagggccccucuggagcugcggggccuucuggggaagaaggagacaaggugagaggaccagggagagagacaguuuacagagagauugggcaugcugggaccugaacucuuccuaauauguuuguccugcagggggaaguagggaugccuggucacaaaggaagcaaaggggauaaaggagaugcaguaaguagggacccccagggagguugugaugcucaugggaggagauaugggguagccuauguuuugugguuaccucagcccaaucuugacaccaagcucacuggaacugaagggcuaaagauccuuaucugagcucuguuugagcccugagaucccaggagaauaagaaagagcccucuaggcugucaagagggcucaguuagugaagguacuugccacuaaacccaaugaccugaauuccaugcccaggaccuucgugaugaaagaaaacaauugccucucauaaguugcuacacacaugcacacacacacauacaaaauguauaaauguaauaaacauucagagaaaggccccucugggccucaaaaucccuccauggcaagaaucuaccuuggucugcggccagcaucaucggguuacacgccaucccaaaggagaccuuugcuuuuuuuuuuuuuuuuuuuuuuucagauaaaagaguuccucauguaaccuaggcucuucccaaacuugcuauguagcugagguugaccuuggcucccgauccuccugagugcuggggucauaggcauguaccacuauguucagcuccgauagaauuuucuauuuuguuuuccucuucagggcccaccuggaccaacaggaauaagagguccagcaggccauucaggccucccggugaguucucccaacuuggugacuauacccuggguccuugaagugaagacagugugccacucuucugaauaaaauccuagcauccuuguccagccuugguuucaccuuagugccaacacccaugaugaacccaaccccaucucagcucaaacucucugcuuacugcuuugaccuucguccaacucaaauaccuggauccuagcuuucuccuaccaucuacccaaccaggucugcccccuccacugccggccucaaaugggaacuugaacuuugaguuauacuccagccuugcccuaguuaauuuucuguuacuguuacaaaaucugaagcuaaaugauuuauuuggaugacucauggucuggaggaugggaagucccuaauaguguuguuggcaucugaccagggucuccuugcuuuaucacaacauaguguguuaauaacuguuaugugaacuuaggucuucaucuucuuaugaagccacuaauauaccaucgugggggccucacacucaugacugcauuugauccuaguacuuucauaaggccuuaccuccaaauucugguaacauacaaauucugaaggaggcuggcggugugauuugguuggcagagugcucgccugccaugcucaaaauccuggguuccaauccuagcacuccauagcuaaggcauaguaguccaugccuguaaucccagcacuggagaaauggaagcagaaagaucaugaguucaaggucauccucagcuacaaaguaaguuuuauguccaccugggcuccaccagagccuguuucaaaacaacauacgaauucugggcucacaguucuaccagaacguuugaguguuguuguguguuguugaguaagcuucuccaaggcuuucccugaggcccugauauguggaacauggggaguuguggcuucagacccugaccacccaacucuucccaucuuaagaagcugcugugugcuggucucugaugccccugagaaaccuugugcccccuugugcaacaccaacuuauuagcuucuucugacuucguuaugugguagcuugccugccugccugccugccugccugccugccugccugccugccugccugccugccuuccuuccuuccuuccuuccuuccuuccuuccuuccuuccuuccuuccuuccuuccuuucuuuucuuucuuuuuucuuuuuucgagacaggguuucucuguguagcccuggcuguccuggaacucacuuuguagaccaggcuggccucgaacucagaaauccuccugccucugccucccgagugcugggauuaaaggcgugcgccaccacaugugguagcuuucuauugaccuugucccauuuccccuuucagaaacaacuguauauacgaugcugcauuucuuaauaagcuuacucagcauaagacauggcuugugcgagacccccguccccagcucucugucuucuuugccuucccaucuccugggcauuuuucccuuaggacccugucacugaagaaugaccugcugguccaggucagagugucaccaaaacauuaggucauaacuuccaaccuagcccuaaaaccuaccccagccuccuacaaaccuuaccugcucauaaccuuaccugagccacaucccugauucacugugucaguaacucagaaacaucaccugcccuuuacaucaaacuaaaaccugauucucaccaaacuugaucccaaccccuagccucaguccugaccuuggacccugucugcagccuuugaucuggacaccaacuguguuguccccaacauuuucacagggugcugauggcgcucagggucgccggggacccccuggccucuucgggcagaagggggaugacggaguucgaggcuuuguagguguaauugguccuccaggucugcagguaggugugugaguuuggggguaccacacccccaacccccuaccuagggugcuaaucuuuguaugguguguguuuguuuguguguguugcuaucccugugucuuagugauuuauaaagaugaauagcucagagggcuggauguaauaguuggcgccuuuagucccagaacucaggagguagaggcagguggauccugugacuuugaggccacccuggucuuuguagagaguucuaggccagucagggcuacauagugagagucuaucucaaaaccaacaaacaaauuaaaagauggagguuggcauguaugcauguaugcaugcuuucaugcauuccuuguugcuucccaacuaauauuuuuuuaacauuuaaugagagagagagagaauacgugugugcgcacacgcacauguacaugugcauguguguauacucacauucucauuuaugccauggcacaugugucagaagacaacuugcaggaguuaguucucuacuucuaccaaguggguccagggcuugaacccaggccaucaggcuuggugacaaucaccuuuacccacuaagccauuuugauggcccuucucaacuuauuuuugaggcuaccuaucucacugaaucuggaguuccuugauuuggucacugacuuccagcaagcucuaggggaccucuugucccugccucccagugcugauguugcaggcaagcucugcugugucuggccuuuuggaaaugaguucuagagacccagacucaaguccuaaaacuugugcaagaggugcacggccaucucaccaguugucuguacuacaguuuacucuauuucacaggggcugccggguccuccgggggagaagggcgagguuggagacguaggauccaugguaugaacucccugggagauauggaagacagguggaaugggagugaccacugguuacggucaucuaaagggucacacacaccuuacagguuaucuguggcuacuguagccuuucugguggaauaauggggagucauugcacacuauuugguucuuugacaggguccacauggagcuccaggcccucggggucccccugggcccaguggaucagaggugagaauucugggguggacagaaugccucuaugggucugccacaccucuagggacucacaguuuccucauugucucuccagggccccccaggucugccuggaggaguaggacagccuggugcugugggcgagaagguaagaggagggcuugaacuugcccuggauggaggggauagauagugcccgucuccucggcuacaacuguauggggaugcuccucccugccgaucagugagaugaucucuuucuauguucacugccuuucacagggugagccaggggaugcuggagacgccggacccccaggaauucccggcaucccugugagucuguagagcauugcccuuguacuugccauagggaacugcugaccuagagcgugucaugcucucaugaccuccaggcaguccuuagagcauugcugaauccagaccaacagauaucccugucuguugugaaagauaugaaagaugcuccaccugagaagaucucaggggugcuuuguagagucccaaaaguugcccacaagcacacagggcugaggagacagcuagggguuuaaaucaaagcaacaaacauggaauuggggguaaagcugcccaaagggggaccauuuucuuauguacccaaaggcaggacauaggccaggacagacuaaucaugggugacagauccauuaucccuaacucagcuaguucuaguucucugugaccucuaacacuugcauuaccuaggcuaccugacucugugugcauguguguguguguguaaaugcacugcccaaagacuagaagaugacaucggauucccguggagcuggaauugcaggugguugugagauaccugaugcgagugcuuggagcuccguuuuuggucucugcaugaguaguauguggucugucuuaguuaggguuuccauugcugugaagaaaccccaugaccaaggcagcucuuauaaaggacaacauuuaauuggggcuggcuuacagguucugagguucaguccauuaucaucacagcagaaagcacggcaguguccaugcagggauggcucuggaggaucugagaauucuacaucuucacccaaaggaagccaggaacagacuaacucuucuguacuggguggagcuucaaagcccacccccacagcgacacacuuccuccaaccaggccacaccuccuaacaguaauagucccuaugggccaagcauauucaaaccaccacaugcucuuaaccacugaggcacuuucuagcccugauacauauacauauacauauacauauacauauacauauacauauacauauacauauacauauacauauacauauacauauacacauacacauacacauacacauacacauacacauacacauacacauacacauacacauacacauacacauacacauacacauacacauacacauacacauacacauauacauauacacacacauacacacacacacacacacacacacacacacacacacauauauauauauauucauuauugugugugugagaguguggcacauguguggaggucagaggacagcuuuuggaggucaguucucuucuaccauggggucuggggauggaacccagauugucagacuucccaggcaagguguguucaucuuugguccaugacacucugaccuuugacuccugaucucuguuucugcaaaggggcccaaaggugaaauuggugaaaagggggauucggguccaucaggggcugcuggucccccaggcaagaaaggacccccaggagaggacggcucuaaggggaacaugguaagucuuaggaggagacagagcagagaacuuggggcccuuauuacauuaaaaccuggucccuaagacagaccagacaucucuucuuguuuguuuuuaauuuuucuuuuuaaauuuuauguguauguguauuuugccuacacauauaucugugcaccacauguaugucugguaccugcagaggucggaagaggauguaagauucucuggaauuaccuuaucugcaguuacagaugggugugagccaacauggggguucugggaacagaacccuuuuccucuggaagagcagacaguguucucagccacugcaccaucucucuagccccuauuucuuccuguuuguuaacucucugagucacccaaacaaagacugaacgaauagaagaaacaaugaaugaaugaacuaugaaaacauaguggaagcugagcccucccacuggcccacacccagccucuuaugcaugcagugaacacuucacugccucaauauaaaaccccagccuuuccuuuuguauuucguuugugacauguccccugcaguuggucuggggacacuaucuggugugugaaggggcgacuccucacucagugagaugagaucagcaaccaguuuuuauucuagggucccacaggacucccuggagaucuagggcccccaggagacccuggaguuccggugaguguaaaugcucccuguagccuagcccuaaauauaucaauguaucugcauuuacccccaugccccuauccuugacccgcuuagaggaguguauggcccucacucuccuccagcuccaucucuaucccaacuaucccaagacucccacugucucuccucccuaggguauugauggcaucccaggggagaagggaaaugcuggugauauugggggaccggugaguggagagcaaagggcuguagaguguggauauggaguggaguuguugaugggagaguuggguacccagggcaucugcuggguuuccugcgguaucucugaccccaugaucuugaguggugagauggagagggggauggugcuggguggcaucuguggggcuguguuucagcugaugcugugacugcucuugacuaaacaggggccaccuggagcuuccggggaaccuggugcccguggccucccuggcaagagggugaguggucuuccacugccugagggucucauguccaccuugucuucagcaaugcaauagccccucuccacacauaccccacucuuaucauuuuaaaauuauauuuauuuacuauuuguguguguguguguguguaugauguaccacaaagagauuuauaguucagagaacaauugugggaauuuguucuccccuuccaccaugugggucucaggcaagguccuuuaucugcugagccaacuugccagcccacucuugacauaaaccuggaugcuucacacugaccccacaacacucacacuuucccuccucaggguuccccuggccgcauggguccagaaggaagagagggcgagaaaggcgccaaggugagcacccccuugggagcaccucccuguaccaccugaccaaaagaaggccugcacccccugagguucuagcugucagcaggcaggcucuugagacugcuuccccccacccuuguccauuucagggagaugcugguccugauggacccccaggcaggacaggccccauuggggcucgagggcccccuggacgaauugggccugauggucuuccagggaucccugguccugugguaaguggugugaaaaugggggggaggggcagcauggauagccuucuggcuuaggaccucaucauaguugagcaaucuugggggaugauggaauguucauacugagugcugguagaaaccagacaccccuguucugucucccccucagggugaaccaggucuccugggaccuccugggcuaaucggcccuccagggccccugguaagagacuuuucuaucacuguggucacagcucugaaagccacacuaggcauccagggacauugagugggccauagugcggaugguacaggcuagccccucugugccaucuucaugaccuguauuggcccuucacacagauggccuccaucuuggugguccacauuggcccuaucuugaugguuuaugcugacugccaccuugaugucuacacugaccacucccccugauccugucaccugguauccucagcuguccucucuuucacccccauuuuucuaagcacauuuccugucuccugacuguccagucaccccagaccuguuuccuugcauuugaaagcugggugggacucugguaaaucuucccaucccuggcuuucaaggaaucccaagcugcacuucaucuuuucccagggcccaccuggccucccuggccugaagggagaugcuggccccaagggggagaagguaagccuaccuccugauguucccuacauuucccucaaccuuuaccuccugcccuggccuaggagaacucauuccuuccaagccaucaugagaaaaaagaucccagcaugucuguccugugugucuuucucuuucagggccacauugggcuaauaggccucauuggucccccaggggaggccggugagaaaggcgaucagggguugccaggugugcagggccccccaggccuucagggagacccugugagugugugcacuguuggggcaggggaauaauguucaagggggacauuuugaagggugggguauuuggagugggggagggcuguguuaggggaaugggggccuguaacuggggaaugucauguaggaagguguguggguacuugggggucuucuagaagaguuaggaguuuguguauugcuucagaaagguguguguaaacagagcuggacccuauuaagggugacccccauguccccucuucuagggucucccugguccuguuggcucguuaggucacccugggcccccaggugugguggugaguguggggauauuggagggauggggaagucaucaugaugggugguauugagaccccaacauucccugucucuuuccacagggcccucugggacagaagggcuccaaaggguccccggugaguggcacuacccccuggaccuccaugucccagcuccccuccccggaccaacccccuuacuuuguugauucuucacucacccuguguucagcaccuacugcugcacucuugggaucuaagaugcugcguuuuauaggagggacuucucaacuacuguuaaaggaaauaggucugcugaauaaguuguagccuguggaagacuguguguugauuucagaggauaagggauggaaauacacagcuuagguuuagcaugggacacugggagccucuucugggacccugcauguguguacuuguauguaaauguaugggcacauguauacacgugugugcccugccuuggcagggagaauaauguucaaagggggcugguuuagaggaaggauaagggucaggaaugaguggggcuguccuggggaaagugaggggcuguaauggggauuuuagugugggggauuugucuggaggcuucggaggucuccagaggagugcauguacaugucuguauguauacauggguguauguaugcacagauguguauguaugcacauguauguuugugcauauguguggggguauguccacacacauaugugcaagugaaucuauauguuuagguauaugugugugcauguguuugugugugugugugcgugugaguguaugugcaugugcacaugcauguauuugcauugguagaaccaggucuccauagacaggauucauuucaaagugaccucucucauagggaucucuugguccucguggagacccuggaccagcggguccuccuggucccccggugaguucccagacucuggaggaaggcaggaaucagacuuggguguucuuaucaggucccucauaacccaguccaguguuucggucuguagcucagaaaugcaguuccuugaaagcuuugggaggaguggagugcagugggugguggcacacaccugucaguccagcacuggggaggcagagacaagagaccaggaguucaagguuauccacagcuacauagagaguucgagguuagccagggguacaugagacccugucucaaaacaaacaaauacccaaaagagacuuggaagacauucuggguucguggguuuuggcagucccagugggaccauuuguggagucugaucugagcuucucucccuggguucuguccugucucucccucccugcgucuccaucuauuacccauuacucucucaauaucucuuucucuucuuucauucucugcucccgccccccgccccucuucuugcuccucuccuuccucuucugaauuucucugccucccauugucuugucuucucugcccaucucugauucuuccucucuuccauucccauucccuugugaguccaggguucuccggcugaggugcauggccugcgcaggcgccgaucugugacggacacccuggaagguggccuggaggaggugauggccucacugaauucacugagcuuggagcugcagcaguugcagagaccucugggcacagccgagagcccaggccucaugugccgagagcuucaccgcgaccacccacaccugcccgauggugaggcccagguccuucugggaagggcaggugagcacugcagcauuccugugcacugauugccuggcucugcuuccgugauaggagaguacuggauugaccccaaucagggcugugcacgugacgccuucaagguuuucugcaacuucacggcaggaggugagaccugucucuauccagacaagaaguuugagacggugagugaaagaaaccaucuugucuuuuucccaccucugccaucuucugccaucuuugagcccuuauucucccuucacauaacaccugucccuccugucugucagguaaugucuuauaguacagaaccugaagccaagccuuaaggcaagggugcugcccaguauucacaaggcuaugggcuucacccgcagugcaugcacagggguaggggucaugugggguggcuagaucccagccucaagccccauucccuagcagcacuugagcgugggcagggcccuggguuucauccagucaccacagagaauucugggaguugcggccugugagggugagggagcuguggacccuugccaagggcacagccugugccauccaugacccacgauguccaguaggagaggcagagggaguuggguuggcgcucaaugaccuucccauccucccucaggugaaacuggccucguggucccgagagaagccuggaggcugguacagcaccuuccgccgagggaagaagguggguuccaaugcugacauggaggacggcaugcgugagaacuguugggaacuggcguggguaggcagagaaggacaaguacuucucuacaaaguccugggcuccguuccuaacacugaauaaauaggaacuucaaguguucaaggcaauccucagcuacaccaugaauccaagaccacuuugggcuacuugagacuuggcagaagugucaggccuguggguagacugcagguggacugggaggugucuuccucacccuaccuugccccacugcaguucuccuauguggaugcugauggcuccccggugaaugugguccaguugaccuuccugaaguuguugagugcugcagcccaucagagguucacuuacaucugccagaacucgguggcauggcuggaugaagcugcgggugaccacaggcacuccauccgcuuccaagggaccaacugggaagaguuguccuucaaccagacaacagcagcuaccaucaaggucucccaugauggcugucggguaagaccauggaaccagggacuggcggguguggaguggggaagccucucgucacccuccucugacuuacucuccuacccccucauggccagguccggaagggacaggcgaagacccucuuugaauucagcucuucuguggguuuccugccucugugggauguggcugccucugacuuuggucagacgaaccaaaaguuuggguuugaacucggcuccaucugcuuuagcagcugaaguugugaggugggaaggaagcugaagggagccccacaugggcuccuuggugcugaggcucugaggccauucuguuuauccccagggacuccagauccagggucacgugacucugacuauucuuucucccuuguagggggagaguguggagagcccagcucccucugucuguucaccccaggugguauacccaguugucugcuagcuccccccuccauccaacuguccauuguccaccucacccccagaccuccaugcaguagacuuuuaacucagagcuggugaagccccaccccugccucuccaccccuccaccaggccuuuuggugcuauuccuuuccauaguugagcacuggauaccuccugaucccugccugggacccuucccucgcauacuucuucuuucuuugaguaaaagaaguaaagcaagaucaaagggggcgcccucccugagcugcgccuuccuucugcuuccuugacccagugcugcacaaucuccucucccuacucugccccacuccugugcccccaagccuucaggggaccaagauguugggcauaaaucaggauccuacauggugcugcccugcucauaacugggaacuguaugaaagggggaaugaauggucuguggucuauuuaauuugcuuccuucugaaggaagucugggguacggugagagauuccagaaggaucuguacccucccuuaccuacgcggcucuccuccccaggacacagggcaaaaucgccaucucaagaauaaaccaaggaacugugcucuucuu

SEQ ID NO: 4939 - RNA, 5735 nt, Mus musculus
ugcagaaaauaugggaaaggcaugucucuuauuuuggcgaggagauagggaauuaaggcuauuacucugaagaagaaagugagaagccagagccuuuuauuucggugaagagauggaguagcagggcuucuauucaauaagauagggaagguugaggaaugcuugcaaaagcuuugcacaaagaagugcugguagagacuuuuauuuuggugaaaaaaaucgaacucucucucucucucucucucucucucucucucucucucucucucucucucucucucucccccucucccucucccucagguaacugugcccuguaccaucgugggggcuggugguaccaugccugugcccacucuaaccucaauggaguaugguaucauggaggucauuaccggagccgauaccaggacggggucuacugggccgaguuccgugguggggcguacucucugaagaaagcuguuauguugacccggcuugugcgcuugugacugucccaucaguacccccaaggguguuccuaucuccuucagcugguaucuuauagcaacacgagguggccacacacugugucugucuuccugugugcaccuagccagggucacucucggggcccaccguccuccucuuccuccuccuccuccuccuccuccucuuucagguccuccaggaugaggugguccaggucauccacgaggccuccuuggcucaggcacguggccaccguggagccgcugcugauguggggguugcucgggugcagcacuuuggggaggugguucugcuuacggcucuuggggugggcgcaggaggucccaggcacauggggcucuaggggaaggagaguugcugagguaagaggggaccggggcucugcagggagacccacuggaaccaaaggacagagagaucagaggucauaaaaucuacagguguugaaacuccugacggaggugggaacuuggccacaaaaacagacucacagguaguggggauauggaccuagccggguggacaccaccaagcugcuagaaauuccaugggaggagggagcagcccaggggaucugcaggggaugcagaaugcagggugcacaccagggccucaccucuccgauuguagcaaucugcagcugagcaggagugggugugugugcugcgacgguccaggucacggucccagcgugggggcaggauccgggugggguacacagggaagccgcacccguagcagggugauggggaccccaucugugcccagccccugggggccagcagggcugugaggggcugagaggguggccgggcacagggcacaggaggaggggacuagacuggggcugggcugagggugggcugggcugggacagggcugagggugggcugggguccgggcccucaccggaaguuguggcgacacuuugggcaguggaacucugccaggccccacaucuugucaaguggcacugguucguaacgcuuccuacacuugcgacaccgugacaccugagaaaguaagagcccagaguugucagggccaaccggcagggcucaggcagggcucacucgguccaggcuagcuuucaacuccuggucccccugccuccaucucucaagugcuaggacgacaggccugugccugauauguggugcuguguugcugagauggaaccgauggcuucaugaaugcuaggcugacuaauggaggugcagccucagcuuuuaucacaaguacacuaguaaucaagagguuaggaagccaagccaggcaugguaguacacaccuuuaauuccugagugcuggcagcacucaggcagaggcaggcagaccucugaguuccaggccagccaggucuacauagagacuccccaaaucaaaaaaauaagguuagaaagccagacugggguuugauaggugucaaagcugaaaguucaacuucuuaaguucaaggauauugaaguuggacuuuuguggcauucaugaagucccugguuccacaggaaucagguguggaggcaggaggaugagggguucaaggucacccucagcugcauauugagucugagaccagcuugggcuaugugaggcacucucaaaaaacaaagcaagggcuaggugguaguagaguaugccuuuaauaacacuucgggguuugggaagaggacagauaaaucucugaguaagaggcuagucuggucuacagagcaaguuucaggacagauaaggauacacagugaaacccugucuccaaaaaaacaggaaacaaacaaacaccaaaccaaggggcuggggagaugggccaguggcuaagagcacuugcuauucuugcagaagaucuggguucaguccccagcacccauguggcacugugguacacagacauacauaugagcaaaauacuaauaugcauaaaaacacugaaaaugaauaaaaaauaaacacaaaaggaaagggguggagagauggcucagugguaaaguggacugugcucauaggacugaguuaaaauccauagcacacauagaagggccaggccuggcuaaaggcacuuauaacccuagcucaggggaaauugagucaggaggcuuccugggccaugcuagucuacacauuaacugaugagcugcaggguucagugagaggcccugucucaaaaaauaaguuggagggcaacugaggaacacaccuaccaccgaacccuggccuccacuugcacauaacauacacauagauacacucauacacacacgugcauggaacaccuccccuugccccguugaugaccuucaguuagaaauaacuucuggacacgggggucaggaaugggguauaggaaggguuuaucaccucuuuccucugggguacacggcgccaccauacauggucacaggaggagcaggcaaacugucgguccacggcagggaugaggucaucuugggcucuuuggaacauucgaagauuggcuugcgucaggggcaacagagagguggcuacugccugcaacauggaugaacgcggacaaaaaggucaccucugccucuggagcccacagugaacacauggcuccugcccgggggacaguaucuucccugcaccuccuccauccauacccuugcccauuccagccaccaacgcaccuggauaucuuggucuugcuucauguccucugguggguccugaggggagacacggaaggggaaggcagaaccggaaauacucucagagugcuauacccauguugagaggggcagaagccauggagacaggacccuggcucuguguagcucuagcagagaugaaacauuauugccuguguugagagcuuuccaguuaguuacuggagcugggucuggugacacaggaggauugcauguaacuagagaaggcugggggcguggcuuagcauuagaacccuugucuacuauggagucccaaguucaauccccaguacuguaaaaacagacaaaagcacaauguccccaaaguccuugagaacuggauacauuugcuauuuucauuuccuagauggcccagaaucuggauucacucagugaucauagcccauggaacccagagcccugcaugaccucgcagaggccacacaugugacaacuggccucagaugccacaugguuuuaaacacuaaaacguuuaaaaaugucuaugugugucucuucccaugugcauguauacaugugcagugcccauggacgccagaagagggugucagaccccuuggaacuuggagugguugugagcggucccauuuuggagcugggauccuaugugagcagcaagugcucuuaacugcuaagccaucucucuguccccuggccacacuacaaagcucugggcuuuggggcuugcaagcagcuagcugcaagccuaauuggcugcucaguugcucccugaugagggauggcggucuucacagaggggccucucagagcccaggcuucguuccaaguggcuagagucugauucccugaagucaacugcuggucucuggaaccuggugagugucguguccccgggcuggguuccugugcaauuggauugccuccugggacccugaggagggguaggacaugaaccaaggccuggagaucugccucacucgugcucuccaugaaggcgacuuccugcuauuauuauuauuaucuuaucauauuguuuauagaccuaaagcaaaagaauaucauugguaggauucuuuuagaugcccagcaaggugguacacgccuugauccccugcucuugguaagcagaggcaaguggaucucugugaguucaaagccagccuggccuaucuagugaauuucagggaaguccagggcugagcuauguaaagacucugucuuacacaaaacaaaaacucugcuaugucuuucaagcaaacagaagccgaggagcaaaacaaccauauugccuugauuccuucaucccuccuguccaggcgucuuucuucccaggaucugcccagcucagacuuucuucuuaugcaagaaaggguugccuugaguuuucuucgacauucagucuccuuauccuacuguccugucucuuccauuugagguaaucagcauguaaugagcaccuacuguuugaaggcugcuugagaaaggaaaggacccuagaugguaaggggagcacucacugauuguuccuucugacaagagaaugggaaucccccuuccuuuggggacagggggagguuaccugagcguccaggucguugcucagcuccuguccgucuuucugcuugacaccuagugggagaacaugggaggggcucuugaaggguguaggaguuccaggcgguggagagccuccgguuaaacggagccagggucgcuaaagcgcuacagcaauucugaaaccacacccacucagugucccccccaccagggcugacucaccauacacgauagagcgcccaacuccgguguggucgcugccaaacuuccucauaagagccccugccuucuugggggacacuuucccaugaaacuucucccggaggcgccugacgcucuucuccaacuaggauagaggggggauaagcucugaugucgccggcgacggggagcagcccccgcaccuucauucuccugaacuugacccuggcuucuggccuccgcauccccaucccccccccccuuuaagccauuuccuggaaaaauccgaaguucuccaggcauugggggaugguggagacugcggcgcgucccagccuccccggugcgaauuuggggucuggcgguguguguguguguguguguguguguggcgggaugcaggccagguuacccccuuuccuucugaccucugacccuacagccccacugugcccagggauagaggagggaaacagcccagggggcagggguguucccgggagcccuuuccgcgccgccgguggcgcggcuguccuaccuccacgccauccugagccaugguggccggagcacaccuggcugcgccuggguccgggccucgcaagccuggguggcgucgccgcagcuccgccucccucgggccccucuuucaguuucguuucuacguaaagcuggggacccugaggagaccccgcgcaggccuugcggccacgcgucugcucacgcgcccuguagugcucccggguggugcucccgggccuccgagcgcgccucaccgcguccugcgcagcagcgcggccucugcagucggucacauguccccacgcugcgcgg

SEQ ID NO: 4940 - RNA, 5914 nt, Mus musculus
ccagauacucacccagaaggacucccgguccuucguccugguccuucaggccuuccucagauuuuguggaauugccgcaaaccucacuggagccagcgucugggcugugagaggugagaguggguaggaguggauguagguagaugcuguuuguagagugcaucuggucuugauuguguguguacggguguguauguauguugucuauguaugugcauguauauguaugugcguauguauguauguguauguguguguguguguguauacguugugugugggggggcacagggaggcucccaggucucucauuuacuccaagcuugccaacgaaggcggccacaugugcccaagacugcccagugcuugggagcugacgccugaugagcagccacuguaguugauguaccuugccucuagcucagaaguuuccacggcucucucacuucccuucuaugccaccccacaggccucuuugcuaugucuucuuuucagcacaucugaaaugagauccaauuccaggaccuuugcacuugugguuucuucugagcagguccaagugugugcccgagugccugggagugguggcauagggcccugggugugaauucugcagggcaggaguggggagucacgaauauuaaccugguaugguggcacacacaagccaucuagggaugaagaggcccaggcaguagcauccuaaccuaguucgguaacagacugggcuacuagugacaccaugucucaaauuagaaaagaggggcccagcaugagugauggauguuccauccccugcacgccccgccccccacgcaaaauggaaguuuucucuuuaagugggggccaccgaagguucugaggggagaggugaccagguccaaguguccggaaccgaggauggagagggauuugggguguaaaaugauucugguuguuguaugaacugugguaaacggacaaucugcgcugcgagcugcagcccagcucuguuguggaguacaaccguaggaagugacgcccagggaucaauacuuuagcucuccuuggcuaccuuggagcuuugggacccgucuaggcuaaaacaguagucucuuuccucuucacugcaggugacggccauggggaccgccaggcuacgcaagcugcaacugcugcuucugcugggcgcuuggagggcgcucggaggugccgcgcguugccgcgucacccuaguuuuguccccgcagaaggcaacuagcgccgucugcaggagcucagaagccacccaagacagcgaacuggccacgcugcgcaugcgccugggucgccacgaggagcugcugcgcgcgcugcaaaggcgugcggcggaggguggugcgcucgcggacgaggugcgcgcacugcgcgagcacagucucacccugaacacgcgccugggccagcugcgcgcgcaauugcagcaggaggcgagggcggagccugaccugggggcggagccugcugcugcacuugguuugcuagccgagcgcgcgcuggacgcugaggccgaagcgcgccggacgacggcacgccugcagcagcuggacgcacagcuccgugagcaugcgcagcucaugagccagcauagcagccuccucggccgccugcaacgcgcgugcgcgggcccggaacggggacagcagcagguagcugugccgcgcgcuccgugucaggggcaccacccacugcucaucugggugaaugauuggggagagcuucauuggcugcacgaaaauauucacagcuccuaggcuuacaagcacuuucaucauacacaaggacuuuuuuuuuucuuuuuuuuaguuuuacuagacaggguuucucuguguagucguugcuguccugggacucacucuuuacacuaggcugacuuugaacucagagauccaccugcuucugucgcccaagugcugagauuaaaggcgugcgccaccacaccaggcuugcauauccuuuuaaggaucuauuuucaucuuaauguguguggaccgaugcaugucugauauguguuugugcaccauguguguauagaguguguauacaggcuaaaaaugaucuggaacuggaguuacagaugacugugagccaccuugcugggaauugaaucuggguuuucuggaagaacaggcaaugcucuuaaccgcugagucagcucuccagucccuaagacaauauauucuuguaacuacaugggacuuaugaauuuugggcaauuucugucaccagccuuuuugguuuuguuugcuuguuuucuuuuuucuuuuauugagauagggucucauguagcccaggcuagguucuagcauguagcucaggcuagguucuagcuccuuguguaguugugaaugaccuugauucucauguucugccucagcgcaaaugacagacaugggacaacaaacagccagguuggcugguuuuacauuccuauugauuuuggggucccugggaccuccuauaugugagguggcuguucugcugcugagccacauccccagcauugggccugaauuuuggcuuagugaugguucuguggauuuuccuaacucgucuggggcccacgugcuccugcucagcagugaagcugugaucaacagcagacugggaaucagcuuggcuuucucugaguaaagcaagcauggggucacacaccugcaguccccggcacaaagaaggccgaggcaggagggugugacggguuccaggcuagccagcuugagugagacaagacacagcuuggcugggagauggcucagggcccaagucccauccccagccccauggaagccuggcccugccugcaugugcugugccugguccagugcugugcugggaagacagguuaacugcgcuugcuggccuccaggccaacuccagcacaguaagagacccugucucaaaggaacagggagcguggcagagcaggacacccaacacccccuuuugcccucugugcuuuucuuaggaugggugauaaagcugagacauuacccugccugauuuucuguuuaucugguaggggauuugaucuauggaaccugccuaucucauucccuacgccaggggauaucuggccucuuuagcugagggaguuaauguaaucaugucugacuguguggccccagguccugccacugccccuggcgccucuggugccucugagccucgugggcagugccagcaacaccagcaggaggcuggaccaaacuccagagcaccagagagagcagagcuugagacagcaggggccuccaucuucucugcugcccacagggcaccuugcuguccccacaaggccaguggguaagucaaagcaagccugcugggauguacgagagagagagagagagagagagagagagagagagggagagggagagggagagggagagggagagggagagggagagagagggagagggaaggacucagggauuccagugccuuuuggauagaugaaaauacuaguuaggauuuggcugguagugugaggacuagaagaaaugacacucuuauucugaugaggggauaagaaaggacuauuagccugugagaagaccaggcuggagaugugcuucagugguagagcacccaggucuucaguugccuuccaacagcacagaagcaaacaagaucaauccucucacgcaccaggaagagaaaguaggcauguagguuuucuuuuugacaggguuucucuguguaguccuggcuguccuggaauucacucuguagaccaggcugggauuaaaggccugugccaccacagggguacucuuauuuugaugagggcaugagagauuaggacugcugcuuuggugaggaguugcuucguaggaucauguuuauugagaaaggagggauggguaaggaaguggcucuuccucaggugaagacagaaggugaugacuuuuauuuggguaaggggauggaugagaaccaagacucugauccaguaagggguugguuggcucagucugucccuugccacaggcccauggagggauugugcagaggcucacggggcaggucacuggcagaguggaguguaugaccugcggcugggccgucguguaguagccguguggugugaacagcagcaggaagguggaggcuggacugucauccagagacggcaggacggcucugucaacuucuucaccaacuggcagcacuacaaggugugugcuuguggugggggugucagagacugcugggcagagaggacgcccccacccucuuccuccuacccuuccaggcgggcuuugggcguccagaaggagaauacuggcugggccuggaaccugugcaucaggugacaagccguggggaccacgagcugcugauacuccuagaggacugggggggccgugcagcacgcgcccacuacgacagcuucuccuuggagccugagagugaccacuaccgucugcggcuuggccaguaccacggcgaugccggagacucccucucuuggcacaaugacaaaccuuucagcacuguggauagggacagagacucauauucugguaaggagagcuuuuauucuggugggaggauagggaggcgggacugcuauucugguuagagugaaaagcagugaagcuagguuuuucccucagggaggcuggagauggcucagcagguacguucauacccugccuccugggcucaguucucagcacccauacuaggcaguucucaacagcccgugacgugagugccaggggaucugacacuucuagccucugugggcaucuccuuuggaaauaaaugcaaagauucuuuccuggugaacugggugugguggugcagggcugcagucccagcuccaggaggaggucugaggggcaggaaucucggggcauccuugggaugcucaaggucagccugggcuacaugauacccugacucagaaagaaacuccccuaagcuuaaggaccucaaaguaugcuggcuucucugccagagaacaaggggcuuuuauucagauaggguagcagggagcccagaguucuuuucugcugacuaaauaaaagauguaggcacuguuuagaggaugggggugugugugagagcuugaccccccccccuugcaaucuaagcacacucuaccacugagcuauauccccagucuauguuuguuuauuuuugagaaaggaacucacuguggagcccaggcuggucugaaacuccaaacccuuuacucuugucucccauguacugagauuacagguguguaccaguacaccuggaauaaaccuagaaaggaagcagaagcccucccccucaaaaggaaugaauaacagaccacuacuuugcagaaaauaugggaaaggcaugucucuuauuuuggcgaggagauagggaauuaaggcuauuacucugaagaagaaagugagaagccagagccuuuuauuucggugaagagauggaguagcagggcuucuauucaauaagauagggaagguugaggaaugcuugcaaaagcuuugcacaaagaagugcugguagagacuuuuauuuuggugaaaaaaaucgaacucucucucucucucucucucucucucucucucucucucucucucucucucucucucucccccucucccucucccucagguaacugugcccuguaccaucgugggggcuggugguaccaugccugugcccacucuaaccucaauggaguaugguaucauggaggucauuaccggagccgauaccaggacggggucuacugggccgaguuccgugguggggcguacucucugaagaaagcuguuauguugacccggcuugugcgcuugugacugucccaucaguacccccaaggguguuccuaucuccuucagcugguaucuuauagcaacacgagguggccacacacugu

SEQ ID NO: 4941 - RNA, 4007 nt, Mus musculus
aguuacgagccgcguggcaccggaaguuggccacguaaaguccguccucuuugcgucuccugcacggaagugagcggugugcgccggaagcgaauacagaggcugccucguggggaagcaggcagcauggggcaguccgggcgggugaggcgcggcggccugggcgggcauggggcacugguggggucgcggccgaagcuugggcgcucaccgccugccugucguccccgcagucccgacaucagaagcgcaaucgcgcccaggcgcagcuccgcaaccucgaguccuacgcugcacagccgcacucguucguguucacgcgaggccgagcgggucgcaauguccggcagcucagccuggaugugcggcgggucauggaaccucucaccgcuacccgccugcaggucuguaucccucagcccuucagcuccagguucggggcucggcaucuuggcgaggacuuggggccagaagcugagcgccugccuuccaugugggagggcuuggcugaauccccagcaccucugacccaggcuuaauggugugcaggcgaaaucgggaauagaaucgagggggaagaucaccauagagaccaucugugguuacauagugaggucuuguguaaaaaacggaaagucauacuuugggggcaaucgcuaggugacucagugggaaagggggcuugcuguuaaacuguaguucaauuccugugccccacguaguggagggggugaaacagcuccugaaguccucugaccuccaucuuugcgucccucccaacaggcuuguaaaaaauacuuuuuaaagaguauuuuugagugcuggggcaauaguuuagggguacagguaaaaccccaauaccuccagaaaggaguguguggucagaaauaccaucucagaauaaucguuuaaacgucuucucucaauguuuguguccguuucuuuuuuuuuuuuuuaaagauuuauuuauuuauuauauguaaguacacuguagcugucuucagacacuccagaagagggucucaggucucauuacagaugguugugagccaccaugugguugcugggauuugaacucuggaccuucggaagaacagucgggugcucuuacccacugagccaucucaccagccccuuguguccguuucuuucuccauuuaucagguucgaaagaagaacucccugaaggacuguguggcaguggcuggcccccugggggucacacacuuccuuauuuugaccaaaacagauaacaguguauacuuggugagugcgcgccacaccgucccuuucccucccugagccccagcugcuccugucugaugaugagcccauugcccugagcucuugugaugcuggcuucaaaguaaacgcucugaagugaaggagcagggcuuucccuucucucgccccacccgccagccagaccccugcacccucacccacccuuucuuuggcagaagcugaugcggcucccaggaggccccacuuugacguuccagaucagcaaggugagaaggguagauaugagagcccggcuugccuggggagggcccuggucacacgggugcuuagccucucuucucccuccuuucaguauacacugauacgggacguggucucuucccugcgccgacaccggaugcacgagcagcaguuuaaccacccuccccuccuggugcucaacagcuucggcccccagggcaugcacaucaagcucauggccaccauguuccagaaccuguucccguccaucaacgugcacacggugggccagaucugugacagcugccggggccaggguuggacaguuggagggggagcagaccacauguuacgccuccauugaguggagagacucgcuuggcauaaagcaacugauuugauguuaaauucggaggcggggcuaggaguugauaggagggucucauauaucucaagcuggccuccaacuuugaggcugaugcuggacuugaacuucugaucuuccaucucuucugugcuuaguacaccuugaaagguguugggcuuugugcauuguaggccggcacucugccaacuaagccauuucucugccccuuauucuggauucaaggucguauguuagaccaggcuaggauuagacuuguggucuuuucuaauaagccaccuaggaagacuagagugucaaguacgcuccuggcuccagagcuucagaugcuaaacccuggcaucagugcuucucagauuagguuccuuacaaugucuuaagucuggugguuggcuuugguggccccuuuagccagugcuucagacagucugaggacucugguuguaguagccccuaacaccugcacuaggcauccuagugccuucugcagacacagacugcuggagaaagcuacacuccuucccagcuuggucccugguuucagcacauaguuccccaggcaggcggcucacgguccccuugccucuacucccaggugaaccugaacaccauuaagcgcugccuccucauuaacuacaacccugacucccaagagcuggacuuccgacacuagugaguguuggugagagggagggagggacucagugugggacacccgugcaccugaugagaauucugcugcugagguugugugauugcucagacucaaaguaaacgcccugaugcauguacaggagagggcagagagcugaccguggacuccaugaccauucaccucucccccuacucccgccauugcagcagcgucaaagugguucccgugggugcaagccgcggcaugaagaagcucuuacaggagaaguucccuaacaugagccgacugcaggacaucagugagcugcuggccacguaaguaagaaagcugguggguggcagcugcaccuguggagcgcccaagguaaccuguuguuuuacacagggguguggggcuaucagacagugagguggagccagauggagaacacaacaccacagaacugccccaggcuguggccggccguggcaacaugcaggcccaacagagcgccguccgacuuacugaggugaggguggcuaugguggcccucucagcucccagucacaaggcuagccugacucucuucccauuccccuguguuggcagauugggccccggaugacacugcagcucauuaagauccaggagggcgucgggaacggcaauguccucuuccacaguuuuggugaggggacagggugaggccagcccgugagagcagugucgagucccacugugacguugacagauugucugauccuuccucacaguacacaagacagaggaggagcugcaggccauccuggcagccaaggaggagaagcuccggcugaaggcacagcgucagaaccaacaggcagagaacuugcagcgcaagcaggagcugcgcgaggcccacaagaagaagagccuggcaggcauaaagcgagcccgugcaagggccgacggugacagugaugcugaggacccaggggcaccgccagaggcagugggggcaggucagccugaagaugaagaggaugacgcugaguauuuccgccaggcugugggggaggagccugacgaagguauguggcaggguccucuggugacaccuuggcccuuuucauuucuucuccauuaaucacauuuaaccacuucucucccugcagacuuguuccccacagcggccaagcggagacggcaggggggcccucugggcaagaagcagcgagggaaggagcagaggccugguaauaaaggccgaggucaggguggcaacuggcaggcucugaagcuacaagguagaucccagagaggcaaggccaagccgagacccagagccacacaccaggacucacgcccagcaucaaggagaagaaacugaaccugccggcaguggguggacuauggaugccccagauuggggcccggaagcugccugggauccagugcaguccgguuuccuuuuauaaaggaacugcccaguucuuaaccuccaauaaaccugaacauggugcu

SEQ ID NO: 4942 - RNA, 4007 nt, Mus musculus
agcaccauguucagguuuauuggagguuaagaacugggcaguuccuuuauaaaaggaaaccggacugcacuggaucccaggcagcuuccgggccccaaucuggggcauccauaguccacccacugccggcagguucaguuucuucuccuugaugcugggcgugaguccugguguguggcucugggucucggcuuggccuugccucucugggaucuaccuuguagcuucagagccugccaguugccacccugaccucggccuuuauuaccaggccucugcuccuucccucgcugcuucuugcccagagggccccccugccgucuccgcuuggccgcuguggggaacaagucugcagggagagaagugguuaaaugugauuaauggagaagaaaugaaaagggccaaggugucaccagaggacccugccacauaccuucgucaggcuccucccccacagccuggcggaaauacucagcgucauccucuucaucuucaggcugaccugcccccacugccucuggcggugccccuggguccucagcaucacugucaccgucggcccuugcacgggcucgcuuuaugccugccaggcucuucuucuugugggccucgcgcagcuccugcuugcgcugcaaguucucugccuguugguucugacgcugugccuucagccggagcuucuccuccuuggcugccaggauggccugcagcuccuccucugucuuguguacugugaggaaggaucagacaaucugucaacgucacagugggacucgacacugcucucacgggcuggccucacccuguccccucaccaaaacuguggaagaggacauugccguucccgacgcccuccuggaucuuaaugagcugcagugucauccggggcccaaucugccaacacaggggaaugggaagagagucaggcuagccuugugacugggagcugagagggccaccauagccacccucaccucaguaagucggacggcgcucuguugggccugcauguugccacggccggccacagccuggggcaguucugugguguuguguucuccaucuggcuccaccucacugucugauagccccacaccccuguguaaaacaacagguuaccuugggcgcuccacaggugcagcugccacccaccagcuuucuuacuuacguggccagcagcucacugauguccugcagucggcucauguuagggaacuucuccuguaagagcuucuucaugccgcggcuugcacccacgggaaccacuuugacgcugcugcaauggcgggaguagggggagaggugaauggucauggaguccacggucagcucucugcccucuccuguacaugcaucagggcguuuacuuugagucugagcaaucacacaaccucagcagcagaauucucaucaggugcacgggugucccacacugagucccucccucccucucaccaacacucacuagugucggaaguccagcucuugggagucaggguuguaguuaaugaggaggcagcgcuuaaugguguucagguucaccugggaguagaggcaaggggaccgugagccgccugccuggggaacuaugugcugaaaccagggaccaagcugggaaggaguguagcuuucuccagcagucugugucugcagaaggcacuaggaugccuagugcagguguuaggggcuacuacaaccagaguccucagacugucugaagcacuggcuaaaggggccaccaaagccaaccaccagacuuaagacauuguaaggaaccuaaucugagaagcacugaugccaggguuuagcaucugaagcucuggagccaggagcguacuugacacucuagucuuccuagguggcuuauuagaaaagaccacaagucuaauccuagccuggucuaacauacgaccuugaauccagaauaaggggcagagaaauggcuuaguuggcagagugccggccuacaaugcacaaagcccaacaccuuucaagguguacuaagcacagaagagauggaagaucagaaguucaaguccagcaucagccucaaaguuggaggccagcuugagauauaugagacccuccuaucaacuccuagccccgccuccgaauuuaacaucaaaucaguugcuuuaugccaagcgagucucuccacucaauggaggcguaacauguggucugcucccccuccaacuguccaacccuggccccggcagcugucacagaucuggcccaccgugugcacguugauggacgggaacagguucuggaacaugguggccaugagcuugaugugcaugcccugggggccgaagcuguugagcaccaggaggggagggugguuaaacugcugcucgugcauccggugucggcgcagggaagagaccacgucccguaucaguguauacugaaaggagggagaagagaggcuaagcacccgugugaccagggcccuccccaggcaagccgggcucucauaucuacccuucucaccuugcugaucuggaacgucaaaguggggccuccugggagccgcaucagcuucugccaaagaaagggugggugagggugcaggggucuggcuggcggguggggcgagagaagggaaagcccugcuccuucacuucagagcguuuacuuugaagccagcaucacaagagcucagggcaaugggcucaucaucagacaggagcagcuggggcucagggagggaaagggacgguguggcgcgcacucaccaaguauacacuguuaucuguuuuggucaaaauaaggaagugugugacccccagggggccagccacugccacacaguccuucagggaguucuucuuucgaaccugauaaauggagaaagaaacggacacaaggggcuggugagauggcucaguggguaagagcacccgacuguucuuccgaagguccagaguucaaaucccagcaaccacaugguggcucacaaccaucuguaaugagaccugagacccucuucuggagugucugaagacagcuacaguguacuuacauauaauaaauaaauaaaucuuuaaaaaaaaaaaaaagaaacggacacaaacauugagagaagacguuuaaacgauuauucugagaugguauuucugaccacacacuccuuucuggagguauugggguuuuaccuguaccccuaaacuauugccccagcacucaaaaauacucuuuaaaaaguauuuuuuacaagccuguugggagggacgcaaagauggaggucagaggacuucaggagcuguuucacccccuccacuacguggggcacaggaauugaacuacaguuuaacagcaagcccccuuucccacugagucaccuagcgauugcccccaaaguaugacuuuccguuuuuuacacaagaccucacuauguaaccacagauggucucuauggugaucuucccccucgauucuauucccgauuucgccugcacaccauuaagccugggucagaggugcuggggauucagccaagcccucccacauggaaggcaggcgcucagcuucuggccccaaguccucgccaagaugccgagccccgaaccuggagcugaagggcugagggauacagaccugcaggcggguagcggugagagguuccaugacccgccgcacauccaggcugagcugccggacauugcgacccgcucggccucgcgugaacacgaacgagugcggcugugcagcguaggacucgagguugcggagcugcgccugggcgcgauugcgcuucugaugucgggacugcggggacgacaggcaggcggugagcgcccaagcuucggccgcgaccccaccagugccccaugcccgcccaggccgccgcgccucacccgcccggacugccccaugcugccugcuuccccacgaggcagccucuguauucgcuuccggcgcacaccgcucacuuccgugcaggagacgcaaagaggacggacuuuacguggccaacuuccggugccacgcggcucguaacu

SEQ ID NO: 4943 - RNA, 53241 nt, Mus musculus
ugggguugauugagggucauuggaggaaggaaccaucagguggaagcccucuuguuugauggccagcccuuauaucuucuacucaccccuguucucagacuaagccacucuuugcugcuugagaccggacacugcuguggcuugugucuuccaaaaggugggccacuccccgagcacucauggcuguucuucuccagggcuagaagugggggaaggagcauggcuguggcucaggugaugggaggacagcccugugcaaguaggaaggagggucccacuugaagugagugaggaaagacuggggucagugcugaagacuuagaacaacacaguucuggggugugcccugugccccagcuucuccucuguguacuuugucuuuuuguaacuuugucuuucugauuucugcuauugggguuuccuaugugcuagguaagcacucugguacagagcuauguccccaguacugccuguacuucugacugaagcuguaacauaguccuucaaggggacugccaagcuaccauccaugguuugguuucguuguagcccaggcuggccuagaacucccaauauaaucaagaauaacuuucaccuccugguucuccuguuucccacagcccuucagugcugagauucugcacucguggcuuauguaguucuggguggaugcuggggcuuccugcaugcuaggcugacgcucuccucacugagccgcacccccaccccuuucagcuuaucgccauggggacaguaaauuaaacuacgaaugguuauuccauuuucucuuuucuuucuuuuuuucuuuuuuuucuuucucuuucuuucucucucucucucucucucucucuuuuuuuuuuuuuuuuuuuuuuuuuuuuuacgaguucuguguagcccuggcuguccuggaacucacuuuguagaccaggcuggccucgaacucagaaauccgccugccucugccucuggaucaaaggcgugcgccaccacgcccggcuuccauuuuuaaguugggagaacaaccagcaucugacagucgcucacgcuccugcgggcagcacaggaggcagguugugugcuuaugaaccuuauuagcacauagcgcuccccgguugucuggggcuucgggaccucacgggcagaguugguauuugaauuguaacaguaccugugggccccacacauuguaaaaggcuuacuguucagucacuuugugaaaaguuuuauggggcugguguucaguagguagggugcuugcccagcauguacaaaacucggggcuccaccccagaacaguacccaccaggcacggugcuguguguaaguccucaaugcaccggggugguggaggcaggaggcucgggagguuaagguccucuuuggcuguguagcguuuuacaucgugagcuccagguuuccccugugcugcugcaggagcgaucuccacccugagaucccacacuccauugagcgaaguaauuggcuuggguuugggguuguuggaaggaaacugcuucgaacauuuuugcauauuucauucaguuacuaugcaaggauucuaaguacuugccgaguccacaggugggaauauacugcaugucaguaaauguugccaaacaacuuccaaagcgguuuauuaaaauuuucaauuaagaaaaaaaaauugaucacacuuucuuuugugagugugcaugcauguguauggguaaguauaugucaugaugugugcgucuugguuacaggacacuagcaggaaggagucaggucucuucuuccacuuugugggacccagggauugaacugggaucuuugggcuuggcagcaagccccuuuaaccugcugaaccaucuacugguccucacuuuucaguuguagguguauguugugugaaccacggcaggcaccuguggaagucaggacaacuuucagaaguugauucucuucaaccuguaauuguguuccagaguucaaaugcaggcuuuugugacaagugcucuuacccacugggccagcuuacuacaccagcugcaccaguuuuuuacuucuuguagugcuuagaaaguauucugauguugcuaacauugaaaauuuucuuuuuaaaauuugacccauccugggguguguuacauguuaagagugugugagagagggacuggagagauggcuuagcgguuaagagcacugauuguacuuucagagguccugaguucaaaucccagcaaccacauggugucucacaaccaucccuaaugagaucugauccccucuucuggugugucugaagacagcuacaguguacugauauauagauagauagguagguagguagauaauagauaguguaugagagaaaugauauagagguuuuaauuugugucucugaugacugagcuuggccaacuucuuucaccaucuugugagugaaguucucucuaucccuuacuguccacacaggcccauccuugaauuuggaguucugacuguaaguuauagcuagcuuuuuaucaggccacuugguugcuguggaaguuugaggggaccaccaugagcucugagaagccacucagguguggugagggaaggccagguguucugacguguaaaccuucucacagcuuucucucuguaccuggggaugaggccaggcuggcaucagaggaggaagccaggagccuagggauagggagggcaccuggaggggcaguuugccagcugcccguaaaacaggcaggugcuggagccagucccugugaugccaggcagaguucugggcuuugcucggaugggggcucucaagaagguggcugucuagcauacuugacaauaucugcauuccugacuuggacaaguuauuugagccuggagaaagguuugguauguaugccaucauacccagcuugaaaguagcucuuaaaaauuacacuugguagccaagugguccuggcaaacaccuuuaaucccagcauucuggagauagaggcaggcaguucugaguucaaagcuagccugguuuacagaggggagguccaugauagccaaggcuacacagagaaaccuuauuuugaaaaaacaaaccaaaacaaaaaacaaaacaaaacaaaaaacaaaaaccaaccaaccaaaaaaaaaaaaaaaaccccaaaacaaacaaaacaaccaaccaaccaaaaccaaaacaacaacaacaaaagccauuuguuuggaaguuuaugcuguuguacuuguauuuuuuugguguugggcacagaauccagaauaggcucuuaucacugagccacauguagccuuuuguauauuucaaguaucccaucaauuugucaaguuggguagacuauggacuguagacuguaaacuacuuuugcaucuugaucuaguuugggccccaguuuuccuuuguaaaauguaaugacaggauugugaaacgaaaaauagcuuuguuuuagaaaaacacuuagcugggugugguggcgcacgccuuuaaucccagcacucgggaggcagaggcagguggaucucuugaguucgaggccagccuggucuacagagugaguuccaggacagccggggcuauacagagaaacccugucucgaaaaaccaaaaaaaaaaaaagaaaaacccuuuuauaacuagaguugugccuugucuguguaucaggcaaccccugagaucuauguggggauucagcagguagcuguacuuggcucaccaugguuuuguauuaauaaaguuuuauugggacacagucaggauaaugacuucucuauagcuauuugacuucagugggugcagcucugaguaugugguucacaaaaccuucaauaucccuuugucugugaaaguuugaccuccacuccagugaggcagaugguaaaagacucuggcccuggcuacuaagaauggugucugguaggaguaacagguggcuuccauguggucugagggaguuuugguggaaauauuuggggcuguacaaaucuuaccagagaauguucuggguagaaacgauggaagcccuggggcacuugaaaugguaaguggucaauggagccaugcccaguggagggcgugugugcccagcuagcguucugcagaugggacaaaugcuugcuugauucuuuuuauuauauauauauauauauauauauauauauauauauauauauauauauauuuaaaucugguguaggaagguuccuaacauguacuguggugcauguguggaagucaggacagcuuggagacgguccucuccuucccccuccgccaugcagcucaggacaucaggaugggguggcagcuuggccauccugccagcccagauuccacacuuuucauucuccucuaggcaggaguugcuaaugaagcagcugucccuggaagcuggcugggaaucuggcuggugagggccagguucaauguuagcaucccuaguaugcaugggccucacucccaggacccugcuccuugacuggaagcaacugaacaagaaaccugcccaucugugcccuuccuuucuuuccaaagugguuucuggguggcagggcuagguucuggcugauugaaggcuucccucugagauuacugguuacccuacucugcccuucuaucuuuccuccuuuucccaguggugucccuguggccuaugauaggcugagcaucuugucaaaccuacaauccgaaauugcccauugcacuugaggaggcacugaaguagauauauauuccuggucccuggagucugucucugucucugugucugucugucucucugugucugucugucucucugugucugucugucucucugugucugucugucucucugugucugucugucucugucucucucguacugcuugcucucuuugggucuauuucccucuguaucuguuugucugacucuuuuuuuuguuuguuuuuguuuuucgagacaggguuucucuguguagcccuggcuguccuggaacucacucuguagaccaggcuggccuugaacucagaaauccgccugccgcugccucccaagugcuaggauuaaaggugugcaccacuaccgcugggcucuucucuccuuucuucucccugucuuucucugucugugucucugucugucugucuaucugucugucugucugucucuccuuuagacaagguccugaaucucacuauguaaugaggcuggcuccaaucucccaaucuuccugcauuagaugcuaagugcuagaauagaugucuuuuaucaugccugccucaggauuuuuuuuuuuuuuuuauuuuauguauaugaguacacuguugcugucuucagagacaccagaagagggcaucaaauccccauuacagaugguugugagccaccaugugguugcugggaauugaacucaggaccucuggaagagcagucagugcucuuaacuacugagccaucucuccauccccagugccucaggauuuuuaaaguuagguuuguugggaaaaguucuuuaacaauuucacauuuguguacaugugcguggguaugugaugucaacuuacacacauggucagagggagacuacuucuggcucaguucucucagcugucuuucugguccucggucauucuuuuauucaucuggugcuagggaugacucccaaggcuucugcugugagguuaauauucugcuguugaacuguauauucuaaauccuuccauaccauguggaagguaaauagaaaauaucauuucucugcgaucugcuuuuuuuuuuuuuauuaaacccagauggcagaagugguuccuggccuuaccacuauacuacuucauugguauauugguccaguucacuucugaauuaucuuuuuaaggaggugauuucagcucugauagaugaagccacugaggaagaguccagauggugugcucauggucguuuuagaggacaagggggugaagaugggguuagacgggaggccuuuuguuuaaggguucauguauuucuuaccaaaaugguaacaaaagaugagcagaaggggagggggauagaguuaugccuauaguuucuccuucugaagauguaaguuccagaaauauggaucauggacauauaguuagacacuacagaaccacacauuucaucuuccagugaagaugguaguuacaguggggcauacccauaaauccaucacucaagaccagagagaggcaggaggucugaacuuuaagaucaaccauauuaucuauuguauagauaguaaagucaagccuaucuuggguuaaaaaauuguuggugcauuuaagagcaguguccacagcggccuuccccuggaaguggaguuacagggcuucgaguggcuggaugugggugggugcucuccagggaggaagcuagccacugcgcagacaagcccacuuuuguuuguuuuguuuugagacuggcuuucucuguguggcucuggcuguccuagaacuccacuguauagacuuggcugaccucaaacugagaucugccugccucugccuccuuaguguaagggacugcaggcaugcgccaccaccgccuaccuuuuuccuuuuucaagaagauuuuguuuuuagaccaggcucaauacacagagauccucuggcuuuugcauucugagugcuggaaucaaaugcaugcaugccacagccucugccagacucaaaagauuuuuuuuuuuuuaaaguuguguuugugcaugugagugcaaugcccauagaggccagaagaggcuguaggacccccuggaaguggaauuacaggggcuuggagcggcuggaugcgggugcuggcaagcaaaccagagucauccucugcaagagcagcacuaccugcucucaagugccgagccaccucuucaggcaagggggagguggguggcgccagucgcagcacggacgagcccacuauagccaggaggugugggugccuccguugcgcgcaugcgcacucccuucgggcauagcauggucuucccccacucucuugcccugugugguacaugcugcuuccgcuugcgccgcccccucccaauugguuuccgcgcgcgcgaaaaagccggggucucguucagagcuguucugucgucugcaaccugcaagaugccagcgcgaacagcuccagcccgagugccugcgcuugccuccccggcaggcucgcucccggaccauguccgcaggcgguaggugccacgcagggugggggugaggggcgggaccgaugccgaggcauauauuggggguaucuccggguggcccugcggccgcugacagccagggcgcgcaugcgcggggcagcguuuggcgcgggcugugcuuccugucgcgcgugcccuuagcuguuggcgccaaaaugggugggggccggggugcuggcaagcccauugacugggagcuugagggagcaaggggaucagcccucugaaauagaacaagcuuggggacacccucagggguuccccucuuuggucagccaggcuccugggugugcaggaagugccccucucccggccuguggacacccugaagcccccacuccgcuccagccuccacuuccggugcccugcagaucccgccgcgcccacccgagggucccuccgccgguuccccuggcccugguucagaagggcccuccuucccagccccgcugucaaguccuaggaccuuuucucucucauccugccgggccgggccugggcagcuugaagcccucgugggauuuuguuuuguuuucauccuaacguaaaggagcuccugcgauccuggagcuaucaaagagacucugccuggaaagagcuggugcugcagaaugggcccuccacuuuggcagugacauaacucugucccgagaucccagagcaaucgaggaaaccuuuaacuccauucaaaguguuuaucagggggaaggaaagaugaaugguagugagaugucucggcccccgcccuauuauuuuagccccuguaaaccaguucuuucgguccuggcgccaucgaggaagcuuuuuacauuguccaguguuuauuucgaggagugagggauggcagguaaagucccccauuucagugcauaugaauccccccucuccccccccccuccccaagcaaucaaggaagaccuggguaaugggcccuccacuaguaccuuccacgccuccaugaggacggcugugugcaaggauuggcgggaacacuggaucccgcuuccuguuccagaagggcaucgucaauccguucauuccugaaagcuugucccgcgcgucauugagcauuagucauaggugcccugcuagugcuggacacaucccaacccgauucugagucugcuuuugcuaucccggggguuaguuuacuggggugaugccaggccgauucccauuugagcuuugggggauaaagugggagaagcggcugaauuccccuugucaaacaccccugcccccagcucgcccccaggguuggaccugaagcucuguacugagcuacaccuucagcccuuucacuuguauuggagacuggccugggauucucucucucucucucugccugugucuucucagugcugggauuacugacaugugccaucaugaugguuuggguucguuuuuugaaugcuuguuuuuugauuguauaggcauaaaaaucugaagccuuugugagacaccucaacagauuucuuuuuacuaccaaaaaauacauacauaauuaaaguauuugguuuuuuaaaguuagacagucuguaaccugccuuucugucuuuugucuuuccuguucucggguugguugguuuaccuguguaugcuuuguuuucauuuccaggaagggauuccuguaggccaagcuagccuccggcuggccgucuaacccaggcuagccuuggucuuuuguaucuacccaagugcugggauuacaggaaugugacacugugccuagcuuagcuuuucuugauuuagaaaaacuuacuagcaaaauaucuacaguaugagauuugagagguaccugcauuugggaggauaguccaggagcugaguaggccucgagguagcuuccguccaugcugcuauucuguauuuaaauggcaguuuguuuaaauagaagugugcauaguuccucuggauauauaaaauauaguaucuucaacauuuggauuguaagucuuuaaguguguaugugggucuaugcuacagcuuguguggcagucaggaccccuugcaggaacuggccuuuccacaagauucuggguaugggaacucagaccaucaagcuugguagcauuccucuuaucucaccagccccagacugacaguuucucugaaauauaguaaaccuugugucauucaaaaaucaaaucaugcuuuuuagugagauguuguggccauggccuguaacaucaggaggcaggagcaggagggucacaaguuagaauucaacuaaggucucauuucagacauucacaccuugcaaggugagggauuucuuuuccugagcaggggguguccuuuccauagcugagauuccuugguuggcauggguuuuucauuucuuucaguuuuuuuaaauuaaaacuuguuuuccaggcacgguuucuguguaguucaucuggucuugaucuugccacgcucgugccucuggagugaugcguguuacaugcuuggcuugcuuuuaacuuauuuuuuguuaaaccuguguauaaguggugugugugauauacauauauacacauauauauguacauauacacgaagguauguguuaggggacagcuuuuuaauuuucugugcauaugcaccacaguggcauauagaggucuucguggcaguuaggggucuuugugguguuuauuacucucucaccucuauguggauuugggaucaaacugaggcuugucaagaauguguaacaagugcccgucucaccaagccauggguaacuacguuuaucuguuugucuguacaguguauggauggaguuggaaaacgccuuucuugagucaguucuuagggguccuggagauggaucucaggucgugggacgugacaaccugugucuuugucuguggagccauuucaucugaccguaaacuuuuauuucauuuugagacagggucuuaccauguagccucagcuaacuuggaacucuguagaccagauugcccuugaacucaaauauccaccugccuuugccucuugaauacugggcuuagagacaugugcuauuauggccagcuuaaaaagcuuuaucuaucuaucuaccuaucuaucuaucuauuuuagaauuacauuugaacuuuuuggaauugguuucuugccuucuaccuuaugcugagaggggggggggugguggaggaggcagguugauuacuuguguaggugcuuugcugugagucucugugcaccacgugugugccuggugcuggagcccuacaaauggauuuucacuuucaaccuuacuugcuuuuuggauuuuguuuguuugagacaagguuucacuauagaaccccagcuguuguagaacuuggccuggagcuaacaaacccuucuccuaccugugccucugaguaggggacugauaaccuuugcuuugggaccauuugcuuauaaccuugcagcacuugauucaguuagucugccuggccagcaggcucaggggaccuuucucagguccaugccugucuuuuugaguuuugagauccaaacuccuguccuugugcuugugugacagucacuucacugaccuccgaagcccuuuucugauggaguuuuccagacaguuggguagcuggggcuggccucccauuuccuguguagcuuaagacggcaugaacuccucauccuccugccuccacuacaggcgcuggcguccguggcuucuguggagccucagcugcgcuaagcaagcgcuccaggugcugauuuucucccucucuguauuuaggaucacgcugcagaaggcugauacagcauggcuuaacucauuaggaggcgggccgaguucuaggacuuaaacuuuauuuuugcugugcugaaguugaucucaggccuguauaucuguuagcucucugguggaggggguggggaguggggguaccucucucugcagcagauccuaugcugucccuuacagugguguaguugucauuuuuuguuuguuuguuuucgagacaggguuucucuguauagcccuggcuguccuggaacucacuuuguagaccaggcuggccucgaacucagaaaucccccugccucugccucccgagugcugggauuaaaggccugcgccaccacgcccggcugcaguugucaucuuaaucuuggugcccuguccauguccauuuauuuaucugugugugucaugugcaugcaugugcccauuagagaccacaggaagggguugggucccucggagcuggaguuacauagggagagggugcuugcuguaagcugccugacccaggugcagagcaaugcggccacgaagcagucucucuagggcuccccauccauucugggcgggggugggggguuacugggguuagaacucagggcagcuauuuuaccacucagugagcuaucugaaaaauggggcuggggcugacugcuccucaggguucuguaggccugcugaacucgugguaguagguuaggucuccacccugggccaucgcagcagugagcagggagugucuacaauauauucagguacgcugugcaguagacuguuggauuuuauuccaagcucgcuuguagaaugaucuaggcuuguucuuucugcaguuugccuaggcgguuugugugccagaucucaagucacccuucuguuuuuaaacugggucuuuguagcccaguccauuuaacucucugaccugcugccucagccuucugagugcugcugggguugccggcaugagccgccaagccugguuuagcauguagcucuuuucucagagguugaggugacuuucugucuaucuucucaguguggcaguggagcuggggcucucagacaugccaggcaggugcugugccucugagccacaccuugggacagacacuugcuguucucuugcucucguucuguaggucaggaauugagggguaggauggguagagaagaaaccuagauguccugggcuggauuccuucuggaaacgggcagggagucuguccuccuggggagcugacuucuaguuucuugcuguuugugggaaauguuuuuguuuuucauggcaggguuuaucucuguagcccuggcugagaauguagaucaggcuggccuugaacucggaucaccugccugcuugccacugccucccaagugcuggaaacaaggcaugugccaccgugcuuggcccuaauuucuuuuuuguaauuucaaggcagggucuaguuguauacuuccaggugaucuugaacucggcuucccuccugcagccuugugagccugugccagguguguauuacaucugcauacguaugccuguguaugagggcagcugugcuccucagcaugcauauagacaucugagggcuauccuaacauaauuuuuauuaacuaaauuguaguuacuacacuggggggguuguuacuguacugggguaugugugaaggucagaggucagauuguuggcauugacacacuuucaucuuuguguggauucugaggaucaaauuuaaguuuuuggacuuguacgguaaacucuuaacgacugagcuagcucucccccccccacgcacacacacacacacacacacacacagaguacauuuauugguauauuuagugugugcgugugcauguguugccaggccagaggucacuguugguugucuuccaaaauuaucuccauuuuauuuuuugagaucuuucucacaugggcuggagagauggcucagaaguuaagaggacugcuuucucuuccagaggucccaaguucaauuuccagcaagcacauggugacuuacaaccaucucuaaugagaucuggugcucucuucuggccugcaggcaugcaugcuguauacauaaauaaccuuuuuaaaaaaaucuucucggugagcccagagcucuucuuugaucagguuggcuagcugucgaaccuagggucauuuucuccgcuugcagguuuuaacguggguccaggaauccucacuugggcccuugcugagucaucccgucccucuucauuguggcuucagacuuguuauguaacugagggugaccugagccucgugauguuccugccucggccucuugaguguuggaguugcgggugugcaccgcugugucuggcuaaguccaaacugaguagucuccagcuucugaaacugucugacagggugacuccuaucccucagucuuuccugccaccaccuccacuuuagagccagccucuuaggccaagucccugucucugacccuuccuccauguuuuaguaccuuuugcagugcagcuagaagguucugugccgauggagcggagugauuaggccaugcugauugucccugauaagcuucccaucuuucauucgaaaaugcuggaaucuuagucacaucugcagagucgcuguugccaaauaaguuagagucaugaguccuggguucugagcaacagcaucuugugagaagggacgacaucauuuugcuacccaagauauuaucugauucaucagccggccucaccccauuugccuugucagaggcagggggccggguguagcugggugggagagagugcuucagcauauucaaggcccugacuuccaccccagcagcagacagaaaaggcagggcucuagaacaggcccuguuguguuaccaaguuggguuucagacgagcauuucugguuuaggauguugaaauaacaaccuuugcaaucucuccaguucauguuucugucagacaaauuuucccuaaaaguauggcuccgauguggucuuuccucucaugugguucuuuugauggccuugcaacaagaugacuacugagugucucccacaguugcuggccccucucuggacuuaccuuuucuguccgacacuguuagggcuguuuucggguugucuuagaagcagcuuccacccuggggccaccuaggucaccccuucaugcuguagggcuuguuccuucuccagggaagaguguuuuauguuuuguuguuuuuccuuuugagacaggguuucuguguagcccuggcuguccuagaacuugcccuguagaccaggcuggucuugagcucagagcugccugccucugccucccgagugcugggguuaaaggcgcgugccacuguggccccacuaaagagcucaagauuuaacuguucaucuuccuuagaugugcuaagauugggucugguguguguguguacacggcaugcauguggagggucagggcugcaguaggagguccuucccacccccuugguugcacucuggucaggcuuggugggaggugccuauaccucaacacuggcugcucuccgggaacccuacauuaucuugagguaggauggagccauacaauccaggcuggucuggaacuugucauccuccugccucuaccucuuugaguguuagcauuccaguucagugcugcugcaccuggcuauguuugccugccuuuucaagguuuauguauaguuuaucuucuuagaugacuagcuuguugaaaguaguuaugaaugaaucauagccuguaagguccgcauggggcuaagguggacuuugucauucaguguguuugcuuuuuguagccugggcuagcccaugaacuccccauccugagugcuaggauccaggccuguacuaccaugccugacugagucugucuuggaggaaucucaggaucuagaggcugcugagcaauggucacaguagcugugucccaccacgauuuuaagugcacaucacuggguuugggagugugacucaguagugggccucuugcccaacacauaggaguuucugauuucauccgagcucagguggggcauaaaagggacaagacagucacaugggcuguuguagcagcuguguuuaugccucuggccacaaagguccacuugugcagcugccuuucuuugagucuugccuuuggcuaagaacuguagguuacuuacugugggaugacuguugccgggcuggccugagcuccuuccuggaagaguuuucuuuucaucugggugcugggauagaacucgggguguuguguguguuaggcagugugcucugccacacucuagccugagcuaaaacaaucaccuuauuuuaguuauuuacgugaagccagacuagucuuaagcucaauagguagucuagguggcccuguauucuuguaucucuuucccccucuaacucccaagagcugggcucacagguguguguuaccacaccuggguuacugggugcuggggauggaacccaaaaugugcauccccggcaagcauucucaaggccccagcugccaggagcuaagucccugcucuacuguagcuagccacgguccagcugcaggguauagagcaucuuuccuaagcaaagaccugggggcugacugucaggcugguaggcaggucccuaucugcuaauaugagucuaguuacccagcuuguugccuacuuccucucucaggggucuagcaugaaugcagugggcaccccgguacaggagugguacuagaaggagggggcaggaccugccaguaacaguaauuagaguaaccauggugacccugguccugcagcugccgggaaggcuggaucugccuucuaguuacugaaaccugagaagccagacuuggaagcugcugagaugggacagagaugcacaggccaggcccuuguggugcuucucugacagacacccaccuagcugguuagaccuguucacccucuacugcccccaggcucccaggcugaguaacagguggccucuucugggucuuuuccuuuuccuucuagucuuucuccccugaccagagaggcaagagagucuucagcaguugggaccaguucuuugcagacaagcccaguagaaugcugugcggcugugcuuagauacacauucuggaggcugaguuccgggauccuggccuacaguauugugucucccugugcagugcggugcguggaaucccaggccuccacaugccugccgggccaccgcacucuuacuccugagcugcguucucagcucgccaguucaccuccagcuccucaguguguggcugugggcaagcccgauggccugggccuccuuucccauuuauucaguucugcaggagagggcugccagccauacauggccuugaggagccaucagcuggcuggguccuacaaugcagccaugacucaugcugacaucaugcaugcuguggcaggccuuuuaggagcugacccaguuagggaagacagcuguaggucauccagguuagagauggacccugacugacagcuccucaugucuuuucuuguauauuuucccucugcuuggaaacagggucuccuguaguccaagcuagccucaaacucacaguacaaccaaggaugacucugaauuuuugaaccaaccccuucaugcugaguccuggaauuauaggaaguaccacaauaccuaguuuaugaagagcuagggcuggaacccagugccucaugcgugcucugcaagcacucuucuggcugagcccuaucuccagcccuguuguuugagggauggucucacuauguaauccaggccaugaucugugugccagucuggcagugugagcagcuaucuaauauagcuccugggcugaccuuaccccuuucugguagaaugcugugugcgcuugcucagguuacuaaggacaucguaggaaggcgcagcagaacguacuagaaauucaggugugguggggcaugauuguaguauuagcauuugggagguggaggcaggaggaguaggagaugaagacagucucggccacacagcugugagacucaccucuauacaacagccaaaaaaguugaugcuagacaccaggugcaggggcagaagagggggccguguugccgcaacacucaaacauguucauuccucuuuccccuuuuucuuucccuuuucuuuuugaggauacaauucucacuguuacccagguuggcugcaaaguuacaggcuugagugauccuccugccucagcaggaggcuaaugccauaccacaccccacgccccccaguuuuuuguuuuagauugauuuucagagguaaaugaaguuacuuauuuauuuccuuuacccaggcucaaagacuuggaaagagauggcuuaacagaaaagguaaacugcucuuccuguguguacuuugugugcuuuugcguguguucaugugugcgugugugugcgcgugugugaguaggugugugugcgugugugaguagcugcgugugugugugugugugugugugugugugugugugugaggugugugugcgugugugaguaggugugugugcgugugugaguagcugcguguguaaguagcuauaugcaauuagguggguacagaggcuaggggguuggcauugggucacugugcacuuuauuuacugagguagagaccacugagucggaaacucauggguucagcuagucuaaagcaucagcuuggucugggaauccuaucugcccaaaugcugagauuguaggcuggcuacucugucugccaagcuuuuaugcuagcccuaggcuucaugcuuacacagcacgugucugaguguccgagcuguugcccgaggccucugggguugguuggguuuuuguuguuguugguuuuguuuugaggcaggauuuugauccauaguugggcugaccuggaacuuaguagguaguucagacuggcuuuaaauuuacagcaccccuccuugucuaagcuaccugaguguugagaucucgggcauccuacacuaugcgugccugaccuguauuuaguuuuuagcagagccagggcugccuuuggccccagcugcuggggcaguuaggcaucuuaguuaugcauuaguuuguuaauugcuagcuuggaaguuugggguuccucagcucuguucuuccuacaggagugugugagggagaaauuaaacuuacugcaugaauuccugcaaacagaaauaaaaagccaguugugugacuuggaaaccaaauuacauaaagaggaauuaucugagguaagucuguccuuuuucccaguuuccagaaagcuaccugcuugugaccagaggcagaggccccuguguguccuacugugaugucuuccuacuaagauauccuuuccuguuguaggaaggcuaccuggcuaaagucaagucccucuuaaauaaggauuuguccuuggagaacggaacacacacucucacucaaaaagccaacgguugucccgccaacgggagccggccaaccuggagagcagaaauggcagacucaaauagauccccaagauccaggcccaagccucggggacccaggagaagcaagucggacagugacacccuuuguaaggacacgagacauacugguuuguugguuguuuuggguuuucugguuguuuuuaagacgguaccugucaguauaggucagccuggccuuagaagucuguccugcuucagcccccugagugcuggugugauaggccuaugcugucucacaggucucaguugacuuguuugcaucuuggaggcugugguucauuugaagagucaggccacuugaaccauggcacguaccacauguauucuaguuguuuguuucuggugcugagaaggaagccuaaggccucgaacacuaagcccaugcugacacucagcugcgugucugugccccugccucuggagugcuagugguauaacccaggaccugggugugcuagggaagggcacaucuaucugccaagcccuggcuggcuuuuucaggggagggaggagcucuggugcuggagauggagcgcggguguacaggugcucugccacagagcuguacuggccucuggcuuaguuucugugcacuucuaccuagcuuggacucccacagauggucccuacaugagguuucauucaguuuaggguuuugcgguuuauaaugguguagacaugguagguagguggucacuguaaaccguucuuggauucugggcuguaugcuacuguugcuggauacuaagcaauggcaguucuaaggggcugccugcugacccauguaaacugcuaggcaguuuauaguccagcugagagccaagaagugugcauucuugcagugccugccaccugcagucacuuguucuugaaguaugccaugucacuuucucuuguuuuuaagcaguugaaacuucaccuaguuccguggcuacgaggagaaccaccaggcagaccaccaucacggcucacuucacgaaggggugaguaguaaggaguggccggcuggcguucuuggggccuaagaaccuuggggagagaaugagucugagcggaugucccugccuuccauaacucauaaguguuguauuucuugccuuuguuuuaguacugaggcuagaacccagggucugguuuauguuagggccucuaccacugagccaugcccuacccacucaucagggguuuuaggcaggggcugucccacugggccaagccccuacccucucccugggggauucuaggcagagaauuccccacugaaccacaccguggcuucgcauagacauucauuuuguagguuuuuguuucuuuuucaccuugugagauaacuuaaagcauacauauacaaagcuauagaauacaguccaagaacccuuaugcugagucagaugucucagcaguuagagcacuggcugcacuugcagaggacccagguuugauucucuaccagcacauggugguuaacgaccaucuguaacucuaguccuggcgaucugcugcccucuugcagcguccuuccuuccgcacugcaugcauauggugcacagacacacacgcaggcgaaacgccuauacacaugaagcuugaacaaaacaaagaacccucguacuggccaccgguggccaccggguaguagaaaaauuggacacgaugcugcuuucacgccuuuaugaacuacuuuuguaauggaaccuugcuccauaaaguuauaccagccaacuucauagcagcauaaacuuaaggcaaaacauauauuguggguuuguuuauuuauuuuuaaagauuuaaucucaugcauauggguguuuugcuugcauguguguaugcaccacaucguacagugccuguggaaaucagaguauuggaucuccuggaacuggaguuaccgaugcugggcccugagcccagguucucugccagaggaggaagugcucuuaagcaccaagcugucucuccagcugcacacaucuguuccuaugcaugcauacauaguguguguauggcauguguauguauuugugcaaugugaucacucauccagccagccauggccuagguggaacuugggucuuugagagcagugggcgcccuucaucacugagccagcucuccaggacacaauguuucucugaaacauuagagccuugccugccacuuugcaagucucaaagaaguggaucuagacagcaauagcuucuuacaaagagaacagguuuuugacaaagauaacuguucuuugagucagccucaaaguaugaagcuggguagcucuuuuaaagaagaccugguuuuaauuuccagaaccuacauggugguucacaaccaccuauaacucaggggucugauguccucuucugaccugugcaggcaccaggcacacaguucauagauacacaugcaaaacaaagcauccacaaauccuuagagcugaaaacggggagacgaccuaguaggcaaaguguuugcuugcuuugcaagcacaagaaccuguguucugauccccaacacauguuaaaagccaggaaugccaguucuuguuuguaaucuuagcauggaugggguggacacaggcaaauccugugcccuggcuggcuagguaguguagccaagccagugaguuccaggaucagugagagacaacugucucaaaaaauaaagggauggccagugguggcgcacaccuuugaucccagcacuuaagaggcugaggcagguggaucucuggaguucaagacuaaccuggucuacaagaauuccaggacagccagggcuacagagaaacccugucucaggggggaaaaaaagggcagcuucacucaguuccagguggcucacuucuuaacaccugcuccucuuacagaggaggaccuggguucagggcccagcacccauggugccucacagccacugguaccuccaguucgaggggaccugacacccucugacuuccacaggcacuguacaauguggugcauagucacacuuacauacaggcaaagcacucauggacaggacauuaaaucuaaacuuuuuuguuuaaaaacaaauacaugggucugagcacuguacucacaacugccuguaaccccagcucuagggggccuaacucuccuggucucucaaagcacacgcacguauacacuaauacaagucauuauuaaagcccuucaguccuggauaggugggccccuccuggcagggaagauaccuggacguuuaagagguucuucugugagcgaagggaagucauugaggaccaccagacagcaggggggucucggcacuaacagucuccucacugugugacagccccacuaaacggaaacccaaggaagagucggaagaggggaacucggcugagucggcugcagaggagagagaccaggugggccagcccugucggcucuggacacucugauuuacuugcuagcagagugagcaaagguggucuaucugaaggcagucuccuuauauauaguagggguguuucagagucuguggcuagacgagggcgaggggcaaccuguugauggacugugcuacauggugguggaccccgguggguuugaaaauaguagcccagcaggcugagugcugggacagcugacgcuguagaucugaucugacagcauuaggaggcagcucuacuuaguuuauuuuuuccaauguugggaucaaaccuagggccucauucauccuagguaagcauuguaccguugaacucauucugggccccaguguuggacacguacaaauauauugacaguauuauguagcccaggcugggcuugaacucuugaucuuccuggcuccaucucccaaguacuaggaugauaaaugaggaccaccaucaccagcugguugggauuucuauguauauuuuggguuuuguguguggguuugugcacaugugugcaggugcacaagaagccagaguuagaggaguuaugagccaugugagaugggugcugggaacugaagucugccgcucuagaagagcaacauacacucucuagugacugagccaucucuccacacacccugcgccucuuugagacaggaugucccuguguaauccaggcugcccugaagcuguagcucagggugggcacgaucuuacggugguccuccugccucagcuucuugaauaccgaguugcaggucugggcuagcacgccuggcucuccccacuuguuuaacuuguguuuguuguuggucugcuuuucgaaccaacguugucuucucuuccucccucugcccaggauaagaaacgcagaguuguagacacagagagguaagaauccauguagucuccucugauuugucucacuuacagaaauugccuucugaauaguugaaagaguucuguaguaacuauaaaccuauucauggugcugaauuuggagccaaauuauuacuuuuguuuuguuuugcuuuuuuguuuuguuuuguuuuguuuuguuguuguuguuguuuuuuguuuuccaagacaggguuucucuguguagcucuggcuguccuggaacucacucuguagaucagacuggccucgaacucagaaaucugccugccucugccucccaagugcugggauuaaaggcgugugccaccacugccuggcuuggggccaaauuaugaaucuuucaauuccuuccuccucacagaaggagaugaggucuccuggugucaugaggccuggguugguaagagaucauuuggcuguuaguucuggcguggcagcuucuguugguguaggaaguuggguucaugaagcugcuuccggggcucgggcugcuuggguccugccuagguaauauucuacuuuaccugacaguggugcugcagcugcuguggagaaacuggaagagguaacagcgggaacccagcuggguccggaagagccaugugaacagguaaagcccccccuuccuugagcacaucucugguggaggugggggagcagaagagggguacgugacaccuggcuuagggugacgagauggaaagccucccaggagggcuccuuugugagccgagagguggugcuuacagguuagagguuccguagcagcauccacacacgaaguugccuucagggcugggcucuggcucaguggcagaggguuugcauagcgugcuugacgcucccgucccauccccaguauccucaccagaaagaccccucccuaccuagcauggccuccuuggcugggaugaggucagcucuuuccuucaagccacccuggggggaaaugaaggugaaggcucugagcugcacagaugcuuuuugauaaccguguagcuucguugguggagcacuugccuggcguguauaugcagccuuggguuuuauccucgccaggaacaacaacaaauuuccaggccacuuagucuguacuugggaaagagaggccauccuuuucucucucucucucucucucucucucucucucucuuucuuccuuucuuucugauugguuuauuuuauguauaugggcacacuguagcugagcagcugguugugagccuucaugugguugguuauugggaauugaauuuuaggacuugcuugcucuggucagccacaauugcucaggucaacuccacuggcucagucccugcucgcucaggcccaaagauuuauuucuuauuauacauaaguacauuguagcuacaccgggcgguggugacacacgccuuuaaucccagcacuugggaggcagaggcaggcagguuucugaguucgaggccagccuggucuauacggugaguuccagaacagccaaggcuacgcacagaaacccuguuuccaaaaaccaaaaaaaacccaaaaaacaaaaaaacacccaaaaaguacacuguagcugucuucagacuugccagaagaaggcaucagaucucauuacaggugguugugagccaccaugugguugcugggauuugaacucaggaccuuuggaagagcagucagugcucuuuccugcugagccaucucgcagccggaggucauccuuuuuuacauagcaaguucaagaucagccugggcuacgugagacuuaucucaaaaggcacccaaaaaauuacauuuauugugucuguuagaguccauacauguggaugugaaaaacagcuuuuagguguucuuuuuuaucauggagcccaggaaacucgggucaucagucuagacagcaagugccuucagccacagagcaucucgcuggcccuagauuuguccuuuucuguucagggaacucuaacuugggucauuagacuuguauggcgggcuuuugugcuugccaagauauuucccuagcccuuuaaaacucuuuacuuuugugugugugaacugcagcaccuccccugccccaggguuugucuccuaaggaugccuuugcugucugcugacuccacuagaagacaguuuuauuauuuauuuauuuuccccugagacaggguuucuuuuguguaggagaaaacuuggcugucccagaacuagcucaguaguucuagacuggccuccugagugcuggguuacaggccuguggcaucaccgcggggcauaaggaagcaggguugggagguacuuuaaugcaggcuugugugugaguugagaaaggcaaccuccuagagacuggguguggcucccccagaauuggaguaagacaaaacuaagugugguccgggcuccaggaagagccacccaaaacauucacuuaccaaucuuacuaacuagaaccuaguaggguuacugccggucugucaauucaggacaaauuggggaauugacuuuucuuagugguagugccagggucucaguuuguauguauauguggccgacgucaaacucaauauguagaccagacuggcuuuuuauuaacucuucuuuccucuccuaggaagaugacaacaggagucuucgacgucacaccagagagcuguaagugcagcugucaugccuccgugcccuaaaguggugcuugcuugcagugucgcugcugugaacaggggccugggacugagcacuaguguauuuuguagccugagaaguuccacugagaaaaccuagaccaaggugggcuggagagauggcucagcaguugagaacucuagcuccuuuuguaaaagaugcuggguuuuguuccuggcauguggaagccaacugcugccuguaacuccagaucccaggggguuacuccuccggcacauguauacagaugacaugcuggcggaacacccauauacauaaaauacggauagcugaagaacagacccaaggaccucacccagugagguggcucacuggguaaaggugcuuguucgcaagucugacaguugagcucaacccuggagccugcaugaugaagguugucuucugaccuccauaugugucuauacuuguacauacagauaacuaaaguccaaccaagcuggccauggugagacacaucuggaaccucaccuuguguuggaggcuaaggcaggaagguucucaugaguucaaggccagccugagcuagagugagccacuguuucaaaaagaaaugagaaaccauuaagaaauaagagcauuguggugcacaccuuuaauccuagcacucaggacacagguguaucucugaguucugagucaaccagguuucaggacagccaggacuauagugagacacccugcuucaacaacaaaagguagucugccuacccuagaaaaggguagccugcgaccuucuccuuacucagacccugccucagcagucacguugccauccaucacguuacuaguggcuguuuaagugagcuugugcuccaagugucuuggcugacggugugaaagcuuagcagccacugagcucgucauugagccuugcaccuggcagcugauucuggcugacagugggcuaacuuaauuguccaccacuuaguccacaugaagacauccuuauguccauagaagggcacaagcaacuagugcuggccuucaauacuaaguuuugauucugguguuuguauauauuuuuuguuuucgagacagggcuucucuauguaguccuggcugcccuggaacucgcucuguagaucaaacuggcuuugaacuuugagcagagauuugccugcuucugccucccgagugcuagagauaaugcugugcaccacgaccuggcuuauuuggagguuuuuaauagauaggaucuccuauguaauucagacuugaucucugcuucaggaucaagaauacaagaauuucaggccuguucuaucacauccagauagagaugauccucgugacaugucuuaacaugugggugucucgaauccagacaggggauuucuuacuggcaugcaucuaugaguucagaugggagucccaauugacucuggaggucacacuagggcuagacucacaccuccuaagcacuggagucacaggcccugcccagucagugcuuauguaggugcugggcagucugaacuucaguccuuuucugagcuaguccagucuugagaugguaucgguggugguuuucggguuuuuuguuguuguuuuuguuuuuaaagcuucuguuaacacucacuugacucaugcaaauauugaaggcccaagugcagagggcagccuggugccugauccacagaugcgcaggguggaggguagggugcagaagaguaagacagucgggcuccugugggauggaggccagccuucugugcuugcugaugcuggccucgccacucauuucaucacgacaguccugucugccuccaggaccgccagugaaggccugcuaguuguuuguccuaaccuuuggcaucucugauuaucguucauuugaagagcuaaguggugugguugauagacucggggugugcacgggcgcacaccaguguguuuaucugguguauacccaugcuccaucuugccugcagagguaaggggagagcucccagguuucacuucacuccucccauugugcauuguggggauggaacucggaucaucaggccuacgugguaaaaucuuuccucuguucagacgucuggugggccccagcugagugcuuguuaucggcucaugaaugcuguaggcuugagccccaguucugcaaaaugcauaaaaucaugaaggauaaacagguggcggguaggaagggugaccuggucucgaacugagaggacacauuuaaacccgcauuugacugcccagagcauugaugaucaguguccaugugugagguuuuuuuuuugcuuuuuuacuuggcagaucauugaggcggaaaucaaaggaggauccagacagagaagcaagaccggaaacucacuuggacgaggacgaggacggaaaaaaggcaaaguccuuacuaucuaagugggcugugcugcacuccccuggauuggcagagauggugcugggcaggggucugggcgcagcaccugcuccucaguacucgggcagguuucccuggucuccuuuggguguugguugucacugcacguuggagccugucaauucagcaagccugccugcuccuuuaaguccuaaguucaguucuugacucuccaucugucuuugcuuacucagcugagcaucuuccuauccuaaacaggccuggcuaauggaacacaccuguaaucucagcaggaggguagaggcaggagcaugauccuaaacaggaggaucccggccagccugaguuaaaaacuguuucagaacaaccauaguccuuccugcaaagcaagagcauacaguuagacgucggugcaaggauucucucaguaaaauacguggagauugaacaacccagcguuugcuugggugcucauguccucuguaauccccucuagugcauguguguuaccuagcacccugucugugcuguuugcuuugcugguaugguccuguuuaaaaggggauagaaaaggacagucugugggcugaggacagguuucugagccucuugcaucuacagucgguugacucuugagggauauggaagacugauugccuuaggugccaaggccucugauagggcacagugcucgcucuguggaucucuagggcagugagugaggccacagacucaugucucagguguccaccuuaggagaagccugaaauagcuaccugguuuccuccccauugagauuuauagaguggaguuugagcccaggcgagccggcuugcgaguguucucacugcuugucuaagaaugcaacagaaguucucauagucgccucaggugcaguaauauuucugugugucucccucuuugcccggaugccaguggaucacugucgaugcuuaccugaaagcagggaguuuuugucuguauucuguuuuuuucaugaguguguguggacaucaagaggacagcuugugggaacugguucuugucuaccauagggaccccugcaauggucaggcugguuugcaggagucaucuuguuggcuagcucuugguuugggauaaguucucacucugcgacccggauggccugaagcuugucaccuaucccaccaugccucacagcugccuugauaugagagcaauacucaaguuguuauguauagacccacucauaccagauagguaucagugaaggacuccucauuuauaagcucagaaaugcuacacuggcuagugucuguuuggaacacaacuguguaauccccuugcccuccuggcuuuccugccucucgcuccauccccagugcugggaucgcaggucugugccaccucccccaagaccucacgcuguccacugaguccacuguuugguuuugagacagugucucacuguguagucccggcuggcuucaaauucagagcaacaccugccucucccucccaagugauaauuaaagaugggugucaccgugcucagcugugguuuugucuuuguuuuuaggucuuuugagacaggguuucucuauaucccuggcuguccuggaacucacucuguagaccaggcuggccucaaacucagaaaucugccugcuucugcuucccaagugcugggauuaaaggcgugugacgccacacccggcuugucuuuguauuuuacggcaaggucucaggcuucauccucccccaagugcuagguuauagcaugaccaccaugacuagaaaguucuguagugccuguggaucgugaagccucugguuuccccguuuuggcucaggagagaaucugucuuguguucagaaccaagaugcugaaccuaugcucuucuugcauucacucugcuuggccucugaaguaacguuguuguuuucucuccaugguuugcugucaggauaaaagaaguuccagacccaggagccagcccagagauccguaagugucaaaagugcuugcaccuugcuaacuguuaacuccuaaaggcucugcuagggagagucugaguagacagggagaccagggagucuggggcccuagcuggggacccugugaggguucgcugggccaccugcagaccuuucagaaggguuucugccuucagagccuuuaugauuuuugguuuaggggugaaaguguugaacugucuuauggagcccauggugaccuugagucccugauccacucacugccucuacuuucccugggcugagauuacaggugugcaccacugugaccuuaaaaguuuauguguuugggcauuauggccgcauacgugccauucuucagaucccuggguuuaaagaauuaaacauuuuauuuauauauacauguuagaauuggcuggaugcaugaagugcucucagaggccccaagcaguuguuggauuucuuggagcuggagucguaggcuagugggaacugaacuuggguccucuagaagagcagcagguacucagcuguugagccgucuccccagccucuugguuuauguuuguuuuguuuuucucuuuuguuacuacugagaaacuaaugcuaccaagaagucccauguguugcccaggcuaaccuggaacucaugauucuccuuuuagccuuguaaguguuaggggugcaagugugaacuaccaucuauggcggugcuugcuuguguguguuuguguguagucacaagguugacacagggucucucacugaaccugaagcucauggauaugcuuauguuagcuggccaguaaguccuguggauccuccugucucucccucuccagcacugggauucccgccgugugccucucgugccggcuuuggacgcugaugaucaaagccgguccuuacgcuuguaaggcaucuuaggcugccucagcugcccguguccuucagaaguggaagcugguuuucagagcuaacguuugguguguuacuuguuuguagagcugccaaacggagacccaaggaagcagagccagagcagguagcuccagagacucccgaggacagagacgaggaugagaggguaagugcucugccccuucucuucuugacuuuuucuuuaggaaaagauuggauguguaugagugucuugccugcguguauguuuguauaccacauuugcgcagugcccacagaagacgguguuagauggccuggaacuggcugugggggcuaggacuugaaccuuggcuccucuguaagaacagcaguguucuggcucgugauugcauuuguuucagauuugguacaaauaauguagaaggucuacucagcgugggcuguaauuuguggaagauguccugugguuuuccagcucgacugucgcuucucuggcguguuucuugcucuuguuccccuguggggauucuggagguggcgagcugagacuuuagcugagcccgggcaccgcgggcuucaccugucuguucagccgcuuauaucauucgucuuuaaguaugggggugagagccaggcccucugcuacugagccccaacaucgguccuaacucaguguuguuguucuuugcuguuggcuuuuugaaguaaggucuuucuucauaguccagguuuacccgugucccucacuggguugugaccugagccaccauaccugccucgccuaacaucuuuagugcuuuuaccuaaaacugacuggaagcugcagagggcaagaaacucggucucuccuucgcuuguuugugggaauucauuuaaaaccgcugccuguguguagccucuguuugaagcuugagcccauauuuauuuccuguugcuugaaauaacgggugucuggggacaacagaucuccauggaucauugccguugaggccacucuggucaucuagccugugcaaggcucuggauuccaucacccagcauugcaaaggggaaaaguugggcgaaagcagcugcaaucccuaaccaaagggcaagaggcaggcagaucucuugaugugaggcucucaaaguugcaaccugacucucucuucaguuagcacuggacugauucucugucaccuugcucagaggugccucuggcaagcaccuccagugagucauguauucuuuugaacuuggugauuuuaagaggucauuguuuaggagagccccacaguuagcuacuagagaggcugcuucuggcucccagaccacgcccauauuguuguggccucauguagcugugcauggcauaaggagagacugggcucugauagccuccuuuccacaaaauggcuuauuugagcuggcaguuguggcgcacgucuuuaauccuacuauuugggaggcagaggcaggccaaucucuugaguucgaggccaguguggucuauagagugaguucuaggacagacagcagcccagagaaacccuguuuccaaaacuaaaacacaaaagguacagcuuuuggaccagggccucuguugggacuuuuuuaagccuugcuuacaucccuaagugcccuggcuccuaaugugcccaugcugggggugcuugcuuggucuuuuucuguuugauuuuagagacaugguuucucuguccuggaacucgcucucuaagccaggcugaccucaaacucggauucucugucucugccucucaagugcugggauaaaggugugugccaccaccgccuggcuuuuuuuuuuuuuuuuaauauaaguauaaaaguauaaauauauauauaaauaaauugaauagggucucaccaaguaucucaggcugacuucuaacucaugguucuaggcuucugagaagugggguuagggcagacuuguccugggauuuggacauuagcauaauuugggccucauugccugaccuuaaccaccuuccuuccuggguaaguucuuaacccuaaagugcuguccaaaccaagagagguccuguuccuuuguuuaggaggagaagagacgaaaaacgacacguaaaaaacuggagucacacaccguucccguucagagcaggugaugguguuagacagucccagaaagcggggugagagauggguucgugaacugucacagcagccuuagcuucuggugggagugcagaccaggauauucggcuucugcugggcacguugguagagggucccuuagaccuccucguccugacagucaucgacgugcaugggguggcuuagggggggagagugagcgcaaggcugcugcugguguauuucaagcugaugaaauggccaacaaccuugcgcuuccuuccagaucggagagaaaagccgcucaaagcaaaagugugaucccgaagguaagugcaucugugggagccuggccggcagggaggguacagcaguuccugaugcugggggcugcccucaggccgugccuguuccuucccacagaucaacucaccaaagugccccgaguguggccagcaccuagacgacccuaaccugaaguaccagcagcacccugaggaugcugugagucccuuucugcccucacccuuuuaccccccugccaccuggugcccacgucucacuguccccuguccuucagguggaugaaccccagauguugaccagugagaaacuguccaucuacgacuccaccucgaccugguuugauacuuaugaagauucucccaugcauagguucacuuccuucagguaaucgccgugcuuggcugccugugaugauguccuacugguagaugccccuauucggggcauccauguauaaaguccuucagccuaaccacagggcucuggagaugcucacccuguaaagagccaagaggccgauuaaguucggguagacauuagccacaugagacgggguuucacuugauaggcgguugugggugaccuugccuuuugugcaguucugggaugccagaccucacguacgcuaggcgggcacuucaccggcugagucacauuuccagccccgguuuuugcuuuuguuguuuucuguuuuguuuuuccagacaggguuucucuguaauccuggcuguccuagaacucacucugcagaccaggcuggcuuugaacucccugagaucugccugccucugcuuccagggugcugggguuaaaggugugugcuaccaccuccaguccugcuuuugucuuuugaggcccagggucuuuagucuuuaacuaugucacuggacugucugucggcucccuuucaucccaaguaugccaccacacagagcaucauuuuucuuucguuuuuuuuuuuuuuuuuuuuuuuuccuuuuugaaaccaggacucacuauauagcccuggcuagaacucuugaaauugaucaggcuagacucaacuuggaucugccagccucugccuccugaguacuggcacuaaaggugugcaccacugugccuggcuacaaagucuagcuuuguuccaaugcuguuucacugugcucgagccuaggcccuucugcgcucuaggcgagugagcuccucccagcggccccacaccccccacacccccagguuuguuugccgcuuugagguuggugcggcucugagucuuuagucugugccagucugaagcccauuccugugcucacacaaggaccagcucugagcugugcagggagccaaguccacagacguagcacgcagagccuugccuuccugucacagaaaaccagugagugcucucacaugauuugguaaugcuugcaacccaaaagcacuuuggauuugcauuguuuugcaguaucuguguguaucucgcaagguauccugggacccacaucuagagaugagacucccuagggcucggguucaccaccugcuguggacccagcaguccgggccaggcuagcucugaguuuuugguuguccucuuaccuccuuucaagugcuggaguuccaggcaugcccgccaucuauagcucagacaguaucuccuuagugcacuagcgguuugccuugacuuuguuuggaaggcucggaauggcaauucccgugugcuguagacuuucaugcucaaugugggauuguggagguuggguuaguaaucgucaggcuaacagcuccaggcagugaagagagccugacuggcagagaaauggcagaagcaaaguugcagucggaauggaggcuugccaugaagaaaggcuuugugaaggccaguggggcacagagugggccgaggcccucggcugugcuuggugugccugaaggcuugggcugggccugaucugaccgggcugcaguaaaugcagaggcuauagcggcugguggagaggcaggccuagguugugaccaggcugggacacacgaguccugggcugugugguggaaggacgcccucaggaagcaccauuggcacugcagcaggcaucauuccugggcugaacccaccgugggcuggaaugccuagggccauuuguguccagaucccugaguguggcuguggcuguccucccuaccagguggcuggucacuguuaucucuucccugcugcuggaacacugauucccauagaggauacuguccgccaguaaucuagagggcuaggccuuaauaagcaggagaccucugaggggcccguugaagccugcccugugauggcagucaggaguggugucucuguggcagccucgggguugaggccaggcuuccaucagugaguuauucagccaccuuccugguaggggaaggucugagggcacacagcccuugugcuagaagcugggcgccauaagggacuccguguuaacugagugacuaguagaaacaaaccuugggcaggaucaggccgggcacuacaauguucuuuuuagucuggagaguaaauucggguucgguuccugauaccuauguaggagcccucugaccuuggugugugugcuuguagugcaggggagggagcgagaguccgggugggugaagggcggucuuggcucucaguguuggguuuggugguaaagugauguuuguugccuauucaguguguacugcagucgcgggcaccuguguccugucgacaccggucucauugagaagaauguagagcucuacuuuucugggugugccaaagcaauucaugacgagaauccaucuauggaagguaugugaagugcucaaacaaggguugucccaagaagcaagcacaucuaggaggcgagauaucccuccuaugggagguacugcuucaagaaagagcuugaaguucugccauuaaccgacaaaaugacuuuggaaaggcagccugcuggcugggucgcuggcggggauaugaguugugagucaccauguuuuuagucuuguuucuuauagaaagacaucuuuucuacaggugguauuaauggcaaaaaccucgggccaaucaaucagugguggcucaguggcuuugaugguggcgagaaggugcucauuggcuucuccacuggugagugucugcaggcacagcauccuggaaccacccgccugccugccugggcuugcugggcucugggcagagguuuccucgggccuggggaaucugguggcuaguguugaucauaacuggccuggaagcggguccuccacacguaggacagucaaaugcuuacaauuugaauggguccaaaacuuagcuaaguucccuuuuuuucuggcccaagugguucuagcuaauggagaaguugggcuguugagguuugguugugggcuuuuugguuuuuuuuuuuuuuagguuguaggauaaauuuuagacuggaugcugggaggauucauacuugcccuguguucagccuggaggccaucagcuuugagauggccuuaaguuucuuucucuacacuucccugugaauguuguguacuguaccaugcauguggggucauauaggacaacuuguaguugauucucuuccucuaccaugucagucccuaggcucaaacucaggucgucaagcuuacaaauuagugcccuuacuggugagccaucucauuggccuugaaacggcuuuuucaaaugucuuaccugcuggacaaagcagguaccgguuguccuagcuauucaggagguuugaggaauucagggccagccugggcaacgugaccagagcccauuacucaaaccaagcagcugucugcauaaacgacagggguuggagguggaaaugcuggucagccuaacuggacugaucauuccuccacauucuugaaaaacacgaguccugcuuucuuccuagcauuugcugaauacauuuugauggagcccagcaaagaguaugagccaauauuugggcugaugcaggagaaaauuuacaucagcaagauuguuguugaguuccugcaaaacaauccugaugcuguauaugaagaccugaucaauaagauugaggugcgagcuuugccuucccuuuggguuuggauccacauagaagaauggguacaaucuucugcuaccacuagaagagcuuugauauagaugaauggagcaggccuuagggcauggcacaguuguagaaccccugccuagaacuccccagcgaggggcucagguacacugcggcuuagugguacauugcuugccuagcaugcgugaaguacuaggcucuuccucccccaguauuacaaggaagcaaaauauucaaaacaucugaucuucuuuucuucccuuuaaagaccacuguuccuccuucuaccauuaaugugaaccgguucacagaggacucccucuuacgccacgcccaguuuguagugagccagguagagaguuacgacgaagccaaggacgaugaugagacccccaucuucuugucucccuguaugagagcccugauccauuuggcuggugucucccugggacagagguaaggauguagcaagaaucagauuggaggcuugagaccagaggaggcaaucuccuguguuugguucucugaaacgguggccaucucccucaggcgagcaacaaggcgcgucaugggugcuaccaaggagaaggacaaagcacccacgaaagccaccaccaccaagcuggucuaucagaucuuugacacuuucuucucagagcagauugagaaguaugauaaggaggacaaggagaaugccaugaagcgccgccgcuguggugucugugaggugagccggcuauccuuggcaccccuuccuuagaugugaaggagagcacuccaugcuuugggguagccuccugacccucucuguccaucugggguugaagucggaguguccaagaccuuuggucuugcugaugcuaggcuacagauccuggguuuccugagagaugcuagcuccgccucuauuuccuguggguguugagagagcagacgcugaccccaggagccaaagcuguccccuccacccccacccccgggcacauuuccugggauucuaucuagaacugaaagugcacauuucucucaguuuagacuuauggcugcagaagccucuugcuuugaccuccaagagcuggccuuacagaccugugccaccgugccuggcucuugugaauuauaaauccuuuucauauagauagccuuggaaucaaccuacauuacacuaaacaagcaaacacaaacuucaaauaaugugguaaagcuacacauggaggcgccggccugugauccuggcccaggcugagaaguggaggcaggaggaucgggacugcagggucaugcucaguuuaucgugaguuugaggucagccugggcugaauuuauccuaaaccauagccuacacgugcauguguguucugaggcgcuucuguguccagggcugacugaaacuccucgugugcacuggguauccagguaugcacugccguggccagaccugugacgucaguguguccugccugacagcagcuugcagggcucgccuuggcccaggcuguacagggacuuggguauccuguggcuuugaaugggugaggagacuccugcgugugcuguucugagcauccagggggcagcuggggguuuauuuucuucagagaaagucaccuuuugcaauuuaguguuuugacuuucccuggguagagccuggcugguuuccacacaccacaguagcauguccucuacucucuuggcagcccucgugaggaugcccuguccucgcugugccucgacuuugcucacuguccuuguaucugguguuuguuuuaaaggugccccuuuuuuggcaguggugugggagugugguugcaguggugguggguuuuuuuaggugaagucggguacuugaugguccuguuugguuaccuuauucucaugguucguuuuuguuaggggcuguccccacugacugguggggacucugguagcucugugacacucaacagagcugcuugugagcuucuaaggugccgucagcacccuguucaccuccggauucucagaugcacacgccccuucugcacguguccucugugagcagccggauggccugguaccuaauacagguuaaggccauguguggcugccacacuauugcucaggggaagggucaacacacucuguucagcacaaggccaguauguuuucagaguuucauuagagagcugucugcaugggccacagugcauaugaaggucaggaggaacucuguagaguuggguuucugccuuccugugggccuuggguauugaacuuggguuauaaggcuuggcaccaagugccuuuacccacuggcccaacaugcagauuuuugaaaguuauaauuaaaaauuccugggccugggugugguggcacacaccucuaaucccagcauucagcugcagaggcaggaguaucugaguucaaggccagccuggucuacauaguugcaugacagccagaguuuuguagagagagaccgucuccaaaacaaaaacaaaaaggccaaacaaaguuucuaguugagaauugcugauugaucgacuuguuugcuauuuuucaggucugucagcagccugagugugggaagugcaaggcgugcaaagauauggugaaguuugguggcacuggacggaguaagcaggcuugccucaagaggagguaggcugugcuguauucuacucggauaacagagcagccagggugccagggcgugcugcagggacgggguguggagcugacaugcgcuuugcugggguugacugcaguguguguucugcagguguccuaacuuggcggugaaggaggcagacgacgaugaagaggcugaugaugaugugucagagaugccaucacccaaaaagcugcaucaggggaagaagaagaagcagaacaaggaccgcaucuccuggcuugggcagccuaugaaggugaggccccuuccucuucaugcuucuucucuucgcgccucugagcccagccgugcagccaggaaccugcuggcagccucccgagagaggaggacugucguccagcugcuguccccuuucccucccucguuccugauacugggaguggaaugcaaggccccagacugcuggacuagagcucugcaccugagcugugccucacuccucaugguggacccugagccgaggcugcagcacagguagcccauccgcuugugcccuuuguggugcuccauugccaccucucaggcgcuaagccgcgugcugcccugucagacucuguuuuguugcuauaaaaaccaagccugauggugguggcacacagccuuuaaucucagcacgcgggaggcagaggcaggcauggcaggcauagcuugaguucugggcuacccugguuuacacagcauauuccaagacagcaguuccaagaauggggaaaggucagaagccuuguggguuugguuugguuuggagaugggaucuuacuguauaaguuagaacuucuauuuucauuaguuuuuuuagauugauuuaucacauguagauggcugggguuagaagaagauauggaaucaucuagaccugcaguuaagguugguucugagccacugugggugccgggacccgaauccagguucccuguaagagcagugagugcucuuuguggaguugcuuucuuuuuagccuuuccaaagugaggauuacaggcaugcgcuaccaaucucagcggcucaugccuuuugagucaagguuuuuuacuguguagcucuggcuggccuggaacucaaugcagccugccucugccuccagagugcuggaauuaaagaugugugccaugacaccuggcuuuuuuucuuaauuugauuacauuuacucauggaugccgcagcacggugugucaggacaggucguguaagucgccaaucuccaucucccauguuggucccagagaucaaccuuuggucaucugccuuggaagcgagcuucuuuguuuauccacugagccaucccauccuccaugacuuaguaaaucaaaaguugugguugguugguuugucuguuuguuuauuaaggguugcuagggauggagcccagagccugguaucucuuaaguacacuuugcacugcugacccacacacccuuagucccaaguaauuuucauaggaagucagggagagccgccacccagguuaaaucuagugagagccuuggaugugacuaucaccugggcuccaucgcuugcuuucagauugaagagaauagaacuuacuaucagaaggugagcaucgaugaggagaugcuagaggugggcgacugcgucucggucauuccagaugauuccuccaaaccacucuaucuagccagguaugcaugccugccuuuucucuugaacaccucaaguccaacuuugucagaacagaccccagguucugcugguuacaugagacauuucuuccccguccugucuuaugacugcagggucacagcucugugggaagacaaaaauggucagaugauguuccaugcgcacugguucugcgcugggacagacacaguccugggagccaccuccgacccccuggaacuguuccuggugggcgagugcgaaaacaugcagcuuuccuacauccacagcaaggucaaggucaucuacaaagccccuucugaaaacugggccauggaggugaguuccuccuuucgucccuauguucugucccaccguuagagccgaggcugacacgagucugucuccauagggaggcacagacccugagaccacacugccuggggcugaggauggcaagacuuacuucuuccagcucugguacaaccaggaguacgcaagguuugaauccccacccaagacccagccgaccgaggacaacaagcacaagugagugugggagccaauagcaggccuccccgugcccacccugcucuguggcgucaagaaaguuuuacuucccaguugugcucuuugcugaccaaagaggccuaacauauggaaauguuuaaaauguauggaccgguuggagguuaccuugagcaagguguggccuucuguuuaaaaauccucauuuguggugcugcguuguagcccugggccuuggacacgcuggcagaacacaccucugcuguucacagccucggccuuguuucuaguauugauuucuaucuuugagcugugguccccaagagcugucuacaaagugcagacauaaagaaggggggcaauuauccagauaccugcagauguucuuggguuucaguggcugcuccugccacuucagagccucgagcuuuucugcucuugccuuggcuucugcagguucugccuaucuuguauccggcuggcugagcugagacaaaaagaaaugcccaagguccuggaacaaauugaggagguggauggccgggucuacugcaguuccaucaccaagaaugguguugucuaccgacugggugacaguguguaccuuccucccgaggccuuuacuuucaagugagugucccaugucccauaccagucagcuggcuuugugauaucccagcugauccuauaagccaguguuagaccaucauucugguuucuagugagaagccaauaaccuaaugacugcauuucaguuucagagcuauuagcuauauuacuauagcaaaguaccugauguagcugaguuguaauauggaagccauauucuggcucauuuuggaaguuccagcacaagccugagggugacagagcucgugucaucugguuagggagugaaggagagaagagguucuguugccacugucgcagccccuugagggcaacagagggcguaucuccagggacauuccuagccuuguaaaugcucauggcuugcuaauagugcagcccuggggaccuuuagcacacugccucgggagccuucuuucugcaucugagcugugagugucgugagccugggugagacccaccaugcuggacagucuguuccucccucagcucagccucucagcagccgggaggccucaggcuuggguuucucccugcagucuuuuuccugaagcugauggggucuugucugccaggacucgaagccuguugaagaugcagugcucuacccacggucuggcaaaugagaucuuuuacuguggacaggauaccucagacuccacguguuggauguugggacaucaucaccuucacucuccauccacuuuguccucaacacuagcaaaaguuggaauugccguuuguguuuaccaaacuauaccucaggaucuagacuugaggacccauuuuccucgugcccagugggaccuuaacccccaaauucagcuuagucguuugacccauggaacugaggcauuggguggggccucugugcuacugguguuagguguuuuaccagucuaguacugcuugucuuuggugcccucuauagguugcccccuguaaaguuccgugccagguagaggcacagcauggaggucacacacaguucucagaggggccucugggacuagagcagacuguagagcccagauaagaaagucaaggcaacugcuacccagagugggcagccagcuuugucauaaguuagaccaaguucaggcuuucucaggguccauccuucaccaucacauuuacagccuuacaucuguucuccauaguccaggaagugaaagucguguccaagcggaaagcauccacacccaccugagcucugggaauuggguggcaugagauuuuuuuugcguuaucuuuccuugacgguacuuggaugugacgaggaaucggcucacuccaaccaaucaucuaggcucuagccccaagcucaguuguacccuuuacuauuccucucugcagcaucaaaguggcuagccccgugaaacgcccaaagaaggauccugugaacgagacccuguacccugagcacuaccgcaaguauucugacuacaucaaggggagcaaccuggaugcuccagagcccuaucgcaucggucggauaaaagagauccacuguggcaagaagaaaggcaaggucaacgaggcagacaucaagcugaggcucuacaaguucuacaggugggcgugggcucugccugcccagaggccuuccaggaggcucugcugguggggguggcugcuucugguuauccugagggcacgaguguguuugcagagcuggagcuuuucaggcauuccuaguuguagaccaguggggaaccuaugucugacaaggaccaagagcuggugucaaugacuguguccugauuugucuggguccuccuucccaaaccacagucccuuucucugcucuugcaucgcccucccugagccugcucugcaccuuccuugcugguucuggaguuuguuuuccaguccuuggcuugacucaacacuccccuacacacacacacacacacacacacacuccccuacgcacgcacgcacacgcgcgcucacacacacacacacacacacacacacacacaucuuauaccuuugugcauuugugggugcuuucugcuucuuugauugugaauggguguuaacugguugacaaaggcaguucgaucccuaggguuugaggcuagcuuggucuacauagugaguucaaggauagccagagcuacagagaaacaaaacagaacuggguuucauucuggaguucaggcuccccuaaaacauacucugugguccacuccugccuuaauacuauauugauccuccugccucagcccucacugucuuucccuuguaaaaauccuguagcuggaagugaugaggggcuucugugaaagaaaacuaccagguagaccagccagcacagcuggaacgugagaccagccagcacagcuggaaccugagauccuugucugugcaucccaaggguuggauagcaggcaccugcuacuacaccugauuuuccuagagucuuuguaauaaugggugugguaaacaaaagagcagggcacccagcauugaugggugggaugaaggcagagaguacaccagucccugguggugcccaggaauccuauuccugcugugguauuggggccaaguaaggguugguggccaccaagcugacuggacugggauguggucuuuucuauggugcaguuugguugagcauccucaaaccaaaauacugaaaauucuacaacugaucucuucuuacaggcugccacagguguacuuaaugcuacguagagaccagagagauggcucagugcuuaagauuugauguuuguuuucuagcacccagauagaugguggccacggucaucuguaacuccaaauuccacaggaccugcugccauucucugcccuccgugggcauuguacacaccuguagccauacauacacggacggaaauuacccauucacacuaaauaaaaaugaauaaauaguuuuuaaaugcugccugaagugaccugggugacggggaugguagcugaugucugugauccugguaguugaagugcuguggcaggaggaucacugaguuggaggucggcuugggcagcagagcaagacacucucaacaaauaaaaggccuugaagcuguggugugagguguacaagacuaauaagauuccuguucucagacucggcucucaguugcugguccaggcauuucagaggagggugcucggccggggauuauaaaucugugguaaaguaguauuccccugguauccuccucacaggccugagaauacccacagguccuacaacggauccuaucacacugacaucaacaugcuuuacuggagcgacgaggaagcuguggugaacuucagcgacgugcagggccgcuguaccguggaguacggggaagaccuacuugagagcauccaggauuauucacaagggggcccugaccgcuucuacuuccucgagguggagccaagcuucaggggcaaaugugcaggagcagggugcccaagacaguggcucgggcuggggcagggcucagugagacagggccuuuguucagcagacgcuaggcuaauccugggugugucuuucgacaggagaagcuaaggaggcagcuaauucauguguagaucuguuuuuuauuuuguuuuuuuuuagugaauuuuuaaaaaaauuuuuauuuucaugagaauuaauugguauuuugcccacaugauauaugucugugugauggcaucagauccuugaaacuggaguucaagacaauugugagcuaccgugugggugcuaggaauugauccuggguccuuagagagagcagcugcuaccucaucuccccagagcugucuguuuggucuuuugagauagggucucacuguauagcccuagaguucuguaugcagauuagguugaccuugaacugacagaaauucuccugucuccuccaagugcuggaauuaagacuuguacucacaagucuuaauuccagcaccucccccaccuccaauugagucuuaggugugggauuuuggcuuuuaaaggaaagagugcagcuggggauauggcuugaucuguagaguuccugccuagcacacaugaagcccugggcuggguucccacacggcauaaacuggccgugaugcccagcgagcgggcgguggaggcgguguugggcauugacacagagagagguaguggcuagcaggccaauuguuaacauguaagguguuggggcugagcugcacauccuugcucacugcacguccgugcgcacaggucugauuucaggugcucugcaaagucaacacucgcuuuuuaagaguaguaauggagaaugcaacauuuuauugucuuaacagcauuaaaauuuauccgagacuguuuuuguaggcgucuaauaaccaugccuaggguuuugauauguauugagagcgucccccuucuuggaggaguacauuucagucccguguugguuguauguagucagcuucucuguagcguggacuggccucaaauucauacuugugccucagcaccucuuccagcugacuguagguuuugucuguuuccauuggugagaucaaauuccauugguggcuaauuggcuguggcugaacuccgauuaagagacugucggucagcucuuaaacagugugaggggauccaugcauuucuucucuacuaacguggcuucucucugcaggccuacaauucaaagaccaagaacuuugaagacccaccaaaccaugcccgcagcccugggaacaaagggaaagggaaggggaaagguguguccuugucccaucugucaguccuccugaguaugguucugagagagaaagcgugugccgucuaggcagcacugaagcccagaaacuucugccuccaccugccaaauucuggggucauagacgccagcgcuuggguggcugagucgggagggucucccaaaaggcggcucuaggucacauagcauggcagagaaagaucucccgaguaggccugaggagagcacucugcuggcucuccucauuaacuguuccuccuccagggaaggggaaggggaagcaucaggugucagagcccaaagagccugaggcagccaucaaacugcccaagcuccggacccuggauguguuuuccggcuguggaggguuaucggaaggauuccaccaagcagguaagcaggagcuggugcugacucuggccuggcuuuaggguggcuuucaggcauggccggccggccggccaagguggcugucaaguggugcgaugcauguuugagcaaauagaauugauuaaaauagauuuaaaauggcacucgucuggcuuugugucuaccaggcaucucggaaacgcugugggccaucgagaugugggacccggcagcccaggcauuucggcugaacaaccccggcaccacaguguucacagaggacugcaacgugcuucuuaagcuggucauggcuggggaggugaccaacucucugggccaaaggcugccacagaagggcgauguggagaugcuguguggugggccacccugccagggcuucaguggcaugaaccgcuucaacucccgcacuuacuccaaguucaaaaacucccuaguggucuccuuccucagguaagcauggaccacagcccucugccauuugcuguggaggggcugacucccagucuagauucagguuugugggagcaaccccaacgccgcucccaugggagcugcccaugcccuguuaccgguugccugggcauggagggguuugcaaugacugugucccuccugccccuacagcuacugugacuacuaccggccucgguucuuccuucuggagaacgucaggaacuucguguccuacagacgcuccauggugcugaagcucacacugcgcugccugguccgcaugggcuaccagugcaccuuuggugugcuccaggugggcaccacgcgggcagagggacagaaauggccucucgugggacagucccuggccugcuguggacaacagagggcaacagaggucugcaugaccaccacugaggcucagcucagacagaaaaagcauagggcuagccaggaaccuuuaaucccagcacuagggaggcagguaggcaagucugaguuugaggcuugucuggucuacagagaguucuaggacaaccagagcuacacggagaaagccugucuugaaaaagacaguaaagagcauggggugacgaggugcgguggcacaggccugucuuuucaaguccuggaaggcuggaguaggauccauggauugaaggccagcaucucaggauucagaguuggccauagcucagugugauacauccacuagcagcacauuuccuugguccugucccuggcacccaaaguuaaucggguagcugggaccaaguugguagagcacuuguuuaaucuucaggaagccuggguuccauucuuaccaccacacagacgugguugcacacgcuaaucaucccaacaaauaaaaaggggggguguagguagcaucagcacuugauuugccuacauagcaaguuugugccuggucagcagcuauggucuuccaugacugucggggagggagggcugggauugccagcagcggaguagauguaaggucaauaaaacacagggugagaaguggcccagcagaaccggguuuauccagagcaaacccaggacaggagcgcuccuguuggucgccgaggucuugccauccacuuacagaugcaggaguuacuaaagacauggugauggguuagcauuccugguggucagcccuuaacugagcuugacacaauuggcaauggcaggagccuacgcagacaagugauuuuaguaguuacuguagucuuggggguugucuccacuuaaccaaaauggggguuuugcaaaugguguggccauggcuaacuggggcaagcuguugugucauuuggugaguugcagauauguguugccgcuuuccaguucagcucuccgagaagaggccagcugggcagacacucuaccuaaagccaccucucuuccucuggugcaggcuggacaguauggcguggcccagacacgaaggagggccaucaucuuggcugcagccccaggagaaaagcugccucuguucccagagccucugcauguguuugcgccccgugccugccagcugagcguugugguggaugacaagaaguuuguuagcaacauaacgagguaggaacugugcuccgcccccauguguggcacgguggcugggaugcugccaagcucuguguguucuguagaguggcagugggucauguugccuggcucacugaggagaucugcgccagagccuggcuggaaggucugcaccauuccaccucaagccugcacacaaggcagaaccugagcagagcccauaccacagcugccccucccucacuuccuaaguuccagcagaggccaccugccugacaucuaauagagcaccucugcugcaggcugagcucggggcccuuccgaaccaucaccgugcgagacaccaugucugaccuccccgagauccagaauggagccucgaauucugagauccccuacaauggagagccacuguccugguuccagaggcagcugcgaggaucacacuaccagcccauccucagggaccauaucugcaagguagcugcccugcggccgugccgugccgugccggugccuggcccagcuucuuuccugagcuugcuugcacuuccacgggccucaaggcucaacaucucugaucuacccgcaugcugucaucuuugaauacucccuggaugacauccaauguccccacaacacacccucucuuaauagcguuucuguaugggcuucucauacaucagaccucacguugugugugcuccccuccuuguccugugcauuuaucucagcugucccuccauagguguccucggucacauguucuuacgugaccaucucucagcuaggguugugugguugucucuuccugacaagaucugagccucuaggugcccuucugugcuuccagaaccggguuucagcugggcuucucuuuguucuaggacaugagcccacugguggcugcccgcaugcggcacaucccacuguucccaggaucagauuggcgugaccugcccaacauacaggugcggcugggagauggcgucauagcccauaagcuacaguacaccuuucaugaugugaaaaauggcuacagcagcaccggugcccugcguggagucuguuccugugcagaaggugggaccccaagcuuuagucccccccuuccacuuggucuucccgaaaaacaagagucucccuuauggcagcccuuugugagggcuggcuguucaguggggcuuccugggguuuuguagccguccccauucaacucaucuacgugauaagccagaggccuggccacaccuccgugcuaauuaaauggcugcauggugugagguuacaacagcguaggggggcccaaaucaaacacccguaagagcucccuuuggaagccccucugcagagaugagagaugagaugccucagucucuggcagcagccuuguccauagcucaguguuccauugcaacaggcaaggccugcgacccugaguccaggcaauucagcacccucauccccuggugccugccgcacacugggaaccggcacaaccacugggcuggccucuacgggcgucuggagugggauggcuucuucagcaccacugucaccaacccugagcccaugggcaagcagggucgggugcuccacccggagcagcaccgggucgugaguguucgggaaugugcccgcucccagggcuuuccagauagcuaccgguucuucggcaacauccuggacagacaccggcaggucaguucaucaccagagcuuaucaucgaguggccucagcucucacauugggggugggggccaccgcuuucgagucagguuguguaacagaguaugggucagcaacaacaacacuggcccaaaugugcccuuucuacacuggcuauuccugguugggaauugcuguugagaaaaaggcccgugccagaaacaucgaccugaccugggcuccaugcagaccauucccauguuccagacccuuggcuccuaaugggacucacauuggcucuggguggguccagauuuugcuuccagacuuuccuaaagcuuuuaaaaaguucacuguuagccaggugugguagugcaugccuuuaguccuagcacuggggaggcaagcagguggcucuaaaacuaccuguuagugaccugaggguguguggacaucacaacaagggcuguaccacaaagcccaggccacuggucaugguccggccacuggugagccugguguuacguccuuccuucccgcagguggguaaugcugugccaccaccccuggccaaagccauuggccuggagauuaagcucugccugcuguccagugcucgggagagcgcaucagguacgugccccguuccucgugggcagcucucgucccuggggccugugugugccaaguccauacaagguuagaggaguagggccagggcagauggcacaggugugagcuucuguugacuggucaguccaagucagcaggcaccgaucucaagggcuaccccagcaccuacgugcagaaacauccgggagcuaugucucaguccugaauguuuccagcggugugcaugugcucaagaccagccgugagcgagcgccugcugccgcgagcgccugcugcccuguucucaagugacuuuuccuuucuccucagcugcaguuaaagcaaaagaggaggcugcuaccaaggacuagugcucucacccagagccccacgugcacugauguuuuuaacccuuugagccccaucauuugaagucuugugcucagugucuguggccauggcugacacuaagcuguuuguaugagguuuguuuugugaccaagcuguguaguacuuugugcauucugaauuuuaagguuuuuuuuuuuguuugguuugguuugguuugguuuuuuucuuauccuguauucuaucagaucugccacugugcagguggcaagugagacuugauguaguuuuauauguuguaauauuucuucaaaauaaagcgcuucugucaagcacccagcuagugauugaguucucuggcagcgucccccagcggaggggggaggggcucgugcuuuacgguguccguggaccagccacuacauccaccucggugggauacuuuucugugauucaguucugcccagugaaaggcaaauggaacuuucuaguagguuuucccagaaagccucuucggauggucuuggcuaaucuccacggacacuuugcccuuuuuguuuuggaguugaccuuuuauugugugucugguaauaaagcagccauccugcgaucauucgugaugacauaagacccggaucauggagcaagaagagaccaugacuaagccgcccucagaacuccugucucugcccugugugcagaacuccaguuggcuuaagaccuagaagagacuccuggguccuggauuauggcucagcacauaccuuuuugauauauuguguaaccauguuugacccuuauguucacuguguagcucaggcuggacuacaaguuguggcaauccuccuccuucuaagggcuacuguacuggacuaaauauagcaguaauuuuuuu

SEQ ID NO: 4944 - RNA, 2393 nt, Mus musculus
ugagaagcccuaaguguagcccaggcuagccuuaaacauguagcagaggauaaccuugaauuccugauccucuuuccuccaccugggcuuugugcuuguuaaucaggcacucuacugagcuccagacccagaaagauugauuuuuuguuuguuuguuuuguuuuuuuugggacaggguuucucuguauagcccuggcuguccuggaacucacuuuguagaccaggcuggccucgaacucagaaauccgccugccucugccucugccucuggagugcugggauuaaaggcgugugccaccacgcccggcuaagauuaauuuuuuuuaauuacuguguuagauuaauuuuauuuuauauguguauuuuauacacuuaacacuuagugugcuuguguguguguguguguguguguguguguguguguguguguguguguguacuacaugcaugcuggcugcuuggcaugggugcugggaacuuaauuucaguccucugcaauagcaggauauacacucaaccacugagccaccucuccagccauaagacuguguguguguccagaagaaaacaucagaucgcuagagcuggaguuacagaugguugugagcugccaugagggugaugggaauugaaccuguguucucugcaagagcacuugcucugaacugcugacccauccaucucuccagcccccaguuuaugguucuugaagaaaucaugucuuguggaacugaccuuaaacucauccagucagucucuggucuuguuccaguguacucuucaguacacuuccaggcugcugcuguaugcugcuggcuucucuguugaaggaguuauguucugcucauugaugcuccacugaggaucaaagcaggauuuuccaauauucagcucuuggaccgauuggugcgcucaacacagaaggugccgcuuuaaacagucaaacuaaagacugcauaugggaccuuagggcaauggagucucaaacaggugaaaugaggaccaaagacucucagugacaccacuagaaaaauccacucugagggauuucccagauucccuugaggucacucugaaacuccaucauaguuguccugggguagagauugagugcccgcuccccagacaccccccccccccaaucaaaacauccccguggaaauuccuuaggaauaaccaggcuucaggcuuggguguggaguggccugggagcugugggcucuggaggaagagcacacgugcaucucgaccucucccuuccgcaucugcagcacgaccuccuggcccagggcuggucuccacagcaacuguauaggcgucuuaaaacaggaagccucgggcguccaaaggccaguaagcaagccacugggucuuggaagacuaggguuugauaucucucuuuguccaaucucauuguucaaggucugccucaguuucacugcgaaaagcaagagcaguggagcacgaggcaggaucgggaguucaaggucauccucaacuacagggcguuugaggucacccugagcuacuugacaccugaccucaagaagagacagcagggggagagaugagagggggaaggggagaaacuagcacggggcggggccagaggauggaggaagugggggaaaggagugagaaggagaggaaacccccccauaaggcgcgcuggggagugggggaucucugcuuucugagaggugccucuccucuucggaguucuguuucucauccagucuaagaaagggaggugcagggcuccacgccacaggaccagacaucuuccuuccuuuugggggagcugucaagacgccccagaagucaaagcagaaaaggggaaccgaggccgcgggggcgggagcagucgugagugggagaagggaagugaggacugccucucaggcaggacuuucucacagcggaucuguccgggccugcuuggaucgcugcuucaucucuagugccaaguggguggagcaugguccuggggagaggggcaccucugaauggauggcguccccuaacgauuccagggagcccuuauccccggcaagggcaugucugguggguuaaagaggcuugcaguaguuggggaaaucaggacuugauuucggaucccugcgaaaugccgagccucaguuuaucccuuugaggggauggcgguccugaugucgcaggggacuaggcaguagucaaucaguuaaccaggaggcgugacuccuggaggcccggggccuucucuccggacucaccugcuggucucugacaccaccuccccccacaugucauuacuucaguuuggaaauuccuagaucgcaggggccagcgaggcaggaccaccccucucugccagggcacagucuccacccggaaauaccgaagcccucguuccg

SEQ ID NO: 4945 - RNA, 12877 nt, Mus musculus
cgugagccagagacuauaaaagcgccgcccgccucagucugcacccagugcuagugcugagcuccgcugcuaccugcacuuugcccuggcccugcaauggcuucaacccgugccaagcccacgcuaccucugcuccuggcccuggucaccguugugaucccuggugaguccgagguggggucgcuuuggggggcaggucuccaaacuccaggacccagagcgcggucgaaaucccugcuucccggccagcggaacaucacauaaauucagcuguuaacgggaagugggauuggaaacccaggguugaaaacuaacagcccggaguucgaaucccacguagcaucacuccauggguggguuacagaacccaaaaucucggucucucucucucucucucucucucucucucucucccucccagucccucccucccucccccucucucuguccucucucucucccccugucccccucuuccccucccuuccuuucuuuccuguuuugagaaugaugccuugacacguuagccuaggcuggccuugaacucaguccucaaggccucgcggcucuucggguuacaggcucaaaacacacuacucuccuaaaacaugcacguuuagaaccugggcucauggucugugcaaugggaacuguggucacaguccuugucauggggcagucagaauauggcugagguggggaacagauggucugaggggcuggcccguccuaaagugaaucuugagguccgguucccucccccacagacacccguuccucauccucaccccuggggaaguccaggcugcuucugcgcuggggaauuccaggguugguguacccuggagccagagugagccggcucaggacuccccaccuugcugcugccugggggcggcgccugccguccucccaagagaggaagauucagaacuuguucagcagcuaucaggaggcucccgacuuggauucccgcaauccauaacuccuagcuggaugacuucuucuugccucaggguucuccaaggagcccgaauaauuccagaaguauugaggagaguugcuagcuguuauagcuguuauuaccuccaccagaccaccaaucauagcacugggaucuuugcgugugugggggggugaggguggagagaugggggaggggaaagcugaguucaguuuuuuguuguuguuguuauugguuuuucuuguuuuuuuguuuuuuuugguuggucuuguuuuuuugagacaggauuucucuguguagcccuggcuguccuacaacuugcucuguagaccagguuggccugggacugagaccugucugccucugccgccccaaugguuccaucccccacccccauucguuguuuacuuuaguuaagugguuacacuuuauuuacuuauuguacaggcaugugcuagugccacagcagaauuguggcgcucagaaggcagcuugcaggaccacuuccuuccuccucccucugcaggggcuccgggggcugagggcagguggucaggcuugcuggcaagcccuuuacuggcucagccucuuguuggcuccuuuuuugauguuuucacauagaaaccauguuggccaggcuguguacuccaggccaggcuaacuccugaucuuccuacucagccucccaagggcuugguuuacaguccugcgccuucacacccagcugcggacaggccucaagucuuugcauaaguuagugaaugcucugcuucugggcccccucccacccccaggacugagggauaaccucagccacccaaggaacaaagcagugucuuacuguguagcuaaagcucacuguauagaucaggcuagccucaaacucacgagucuccugccuccugagugcuggaauuaauggugugugccaccacauuuggcacuggggacaccgugacccagaggaucuucuuauuucacucucuuccucuucgugcugagcauccagccccugccaugcuccuucuucugucugaaauuggcuucuucuucuucuucuucuucuucuucuucuucuucuucuucuucuucuucuucuucuucuuccucuuccucuuccucuuccucuuccucuuccuccuccuccuccuccuccuccuccuccuccuccuccuccuccuccuccuccuccuccuccuccuccuccuccuccucuucuucuucuucuucuucuucuucuucuucuucuucuuccuucucuucuuuuucuucuucuucuuccuucucuucuuuuucuucuuccuauuuggccagagccaucucacccuccagaccucugcucaaaucugucaccaaggaguuauguccuguucuguucugcuuaagccaaaaaaaaaaaaaaaccucuuauuaacaaccacuauggagucuggcgugguggcacaggccuuuagucccagcacuugggaggcagagagagguaaggcauaucuuuuugugaggccagccuggucuacagagugaguucuggggcagccaggguuacauaaugaaauccuaccucaaaaaaaaaaaaaaaucaaacaagcuaaaaaaggaaaaacaaaauaacaacaacccauccaccacugaggcugggcuggugcugggccacgagggcagagcgcuuuccuagcaggucugaagaccugggcuccuguauccaaggcuguccuuacacuccauuuguaaccaaggaccuuacucaaccccugaucccccugagugcuggaguuacaggcgugugccaccacacccaguuucugggugcugagaggaaggagcucaggcaugcuaggcagucagcccagccccuccacacucauaauuuguugccuugugugcugggcacaauggccuccugcauggggugcagaauucugccuggcuggaggcugugaggccagcaccuggcccugaagucacagggauaaccaaacuuccucucaucucucccccccucccuuguuguuccagggccuggugaugcucagguauccauccaucccagagaagccuuccugccccaggguggguccgugcaggugaacuguucuuccucaugcaaggaggaccucagccugggcuuggagacucaguggcugaaagaugagcucgagaguggacccaacuggaagcuguuugagcugagcgagaucggggaggacagcaguccgcugugcuuugagaacuguggcaccgugcagucguccgcuuccgcuaccaucaccguguauugugaguggcagggccagggccugggagcagggagacucacugggcacaugacagccuugaaaagucccacagucacuuagagaucucuuuaaacaucugccagcagagugugccauaggaauuuagaacauucuagaaugccaccauuggaugccuggauuguucuguguuguuuuguuuaauuguacucuaugacuaauugugucuaauguuuuagguuuuuaaaaauaaucaauuuuuagccaggcaugguggcguacaccuuuaaucccagcacucgggaggcagaggcaggaggauuucugaguucgaggccagccuggucuacaaagugaguuccaggacagccagggcuacacagagaaacccugucuuaaaaaaaccaaaaaaagaaaaaaagucaauuuuuuauuuuaugugcauuagugguuuaccuccauguaugucugugugaggguaucagaugcccuggaacuggaguuacaaacaguugggagcugccaucugcgugcugguaauugaacuuggauccucuggaagagcagccagugcucuugacugcugaaccaucucuccagccccagucauuuaauuguuuguuugaagacagggucucacguagccaggcuggccuuggacucacacugcagagcugaggauggcuuugaacugaugaacuuccuggugcugggauuauaggcugauaccccauaccuggcuuaccuggucuuggggauugaagcaaggacuuagugauuucaaggcaaggacucugccacugagcuguagacccagccucugaccuagauccgacccuuaaaaacaccugcaaccccaggacucaagaguggaaagaacaaggaucuuagaaguucacagucguccuuggauaccuuauuugggacagauagccuugccuggaccacgugggacauuggggagagagagagagagagaaagagagagagagagagagagagagagagagagagagagagagagagagagagaaaucuugcuuggcaucaacagaggagcuucaguuucacauuacagaguaucauggucuacaaugcguggcaucccaagaggcagcaagugauaggauuuaggcaaguguacauguugcucaccucaauaccugccuaauguccuguuuccucugaagaccgaauaacagcucaugauuggucuaauagauucucagaagcaagaggaaggacugcugggcccgcaggacucuggagacaagagucagaaacagcccuggaguuuggauugaacuuuuaaauuuguaguuuauuuuuaaaaauuauguugggugcaguagugcaugcuuuuaaucucaguaccugggaggcagaggcaagaggaucuuugugaguuaaaagccagccuggucuacagaguuccaggccagccagggauacacagugagacucugugugugugugcgcgcgcgcgcgcgcgcgcgugugugcgcgagugcgugugcaugugccaagaucagaggacaacuugcaacuugcacuaguaauuucucuucuuccagguggguccuggagaggaacucaggucagcaggccugguggcaagugccuucacucucugaaccaucuugcuaguccucuuuauuguuuauuggguuuuguuuuuuguuuuguuuuguuuugguuuuuguuguuguuguuguuguuuguuuuuucaagacaggguuucuuuguguagcccuaacugucuuggaacuuuuccuguagaccaggcuggcuuccuucugccuauccugggcuccuaaauacugggauuaaagguaugugccacuaccauccagccugcuggcccuguuuuuauuuaaagagugugugugugccuacauguaugaauaugcccacacguggaggucagaaaaggguauugaaaccuggaacuugagugagccauaauguggguccuggguaccgaauuccaguccuuugcaauggcagccuuaacugccuaacuuaacugcugagccaccuguuuauuguuuaagguaaguuggcuuugacaucuuacucuucauguucccacucccaagcauccagauuauagguguguacuuccacgccuggauuggauaucaguucuuuacauugauaggugugugugugugugugugcccugcaaucacaccaggcuccagucuuggaaaucacugaugcauggaucccucccacagggaucuggucaagaucuagggcggcuuugcuccuuagggcugaggaugggaccgucagggcuuuguacuuggccagguaugugcucugccacugagcuccaccucuaagucacauugcagcuguauuugaaggucaaacauuuaccaagcacucaaagauagagaaccccagagauggcaaaauaaaguuugguuugggcauaccaagaaauaguaugcaacugaauaaaagaauguagccaguccuuccuaccugaaggaauguuauaccuuaaaaggaaacacacgcuacaaugacuguuucuguaucuguggccucacuuguuagaccagcacucacugccaacucuccacccagcuucucuggguauccuaggaaggggcucuuccccugaaccaugcccccaacuccucacuggggaaugccagggagagguuauacucagcuuucuuuggcuuuggaguuagcaccugaggaacugggugaccucugggccucugacaucuugguuuacuuguugaccaugucaaaccgugguaugauacagggaagccuaaaggccaucagucuuggugguagcuggacagaagccuucgggaaaucucaguguagcuugugguuuggaggaugugguuguaugugccagugcugcccuggagagagggaaguccccaagcauuccuuguggccuugggaagucccucuugaagaacuucccccugguaccugaucuuagaaacccaagacuggggcuggaauucuggcuuugcugcauuucugucugucacuuggaaggcagaguuuaagacuagucuggucuacauagugaauuccaggucagccuggggguggguagaguggggguagggauaacaaacgaaccucaaaacccaagcagggguuaguggggguacuccaggcagagggaacagccuggagcaaggcuggugcagaaacuacuaccuugccugguguuagcacauggguggcagccaacgugguuguugucaagagcuuucuccuuggggagccagggagccuuggcgggugugggagugguccuaggaucugugugacaggaagcuggauuacuggaagcugguggcaaucggauccagcaaaagccugccugagcuugcugcuugugauugaagcauccaagaugggaggggcagacaaauauuugaagaauggagaaacuaggaauuggugagagacugaaguucggugucaagaaguaagaccauguaccguaccaugcccuuccccgugugccaauguuuuaauacagcgaagcaggcucugccccugggguuucauacuauagacugauugcccuggaacuugcuuuguagaccaggcuggccucgaacucaaagagacccaacuaccuaugccuuccaagugcugggacuaaagguuugugccacuauugcuggacucagaggucaauauuuacaaaauaauuuguuuuuauuuuaugugcauggauguuuugcuugcaaguaguaccugguguggugaccagaagagggugccagaugccauguguaggugcuagguccacuguaagaccuguuugugcucuugaccacugagccaucagccuagcccuuagaggucaccuuuuggaaaucuauuuucucuuccaccauauggaucacccagacuaaacuaggucaucagacuuggguggcaaacaccuuuaccuucugaauaacuucuuaguccacuuuuccgugagauugugucugacauagugcaggcuagccucccauggguagcugaggacaaccuuaacauuugguguuuuuuuuuaaagauuuauuuauuuauuauacguaaguacacuguagcuaacuucagacaccccagaaucaaaucucauuacagaugguugucagccaccaugugguugcugggauuugaauucaggaccuauggaagagcagucagugcucuuaaccacugagccaucucuccagccccuguuuuuuuuguuuuugguguuguuuuuguuuugguuuuuuggguuuuggauuuuuaaaaaauauuuauuuacucauuuauuauauguaaguacacuguagcugucuucagacacuccagaagauggcaucagauuucauugugaaugguugugagccaccaugugguugcugggauuugaacucaggaccuuuggaagagcagucggcgcucuuaaccacugagccaucucaccagcccccugguuuuggauuuuuuucaaggcaggguuacucuguguagcccuggcuguccuggaacucccucuguaaaccgggcuggccuugaacucagaaaucugccugccucugccucccaagugcugggauuaaaggcaugcaccaccauguccggccugguuuguuuguuuuuaagauaggauucucacuauguaucccuagcugagcuagaacucuguagaccaggcuagccuccaacucacagaaucccuccugcuucugccuccgaaguauugagauuaagggaauggggggugcaccacuauacacuguauuuauagaauuguaauauaugacuuauuuuuaaauacugacucucuacauagcuugauguggggaccagguuggccuugaacucacagagauaugccuucugacuguugggauuaaagacauauauuaccuaauuuacagcaucuuuaccuaauagaagacucugugcuggacaaggugcuauaggcccgugaucccuacucccggguaggcuaaggcaggguagacacagguuugaggccaagcuaacuacaguaugugagagccuaccucaaaaaaaaaaaaaaaaaggaaaggaaaaauauaggaaaggaagaaagaaaaguaaggcugagaagagaggucaaagcuuagugauggcccugggguuccacuacuguaccacacccucgguccuucacugggggauucuaugagggguuuuaccacggagguacaaccuuaauucuuuuuaauuugggaacagggucuccaguaacuacuaucucacaaaaucaagaauugguccuggaccugcacaccccacucuuuguuaccgugaagauuucauggauuagucuuggaguuuugacacaagugcagcuuaguuuugcauaccucaauucacuuagucucggcuagccucagccuugccagucuccuucuuuggcuggaauuacagacuguaccaccacucucagcuuuuauuguuuugucuucuuuauuauuuauuuauuuguuuguuugguugguugguuugguuuuucgagacaggguuucucuguauaucccuggcuguccaggaacucacuuuguagaccaggcuggccuugaacucagaaguccgccugccucugccucccgagugcugggauuaaaggcgugagccaccacacccggcuccuuuguuguuuuuauugugugugucuggcgugcgagugcacaccugcgugccgggugagcauauggaggcuggacagcucuguggagcuauucucuuuguccaaguuuacaugagggauugucuguuuucccaaacaggguuucucuguguagcccuggcuguccuggaacucacucuguagaccaggcuggccucgaacucacagagauccaccugccucugccucucaagugcugggauuaaaggccucugccacugcugcccagccugggauccagggauugaauuuggguacuuagguuaugugguaagcacauuuacccacugagccaucucacuggcccauuuaauuuaauuuaaucuuauuugugggacuggguaugcaacccagggcuuccugucuaguaggcaaguccucuaaaacugggccaccacccccucaaccuuccgcacacccagauacauauauauuccuacuuauuugcagucuccugaugauagauuuuggaguguauuucaaccucucagcuaccgcugcugggaaugguugacgauccuugugcaaacacuccugaccuccucccuagcuuuccccgaagcucucugcauuccuggcugcuuacgugguggggcauguuugggggagacugaagucuucaggcagguguaggucugucuacggcaguccagcuuacaggauccccaaccccguuuccuugcagcguuuccggagaguguggagcugagaccucugccagccuggcagcaaguaggcaaggaccucacccugcgcugccacguggaugguggagcaccgcggacccagcucucagcagugcugcuccguggggaggagauacugagccgccagccagugggugggcaccccaaggaccccaaggagaucacauucacggugcuggcuagcagaggggaccacggagccaauuucucaugccgcacagaacuggaucucaggccgcaagggcuggcauuguucucuaaugucuccgaggccaggagccuccggacuuucggugagguccuucacagcgggcaaguggguucuugggaggaagaagaccccagcaaugggggaaaggugcugagaagauaguaauccagauagugggaguuuuggggauggugagcuggcucuguggguaaaggaagggacuugcauccaagcuugaugaccugaguucaauucccagcuuccaaaggagaaacugacuccugaaaguugucuuuugaccuccacaagugagucacauacauauauacacagcaaauaaaugaauaaaaagaaagaaaaaggguggugugugggguggaccccagagguccaacucauacugaguggcagccuccaggaucacaaacaacacuucuuuuguucugcggcccuggagguggcugggcaguugcuguuaaaaaaaacaacccagaccccggaacuccacuugcucaugccugucuucucccccaagaucuuccagcuaccaucccaaagcucgacaccccugaccuccuggaggugggcacccagcagaaguuguuuugcucccuggaaggccuguuuccugccucugaagcucggauauaccuggagcugggaggccagaugccgacccaggagagcacaaacagcagugacucugugucagccacugccuugguagaggugacugaggaguucgacagaacccugccgcugcgcugcguuuuggagcuagcggaccagauccuggagacgcagaggaccuuaacagucuacaguaagaaggggcggggcuuaguccagagauagcgauguugagaccugacugaccccaauggagggguacuaaagggguaggacugacaagggugggcccuucgggggcguagccuaacuugguagcucauucaggaguaaggacuggcaccaggggcacgacuagcgccugugguggcacuuucaagagagagaacugaagggaggcuuagcacugcuuuaaucccagcacaaggguggcagagguaguagguagaguccuuaugaguuccaggccagccagggcuacacaaugagacccugucucaaaaaguguggggcuaggccuuucagaaggccuaguuucagcuaggcccaguuccuggauggccagugcuggagauuggggcugacacuaaagguccaucuuguacuugaggcugaguggucauaggcggggguuugcacugggcggggcucacggugugucccgcucccagacuuuucagcuccgguccugacccugagccagcuggaggucucggaagggagccaaguaacugugaagugugaagcccacagugggucgaaggugguucuucugagcggcgucgagccuaggccacccaccccgcagguccaauucacacugaaugccagcucggaggaucacaaacgaagcuucuuuugcucugccgcucuggagguggcgggaaaguuccuguuuaaaaaccagacccuggaacugcacgugcugugugaguuggcugcagugcugagugauagucauuuccuacugccccaugugccuucggagcuuucccugaucucugucucugacacuauuucuccagaugguccucggcuggacgagacggacugcuuggggaacuggaccuggcaagaggggucucagcagacucugaaaugccaggccugggggaacccaucuccuaagaugaccugcagacggaaggcagauggugcccugcugcccaucgggguggugaagucugucaaacaggagaugaaugguacauacgugugccaugccuuuagcucccaugggaaugucaccaggaauguguaccugacaguacugugugaguaucccaggauauaaggcuggaugaggggugggcuaggugccagggccucaagucucaccauucccuucugucucuaccacacagaccacucucaaaauaacuggacuauaaucauucuggugccaguacugcuggucauugugggccucgugauggcagccucuuauguuuauaaccgccagagaaagaucaggauauacaaguuacagaaggcucaggaggaggccauaaaacucaagggacaagccccaccucccugagccugcuggaugagacuccugccuggacccccugcagggcaacagcugcugcugcuuuugaacagaaugguagacagcauuuacccucagccacuuccucuggcugucacagaacaggaugguggccugggggaugcacacuuguagccucagagcuaagaggacucgguggauggagcaagacugugaacacgugugacccggacccaccuacagcccgguggaccuucagccaagaaacgcugacuucauucucuauugccccugcugaggggcuccugccuaaggaagacaugauauccaguagacacaagcaagaagaccacacuuccccccgacacaggaaagcugagacauuguccccaacucuucuugauguauuuauuaauuuagaguuuuaccagcuauuuauugaguacccuguauauaguagaucagugaggaggugaauguauaaguuauggccuggacccugcugcagaugcugugagagucuggggaaagaucacaugggucgaggguuucucuacuggucaggaugcuuuucucauaagggucgacuuuuuucaccagucacauaaacacuauguggacuggcagugguucucugcuccuccacauccuggagcgucccagcaccuccccaccuacuuuuguucccaaugucagccaccaugccuuagcagcugaacaaucgagccucaugcucaugaaaucauggucccaggcggcuccaccucaaagagaaagccuggaaggaaauguuccaacuccuuagaagggucgugcaagcugcugugggaggguaagcaccccucccagcacagaaaccuuuccuuugaaucaauaaaguuuuaugucggccugag

SEQ ID NO: 4946 - RNA, 4589 nt, Mus musculus
gaccacucucaaaauaacuggacuauaaucauucuggugccaguacugcuggucauugugggccucgugauggcagccucuuauguuuauaaccgccagagaaagaucaggauauacaaguuacagaaggcucaggaggaggccauaaaacucaagggacaagccccaccucccugagccugcuggaugagacuccugccuggacccccugcagggcaacagcugcugcugcuuuugaacagaaugguagacagcauuuacccucagccacuuccucuggcugucacagaacaggaugguggccugggggaugcacacuuguagccucagagcuaagaggacucgguggauggagcaagacugugaacacgugugacccggacccaccuacagcccgguggaccuucagccaagaaacgcugacuucauucucuauugccccugcugaggggcuccugccuaaggaagacaugauauccaguagacacaagcaagaagaccacacuuccccccgacacaggaaagcugagacauuguccccaacucuucuugauguauuuauuaauuuagaguuuuaccagcuauuuauugaguacccuguauauaguagaucagugaggaggugaauguauaaguuauggccuggacccugcugcagaugcugugagagucuggggaaagaucacaugggucgaggguuucucuacuggucaggaugcuuuucucauaagggucgacuuuuuucaccagucacauaaacacuauguggacuggcagugguucucugcuccuccacauccuggagcgucccagcaccuccccaccuacuuuuguucccaaugucagccaccaugccuuagcagcugaacaaucgagccucaugcucaugaaaucauggucccaggcggcuccaccucaaagagaaagccuggaaggaaauguuccaacuccuuagaagggucgugcaagcugcugugggaggguaagcaccccucccagcacagaaaccuuuccuuugaaucaauaaaguuuuaugucggccugagugucuugugaguuuguguacagucaucacaucaguuaggcaaagcccuaaggacugccgacucccauaaugccucaggguugucugguaaccuaacccuaacucugagucuguggaucagguugguccccacccccacccccuuucuuuuuugagacagguucucuuuguggccauggauguccugaaaucugcuauguggaaugggcuggccuugacuucacaaagaugggccaaccugucuccugaaugcuaggacuaaaugacaaagccacugccaugucuaguaaaaucuacguuagauagacaggguuucccaguguagaucaggauggccuugaacuuacagagaucugccucccugggagugcugggaucaaaggcaugugccaucaccaagcguuauuuuauuuuuuaauuuuuaaagacuucuuggggcuuacguaaaaacuaaagagcagguccagaacugugcaauggcuuuugguugauuguagggucugaugggaggggaggcagguaucuucaucagggccggccgaggcccauucuggggcguggccagggugccuucuuaucuccugcggccagccuaaacucccuggcguuccgcccgcacuucagcgcgggcuuugugccauggagucugcccuucugcucccgucgcuuuugcugguggcugccuauccgaggggugggagcccccagcaagaguggaugcaaaguccucccgcgccuuccgugaccucagcaccuuucugggugcgucuuaauccagagcuagaggccgugccucccgggggcucagcguggcuuaacugcagccacaacugcccccugccggugcauuccagccugcgcacccaacugcggcagggaaagauaguuaauggauccggcuggguaucuuaccagcuacuggaugugagggccuggaauuccaaggugcgcugcgucgucacuugcgcaggagaaacccgagaggccaccgccaggaucacugcuuacagugagggagaccggggcucaggccgggcuggggugaggggagagggguggaggaagcggauagaugguaauugcuuuaaggggugccugugggccuuaucucucuugccuuagaacggcccagaagcgugaucuuggagccuccgguccuagugggccacaaguacacucugcgaugcuaugugacacacguguucccagugggauucuugguggugagccugagaagagguggccgagugauuuaucaugaaagccuggagcgcuucaccgguucagauuuggcuaaugucacuuugaccuacgugaugcgggccggacucaacgaccucuggcagccacucaccugccaugcgcgccucaaucucgacgggcuaguggugcgcagcagcucggcaccuguuauguugacaguccucggugaggcauccuguaaucccagggaaugggugcgggagaggggauguugccacuccaagggggccugcagaacaggcgugggcuccacgcuuggcgguccucagaccuccuaguuccugauuuucacuccugcccacagcuuuaagcccagccucuauagccuuggccucuaccuccaucgcaacccugguggggauccuccuggcugugggggcugucuacgugcgcaaguaccuggcugugcagacuuaguuauagaucuguuuucgaugccugacaagagggaggggaaaagaacuucagaguaauuaauucagagacucuuauugaaacaauaaagucuuccuccucagucucugccuuacgguucuuggagaaagugguuucuuuuuuaagguaccuuacuuuuuccaaauuccuuacguaggggcugaagauuaguagauuagagguaguacuggaggaaacaacaccuugaaauuucuccuucaaggccagcaugggguccuagaacccgaguuccucugcguagaguuuuguuagcuuuauuugugcggggcagaaagacuaaacugaccuccccuccagggcugacucuugguauggcuuuuucugauuggcuccgcugauacaggccggagcucugauuggaggcuaaguuucccuucuccucccuccuuuuccacuacggagccugugcguuacuagagaaggccagcggguggagcuagaccugauuccccaagguuaucauuaauuggggggggggggggagguagaaacacucgaguaggcggggccuucuucaaguaguagaggaagcggcuaacuagauaggaaaucuagcauagcaacaaguuaagagaugauuguucaggccacgugagcugucacagacuugcuuccuggcguugugcuuguugucuccgagucugguauguauguagagagggaugucaaagcuggggucaaaguguccccaguugaucuuuugguccagcgugaauugcagaaucucgcacuaguuacccaguagaggcggccacacuccuggcgaggagggcgcagaagcucugcugagagacuagacacacaacagcguuguagacacauucccgcugcacucuggguaaauaaagaucgggugccggagucgacucuaauuuagaagccugcgaacgcugcgcacacgcacacguguccgagucuugcuggcacuugaucccccucuuccuucgccgcgugcgcggaggaggucuuaggggcguggcucccauacuuagccugcuggaggucaaaacgaaaccucaguuaaggaaggcauccucacauucuccucuuagaaccacauuuccugcauacuauugacuccccaagcuaauacaagcaaccucuccauccacccuugcucaaacaggcgcuggugggagggaccgaggaugggcguggcuuggagacccagcgcguugucucagacucuauaccuauggugguggguguuugggcagggccucucagcaucccuucccuccuucgccagggaugacgcgggagagcguggucgcccccagaaggcuuuagaucauuaggccgaccuccauguagaucuuucccccacgggggaccgcucuugccuggcuagcucgccugcauuaaggccuggagaagcccagugcgcgcucgccuccugucagcucgccccccaucaccgccucugucaccgcccccuccuuagaaaccaaguuaccaacguuuaaaccaaucccugggcgcaauucugccacccccacacuccacccgcugcgcugcgcgguccucccagccccgcucuccaucacucgcgcuccccucgccuucugugcucuccccuccccggcagcggcggcaaugccggggccuucgccagggcugcgccgagcgcuccucggccucugggcugcccugggccuggggauccuaggcaucucagguaagaagagcccgccggcggagccagguggauaaggcgggggcggaauugaaggaccagagagggcggcccggguguccccuccaggcuccgcccucuucuagcuucccacgcuucugccaccaccuggagcuccgggcuucuccc

SEQ ID NO: 4947 - RNA, 1225 nt, Mus musculus
acugaggaggaagacuuuauuguuucaauaagagucucugaauuaauuacucugaaguucuuuuccccucccucuugucaggcaucgaaaacagaucuauaacuaagucugcacagccagguacuugcgcacguagacagcccccacagccaggaggauccccaccaggguugcgauggagguagaggccaaggcuauagaggcugggcuuaaagcugugggcaggagugaaaaucaggaacuaggaggucugaggaccgccaagcguggagcccacgccuguucugcaggcccccuuggaguggcaacauccccucucccgcacccauucccugggauuacaggaugccucaccgaggacugucaacauaacaggugccgagcugcugcgcaccacuagcccgucgagauugaggcgcgcauggcaggugaguggcugccagaggucguugaguccggcccgcaucacguaggucaaagugacauuagccaaaucugaaccggugaagcgcuccaggcuuucaugauaaaucacucggccaccucuucucaggcucaccaccaagaaucccacugggaacacgugugucacauagcaucgcagaguguacuuguggcccacuaggaccggaggcuccaagaucacgcuucugggccguucuaaggcaagagagauaaggcccacaggcaccccuuaaagcaauuaccaucuauccgcuuccuccaccccucuccccucaccccagcccggccugagccccggucucccucacuguaagcagugauccuggcgguggccucucggguuucuccugcgcaagugacgacgcagcgcaccuuggaauuccaggcccucacauccaguagcugguaagauacccagccggauccauuaacuaucuuucccugccgcaguugggugcgcaggcuggaaugcaccggcagggggcaguuguggcugcaguuaagccacgcugagcccccgggaggcacggccucuagcucuggauuaagacgcacccagaaaggugcugaggucacggaaggcgcgggaggacuuugcauccacucuugcugggggcucccaccccucggauaggcagccaccagcaaaagcgacgggagcagaagggcagacuccauggcacaaagcccgcgcugaagugcgggcggaacgccagggaguuuaggcuggccgcaggagauaagaaggcacccuggccac

SEQ ID NO: 4948 - RNA, 7679 nt, Mus musculus
ccugaaucaccacaaccucgcccuuggaugacagccgaagccuuucgcauuuugccuaggauuccccgaugcacgccugucucuagccaagccuguugaucuaagagguaccaaccucaugaucuuugagguuucaguuugacccccguccaccugccccucccgcguuggcuggugaauuuauugauuuauggccaugcugggguugagacuggggcuuugcauagggcucucccacugcccugccugauugcaauucuuuccugcagugggacuaaguuggggggggggggguuaagacaggauuucucugcuuagcccuggcuguccugaaauucacucugucaaccaugcuggccuccaacucagagacucacgagccucugccuccuuugugcugucauuaaagguuuaaaggugugcaccaucgccgcauuacucaaacuagguuuuuggguuuugcacaucuauguauacaugcagauauacguagaugcuugcaaguguguuugggugcuuuugugagcccucaacuugacauccugacuucauggcuuuccacccuauuuuccccaggcagggucuccaagacucagccaguagggagagcugggcgaauggauccaaucugagauagugcuccugugcgguaaguguuuuauccacugggccaucuccccggaccacugugaggauuugguuuuuguuuuuuguuguuguuuugcuuaaagacaagaucuugggcuggcaaaauggcucagcagguaaggauacccacuaagccugaguugaucgauucccagcugacuccuucaaguuaguuguucucucucucucucucucucucucucucucucucucucucucucuuucucuuuaacuuaauaaaaucaggggcuagagagauggcucagcaguuaagaacacuggcugcucuuccaaagguccugaguucaaaucccagcaaccacaugguggcucacaaccaucuguaaugagaucugacgcccucuucuggugugucuaaagacagcuacaguguacuuacacauaauaaauaaauaaaucuuuaaaaaauuaaaaucaaauuaaaugagaaauaugcuuuccguugggugguggcagugguggugacauauccuuuauauccuuaaaccccagcacuugggaggcagaggcagguggaucucugugaguucaaggccagucuacagagugaguuccaggacagccuggacuacacagagaaacccugucuggaaaaagaaaaaacagcuguacagucauaauccuaguugagggaaauagguaggaggcccugaggcccuggccagacccuccagccugaucagucagcuccaggcccuaguagaucauaucucagaaagcacgcuagacaguucccagggaggaauugcaucugagcccgagcucugacauucacauacaugugucugcagacacacaugaacacaaaaccagagagauggggaagggugggugagcuggcucugugggaaaagggcuugcuacugaucuggauggugugaguuuuaccucugggacccauuucguagaaagaguaagccaacuccuacaaacuguccucuggucgauacccacacauaggccaugacacugaccccaacacacaaacacauacacgcaauaaagaaauggaaaaacacacugggagacaggcagggguggcacaugccucuggacacagagccaggcagaucucugaguuugaggccagccuggccuacagagugaguuccaggacagccaaggcuacacagagacccuguaucaaaaaaccaaaagaaaaaaagaaaaagaaaaacauuaaaaaaacaaauuuuuaaaaaggggaggaaggaaaugcucauuuuggggcaugaggguguagcucauugguagaaugcauauuuaguguacaacagacccuggguucaagccccaacaccgaaaagaaaaccauacaagucagcaagcuuggccccuaguccaucagcugccgcaggacgugcugcccaauagauguccaaaguccgguccucacagauaacaaccagcaaacgcaccugauccugagacccagcagccucggacucgaccuugaccugagugagggccguaacccuccacuaacccuccgcucugcagcagagcucaccccacugcggugagagucgccgcccacccugggaggcugaucucagcugcgcaugccccucccggcuaugcacacgacuuucuuuuguuuccuuuauccacacgcugaggagcuaccuggaaaggagcugaugagagagcucaguggguagaggggcuugccgcuagucuuagcccuguguuugagacccagaauccauguggcagaagaacccacuccugaaaguucucugacacccacacaaccgucagugugacugcaccccugccucuccccaaacacgaacaaguguaauuaaaauaguaagaaacgcugaaaaaacuacccgggugacaucuaugaaguuccucaaggcugcccacgucgaagguucccuccuauuuccuucucuuuccuuccuuccagacccugcaaaccaauugugcuacagacauagaaauccucuuugcuuccuucucucuuaaaaaaaaaaauguuuuuaaauguaugugugcuuuugcgaguucacaugcagcguacaggagccuauccaguccggaaggcaucagagcccacaggacugaagggucacagguaguugugaugaucgugcuagggacugaaccuggguccucugccggagcagucggugcucugaacagcucagcagcucucucuuucuuucucuuuccuuccuuucuuccuucuccucucucccuguguuguauucccacauuuuguacagagguggaggacagaggaaugcugguguuuucuccccgcccaccccccccaccccccuuccccccaugguauuucacugaaccugaaauuuaccauuucagccaggcuggcuggcaugcugggaucacaggcaugcagcugggaguucagguucagguccuuugcuugcagagugagcgaguguucuuaccccggcuccucacuguaggacucuagggcaggggcucaguauuaguucucucuccucucucucuucucucucuucucucucucucucucucucucucucucucucucucucucucucucucucucucucucucucucucucuccccccaggucuaugaagaccaggcuggucccaauucacagagauccgaguuucugccgccgcccccccagcccccaucugcaagggcucuauugagcuucauuuccagcuuuuugagagacuuuuuagguauauauagcuguguguuugucuguccauacauuuguggacaggugccucacagacagcucugguuaugagccaggcucggguccuugggaagagccaagaggccaccucucuagccuaauguguggauggagucgaucuguggcaugagcucaucauguagcuugggcuggaauucagagaucugccugccccuucccagcauugggauucaaggugcgugccaccacacuagcuccauauagauguagcccaggcuggccuugaagucacaauccuccugccucagcuucccaucauugggguugcagguuugugcuaccauuccaagcuacacuuuacacaugaagacaucuaaggaaacuagugaaagggggggggggguccaguggagauggagguacaggugugucagugaaacaccaaaccugaguacugggaacaaaagcugagccucuggaacgcauuggugcccuuaacugcugagccaucucuggcuccugggaucaaaggugugcaccuuuguugaccuugucuacuguagcucaggauagcuuccagcuccacagagagcccaggaugacccugagucuuucuucuggugcuuuucaaaauagucccaagggcccagccuugguugcacaugguuuuuguuguuguuuugcuuugcuuuuuuggagacaguuucucuguauaacaacagcccugccuauccugaauuucacucugaagaccaaacuggccucaaacuuggcagaaauccuccugccucugccuccaaagggcagagauuaaaggcaugcgccaccacugccuggccacuacucucugagacaaggucucuauuggccaggcuggccuucauugguuauguaugaacuccagcaugguucugccccugcugcuaggauuacaggugugguccaccgugccuaguuuacaggugcuagggauggaacccagggcucauacaugucagguuaauucagagccacacccaaugucccagaaaccuuuauuuuccugcuuggguacaaaaauaauaagcaggaaccaggcauugcgcuauacagauguagccccagcacucgguaggcugggacaggcggcagcgucaguucaaggucugaacugaaggccaucccggacgacgugagucccugccucaaaauaaagcuaaacacaggaggccccaggagaaguuaggaggcacagaaguuaggucauuggcuucuaaugcccugaaacugacagacaacugugugucccacaagaagcaagaugcccugucugagcagaauguacaauggcaagcagagacaauagacggguuucagauaccagccccaucaggaucugcguguauuucaauagaagagcugucucucccugagggauuccgaccgcccucugaagaccugugugccuacuccauucuuuauucccaugggaaacuuacaggguuauuuaacaaaauaacuguucagggcucagagcccagaggcuucucugugccggcuugucccuugggccccaguuccagagggagccucagccccuuggccucagcugucccuucuuccccuguccacuggaauugaucaccgaguugcaggaaccaaagaaaaaaacaugugaucuccugcuuugccuguccccccccuucugguggugggaguucaagggcuucucaccugugagggugccccgcccauaccccaucccagacuuggacgcuccagggcuaugacagaugggcccauggauuugaguucuggucuuccacaagguccuuuacaaggcaucccagucgcccuuccuggaagaagggaugacuucuucugccgccucuucggcccuguguuuucuguuuaugcuuuguuuucuucuuuuuucuuuaguacagagaagcagugauacacagacuguuuuucuguccuguugucagugcucagguauuccaagugcuucagcagguacaguuuuguugaucaauuugcuuccgacaggguuccauggugacggccacacccaccccgcugcggccagaugucaugcgggucaccucacuccagguaucacuguccgggucauagcauuccacacuguccagaaaaguguggccaucauagccuccugcagggagaaugaagagaauggucacccccucagagugcccagccuaccacgcaaggcggcagagaacagaagggaaaagaagcccccuguuugcgauggauagguuggagguggaaugugguucagucuagagccccugccuaaacuucccagugaaggugggguacagggugggaaguguuguaagagugggugggggagcggcuuaguaguagagcuucggcccagaaucccccaguggggcggggcacaauuaaaggacacuugccaagcauucgggacucucuggcuuuuauacucagcaccaaaacuuggagaagaaaagauauggacacucaagugugguuuucacccugauccagccuccaagggccucaccgaggacguagaucuugcccuggugcacaguaauccccagcgcacuacggugaugccucaugggggcuacgaaaguccaggucucugucuccacgucguagcgcuccacacuguucaacugguccugcccaucguagcccccugcugcauagauacaguugugcagcacgcagaccccuaaaggaaagcgcacagugggagucaccguaagccuggucugggguggggggugggggcagggccacuggacaagggacuuuaguagccacugcccuucccuccaccacuggagaagcuggaguaggaggaucaggaguucaaagucaaccucagcgacauaaggacuucgagggcagccucagucauguaacagagggaggaggguaaagcaaacgcuuccucgcuuccucgcugggcugggcuguccucacuccaccccccacucaccggccccgcuccggaugguauucaucggugugaucauccgccacucauuccucucuggauaguaacauucugcggaguuaagccgguuagucccgucaaagccccccacugcauacagcaagcgguugagcacugccacgcccacgccaauccuccgugucaacauuggcgcgacuagaugccacucgucccgcucuggcucauaucugcaaaagacauaauaccccguggucacccguggucaacccuuacaccacggcccuccaucugcuugcacauuuauuuuuagguuuuuguuugguugguuuuuuguuuguuuugagauagaacccugcuauguaguucaagcuagccuugaacucuccgcgaucuccugcuuuagucuccccagugcggagagaugaaggaugugcagcaccaggccuggcuccagaagugaggggucaucagaauccagguucacugucaucaauuaugacugacagcaacagcaauucccucuagccuagacggcuuuaccccuuagggcugcagcaccugugcacuucaccccuagcaggauucauugccucacaccacaagauuugcuacagacaugugggguaggacauccagggucacuaagugacaucugggcagguguucaacuccaaaugucuaacugggucucccaggugguucucugagcaacaugaucagagaugggugaacacgccccauuagcccagcagcguccaguccaucccugcauccuacaguccuugaaggggccacccuauucacagaccacacacauuagagccccuagcacauuuguuuacauuuccauuuucaggcaugggcgggguuagcuugggguagacagcugaccuagcaagcauagauuucuagguucuauucccagcacuacaaauacaaaauuaaaauuuuuucucauuuucuuacccuugcuccaagcccuaaauuuguguguguguguguggggggguuguuugucugucuugagacagggucucuuauaucccaggcuggccuugaacuugccauacagccaaagauaaauauugaauuccugauucuccucccucuacccccagagcgcugggaugacagcuggguuuaugagggcuuccugaacgcggggcaagugcucugccaacugagucacacccccagcccuuuuucuucuuuucccuccuuccuuuuggcagggcuggggaugagaccuuaaacccuggauucaagaaagagaccagaggacuggagagauggcucagugguuaagaguaccaacggaagguccugaguucaaaucccagcaaacacaugguggcucacaaccacccauaaug

SEQ ID NO: 4949 - RNA, 1896 nt, Mus musculus
gacacacacacacaaagacacagggagaaacagauaccaagaggaucugagagaagccagaaaaauggaucauauugugaucagaguucaauucuggggacccacauggggugugggggagaaaagcaacuucgacaaguuguugucugauuucccuacauaugacauaguacacacacgcaugcacacauacaaauacauaaauaagcaugauuuuaagagcaauuuaaagccaggacugguagcacaugccuuuaauccuagcauucaggaggcagaggcaggcagaucuuugaggccagcuacggagcugaguaccaggacagccaagacuacacagagaaaucgugucucgaaaaaaaacaaaaacaaaaacaagaaggaaagaaagaaauuuuaaaugagacccuaggggagagagacauagcgaguagauauccauuugucauuuacuaccuuauucauucagaaguguuuauuggccauaaucugugcccaagacagccucaaaucccugacaccauaaacacaagugcuauauuucaugauuucgacccuaaagguugaaagaaguggggcggagacagagaagccuuugggcgggaggagucagauccuacuuauuuggggaccuggaaguucccuccaccuacacuaucccucucguaccugccccuccucucucuugucccucagaaaguagagaagggcucugugcugcuguccagaggagacuuguccccacccggugaggaccagaagacuccagcagucgcgcccacuaaaaguaucucuuaaauugugcugcccaugugcugcgccauugaguugucuuuggaaugcaggcucagggguccagacaucagaggacagacaggaccccuuaucuggaguagaagagugauucaccuagaaaaacccucucuuuccugcgauucugggcccucccaccccgaguguccccgggagggacccgagggagaagcuaggacuugcugguaccagucgccgcugaggcgcucuccggugccgcggcggguggcacaggcuggcaaccccgggcugggagaaggagggggaaaaugcgggcguucgccgacacuuggcgucgcgggcccgcccuuaggcuugccacuuccagccccgcccccauugcagccguccaguguucccaggcgcaccgccuagggcacacgaccggacccaggcgcaagggugaguguccagcacuaggggaacuugcgggaagugggacucggcuccuuggagcaauugacggcuggaaaugcacagcgcuccuugcugggguuucuagauccuuuaugggacccccagcagagaaaacugaaaacuccaaggguacuuguaggccugaaggggagugaggaccccaggaacccuccagcucagccuggcugggcuccuucaaacuuuuccuaauaucauuuccaggcaugucaggucauuggagguguugguacaaaaguccuacccucucccgagugaaccgagcagagaaagcuguuuaaccuguaucuguauuugaugccucuccagcacucaaaguggcccaguacuucuaagucuguuugugcuccucagaaacugucugggaccucuuugucccuuugccuuccagguauugagagaucugugucccgggccugucuuuuccaaggcuucuaugaagggcauuucuuguuguaaaaaauuucagggcauggugauguaugugugccuuuaaucccaacacuugggaggcagaagcaguuggagcucuguaaguuucaggucagccuggucuaucuagacccaggccagcaggcugcauacgaagacugucucaaaacaauuuauuuuaaaaucugauuuacgugugugugugugugugugugu

SEQ ID NO: 4950 - RNA, 14906 nt, Mus musculus
cguccaccaauaggaaacucagcccggaacagaccugaaaaucuuaggccacuggggguauuuuggggucaggcaccggagcuccucagaaguuucagggcagcuguucagaggcuaagccagguaggcaugguccagcugguccagaaagacccugaacugaaagugcuuuccuccauccgccugcagauccucagcuccuccucagucacggaacgguaccccauguucacaguggcugaaggccacgcucaggaccacagccuggaugcccucugcacccagcugucccagcccacacugcggcuaccuugcacaggacgacuacucaaggccaaaaggcccagcuccgaggacuuuguguuuuuauaaugggaagggauggggaaagaugccagacuauuuauuuuuuuauuuaugucaugucagguaugggaucugcaacuccagugguggugcuggaccccuguccucauguccccguccuccccaacacagcugagaccuaucugggcccccagcugccccugccuccucaggagccagggaaggagagugggcuccagggcacucacucagggccuaauucaaguucuguagccugcauugggucacuggucccaaggucccaaagguccuguccugggagaacugacuguggcugauaaagaugcagacuugaacaugccuggcguuguugacauuucaggcugucuguggagaagacagugcucugguagccucauuucaaagcuuaggaacagcagugcccucuccugcagguagcuuucguaggcugccaggcagaguuuggucagcagcuuaguuguagaggcagguuggcucccuguggcccucaggaguggcucugcuguuucuuccguuggcggccuaacuggcggaagugcagccuuuugggguugagaccaaaggccugcaaucucugucugcugaacuugugaccuccaagugucaccgugggacccagcagccuggccuucuugcucuucugcuucugggaugcuggcuucucugggcaggaugugugggccaaccccucuuccuuggauacuaaggucucagccuggggugucuucuggucagcuccauugggugugaacaacuguacuugugggcuggccuugcucugugacuuuccuguggcuucuguggacauuuccauccuacagggagaaaagucaaggcuuaggucagccugcuguucuguucagaaaggauuucccccacucugcccuuuuuguuugagaaggggguucaugacuggccuuaaacucuauguacccaagaugaccuguaacuauuuuuaaagcaggauggagugauacagccucacuauguagcucuggcugugccggaacucacuguaagaccacacuggccuugaacucagagcucuucagggguuuuuauacagugcuaacauagagcccaggccauuagacaugccacggaagcacucugcccacucagccaaaacccuggucuuguugucucacuacagaacccagauggccucagcuuccugagauaacuuucauaaauaggacaacuacagauuaguuggaccagcggaagccauuuaugucagucaacuccuugugccuuuagugcagcugccaugucugucacaacugagggucuagguccuagacucuaggggaugaugguaacaacuguccuuguaacaagccuauaagguacuuguaagaauuuauuuuguucaggcuugggauaaaacucaggauuuuaaucacgcugaacagaaucucacuaggugugguggacacaccuuuaaucuaagcacuugagucagagggagaucucugagcguuugagaccacccugaccuacauuaagaagcuccaagaggacuacacagacacaagucuuaaauaaacacacaaucuuuacauccugcaaaggcaggguguugcuguggagcccaggcuggcuucacacucaacaaacucgugaaccccauccugccucccuaaugcugggguuacagaugugcaccagggugcaguccuccugacccuuuaucugagugcugcaggcaugcccucaaucucucaagucugaaccaugaugaccccucaccaagagggacugacuggccucuagcuuacacaucugcugucagcuccaugggcugcugccacccuccccggcccagugcuuacucuuccuggcacagagacuugaagaucugccucuucuuccacauguucugggccuucuggcuguacacccgcugcuccugcaucuccuccugcuccgaccugugcaccagagguguucuagacgcuguccaaacuaucuucccuccucccccaccucccugcugucaccuguacaugcaggucuucuucagggaacaccagcgauucaguuccuugucaucagcugaaaggaucugcaugaggaggaagauaccuacugugugguccuggggcugccucugagccucagugacucagcagggguggcaagagggcgggggacaacugaguuugguguuuugauauugaggcaggguuuguuugaaugucuaccuguagcucaggcuaucuuggaauucccagcaguccccuccuaccucagccucuagugcuggccuccauuaacaguuucagcuguuagugacagagacagcaccgaacuccagaucucccugucugaccucuucacagaggguguucaccuccuccagucccuugccccucccucaauuuucccugccggcccuggucccaaccuccucugugcugagcccgaagucgcagggcaccacagugcgguacuugaaacgacagggcaggucgucgauaauguccucguaguccagacgguaguacucaucuagguacuccucaaaggucuuguccccugcacaggagaugcacagccggguaguauguguucaaagccccaugaggcacacugccccaucaugccaugcaccucaccagggucaaacaugggcuucuccugccccacugcagcugcaaauggagacuugcgcuuucucuugccugaggugggggccucacgaagcuucuuccgugguuggcuggggucauagucugcauccaucuaucagaaagagcaggucagaucaggccaguucuaaacacuucuggagcauccagaccccaccagggacacucguuguucucaaggucucauacaacccaugcuggccucaaaugugcucugcggccaaggcuuggaacauguucacagaaagcucuugcugucaacugcaccuacuucagacucacaccaguggcacucacguuaaagucaggguccucacagugcagcuccuguuggcuccaggccccaucuugcucggguccaccccacaugucccaguuccagucaucugguuccacggaggacagacaaagugagaccagcacugcacugcacugcaccagcccugcuccccccucuuucuaagacacgcaccuucuagcccguccucuuccucaaacuguggcuucucuuccuccgcaguaccauagaaggcaucuccaaaacauuucugcaagggaagggcaggccuaaggggcagcagcaccgacagcuacaggagcucagccgccccaugccaaugccagcacaacucagccuuguacaagacaggaugucauguaggccaggcuagacgcaaacuauguaccauaggcuagccuugacauugugauccauuugcuuccacccaagugugguaagugcagacgugugaaugagguuuuugcuuuauugagagaaagucuuauaguccugccucagacucucaagugcuaggauucuaagcucaugccaacacacccaacuuuguguggcuccugagucuuccaagaaauggucuccugugugcugagaccuuccacagcaccuccuguuuagggugcagugguuucacacaacagcuacuacaucucuguaggauucagacccugccaucacuugugccccucuacccaugacauagucgcuacucaggacucuacugagcugucaucauuccugauaggcugagaggaaguuuccuccaagauccuaccuacacuagacaugguacacaccugagcccaggggaucaggaguagcaggcuggccuggacuacaaaaugagccugagccuggaacucaggugauaggaugcugucccaauacacacaaaaacccuggcaccaccccuaacacuacaauccauaucugagccacaguugugauucuacaaggacacugcagccacgggucuccauggcuaccaugaucccugagucuauacagguauacaguaggcucacaauuacauggcaguuggggcugggcacaucaccacagaaacacaucuauugcgggccuaccagaagacaacaugaucuacugugcauuuauuuucauuuuuuacugccuuuauuuuuacucaguguguauggagcuuugccugcauguaugccuacaccacaugcaugugugacgcuccugaaggccagaagagggaaucagauccccuuagacuguaguuacagugagcuaugaggugacuuggaggcgaugggaacugaacguuggucuucuggaagaauagccaauacgcuuuaaggcugagccaucucuuuaggccuaucgugcacauaauaaagaauuugcauaugcucaaccuggagcagguccuugaugacauuuuuacagcuaccaugagcaacagcaccuugcuccuccauggagaaaccaaagcuaagagcugagaagugccuuaaauguaagaaagcagacaacuccacagcgcuccacagcccucacugagccuaccaaugugccuucagccucuucccaagacuuccucugcuuggcaaguggcccacuuggggcucucauggggcccagacuuuucuuacagauuucucaacacccggugcucuguuuuuccaguacagcaaaugcuaacggcaagaagagcugcaggacuagugcucagucacugaugcuugcauacgcagagcccuggguucuacauucuaucccaacgucaccacaaauacacaacaaaacuaacugagggacuggaaccccugcagcccauacgguagcuagagauccagucccaccaacauguccucuacacacgugccauggaacaugugaugcccccccaacagauuaaugucaaaacauuuacagcaaauaaauuuaagguccaagccaugcugguauauucuguaacugcagucaguccccgagaagcagacaagggugguaagacggaguccaccuggauauauggugagauucuuuucagaaaagcaggaaauuaagauaucccuggccgggcagugguagcacacgccuuuaaucccagcacuugggaggcagaggcaggugaauuucugaguucgaggccaggcuggucuacagagugaguuccaggacagccagagaaacccugucucaaaaaaaccaaccaaaaaaaaaaaaaaaaaaaaaaacaucccugauaauaugucaaugauucaguuuguuuuuuucaaccuuauggaaugcaaagacauuauguaccaagagaaacuucucuucauccccaccucugucacccaggcugcauuagaacuguguagcuaaggacaacccugaacuccuuauccuccggguaucagugauaucugucuggaacucucucuugauggcaaacagaggcagcgugaguuccagccucguagcccugcaaucaucaaggaaacaacuggcuccacugugcaugugcuagucucgguuauacauucgcuuggguggguucuaguuucuguuguuguugguuuucucucucuuuuuguuuuuuuuuuuuuuuugguggcagaggcuggaucccaaagauagaaaggugcucuaccauagccacagcccuggccccucauugggggacuguaggcagggguucuaccacugagccacacacuaggccuucccaugccacucucccagggggaucucacauggcuuaaugcugaccucuaccccacugucucccaggcaggccuucggguccugauccuccugagccagugcaguugccucaguauguaacccacuguuccuacgcacugcucugccuacccuuccgugucaacugcucccaccuaucuucccugagcuagagccagugcuccacuaacccucacacugcaggcaaagaacaaggugccacggaggucacgucauucucuggccccacagacgacgacuuccugagcaguuaccugcaugagcuggucgugcugggcggggucaaagucagccuccagguccugcuccucaaggcccagggucucguuaccaguggccugucgcagcuucuccagcuuggccagaaucuccuuccucuuuagguucuuuaacuguuucagcuccuccugcuuccuggccuucuccugcgggugaaaggcgcucagcaucccugguaggcagagccuugcacuggggccucccaaugcaagcaguuuucuguuuucucgaaacgagaucuuaaguagcucaggcugaccuuagcuauagauccuccugccuccaccuccugaacucugggaaucggggcauugucagcgaugccuguuuccuucaguguuuggaugacagccagagcuuuguacauuaggcaacucgcacuauuuaacucaagauggccuacaauucuuuauguagaccaggcugaccuugaaacuguagugaccuguacuguaaauagaggugcacacaccaugccagcuuauuuucacccuuuauuauuauuauuauuauuacuauuauuugacauagggucuuuguacuccaggcuggccuagaauccugaguccuccugccucugcuuccuguaaagguaugugacaccagcuucuuuuucuuuucuucuguggagauuguguaaguucccugauuggccuugaaaucucuaccuaccucaggcagguccaauguuuucagugucugugccucggcucuggagggucagggcaggggagggggaggaucacuggcaagcacugccacccccagccacacucacccucuucuuccgcucccucgucucuucccgcuucuccuuccugcgcucaucuuugcggcgcacagaugaugcgaugcuucgcggguaugucuugaccuauaggcagaagaggagccagagggaccucagagaugguaugugguugaagggcuggacccagggcagccauguccucccugacccaggccugggcacacacugaggcugagucaggcuccucaaagcggaaguuguacuuguguucaaagucuuccugcuucuucaggaauagcuccccuucaucugaggagucguccacugccagcuggacuggggggccuggagcccugaagaacaugauggagucugaugagccuggccagacauggccucauugucuccccacaaaaacucaacaaaaggggcugguaagauggccuaggggugcuugcugacaagcccuagagccugaguucgacacuaugguccacaugguggaaggagagaacugacuuccacaagugugcuguugucuuugguauacugccccacccugcaaagaggugaauguaaugaagaaaucacaaguaaucguaacuauuuuuuuuuuuuuaaaaaagauuuauuuauuuauuauauguaaguacacuguaguugucuucagauacaccagaagagggcaucagaucucacuacgggugguugugagccaccaugugguugcugggauuugaacaucggaccuucggaagagcagucgggugcucuuacccacugagccaucucaccagcccguaacuauuuuuuaaaaauacaaagggcauagagcccuuuguuaccuagccuggauaauggagaguaccugagggacacccuggaaagaagagguggcugcuuacccuuccuccuccucuuccuccuccuccuccuccuccuccuccucauagcguuuguugaggauauaaucccucaggaacuguucccccuuguccaguccuggguuguuccaguauuccuucaggugugucuaugcaaagagagggucccacaagcucaguccccuggugaggggcacagagauagccugggauggaccuaaggaucuaaaauuucacagccaagcuagaguagguaaauuaccaccccuuugugccuuuuuuucuuuuuugagacaaugucugaccguguagcccaagcuaacuaagcuaucuugucucagucucucaaguacugagauuacagauuugagcaacugagaaacuguaguccagaaacuguucaugugccuucucaaagaguaugcuguuguuuauuuuuuggugcuggaauggaauccagggacucgugcacucuagcacgaucccugagccauggccagcugcuuacugggaacagcuagccaggggcuccaccacugagccaaaucccagucccucaagaguccuuggguaucugagaagaggaggagagauaaaguaguaacaggcgauauggccugaggacauaucugaggacuuaccaguucuuucagcgacucggagcuguccauguccuuuugccccuuuagccacucaagguaguccacuuccuccugggccuguguuuuaggcaagcacucagauccucagacuccagccccagcccccagcccccagcagcccccagcacuaaccuucucuucccgacucuucgugugcuucugcagcaacccugagccaccuuccccggcacuguccucaucacugcuguccuccacaaaagcccggaagcugcaccccacggaacagacuucagcacuggugcguuacuagcccugagcuccgagcccucagggugagcccggggcaaggggcugcagauacucugcagcagcucuccugucccacccaccccagcccaggcuuaccuuuccuucagcuguuucugcucuucuacauaacucuuuguggauguuuccuacggagggauuggaugucggccccaggccugcuacagacccucacagccgcaggcagcuguuguucuaccuaccuggagccuguggucaacggucuccccaucagaguuguccucguccacauauuugcuguacaagaaacaaugggaacuugaacuguagcgcuggcacaguagugcaacacacaaggucuucagcugaaaaugggcuugcugggcauuacgucuacuuacuauuuuucccacagaaaucguuuauaugugugaauguauguaaugugugcguguaucgcaugaauauggcuacagaugucaggugccaaaaagaauaggaaaugaaaauugaagccgggcaugguggcaaaugccuuuaaucccagcacucgggaggcagaggcaggcagauuucugaguuugaggccagccuggucuacagagcuaguuccaggacagccagggcuacacagagaaacccugucucgagaaaccaaaaaaaaaaaaaaaaaagaaaaagaaaauugacagccauaaaagucauauguacccuaggguggccucaacucccuauguagagcagggugcugugacuaucagagucagccaccaugcccagcucugcucuguauuauucugagacagccucucacuguucacagaugcagcuaggcuugcuuaaccaaacucccacaauccacuaucccugccccucaaggcuggaguuacauuucccaugggugcugggggucugaacucacacucucuugcuuuaauggcgaguguucuuacccacugagucauuugguagacaccaccuccaaccccagaagacaagggauuuaggauguacuucuaccuggcuuauaacuugcuaccuaaaauucaugaccauaguccugcuccugugucuagagcgcugggguuaugugcuccugagucuggcuagaacucuuuaguuuaaaugcacuuuuuuuuuuuuaaaucuagacccuuccucugugucucucuuccuccuuuuuuuuuuuaagauuuauuuauuuauuauguguaaguacacuguagcugucuucagacacaccagaagagggcgucagaucucauuacagaugguugugagccaccaugugguugcugggauuugaacucuggaccuuuggaagagcagucgggugcucuuacccacugagccaucucaccagcccuuaaaugcacuuuuacuucacaauauuuuucuccuuucuucugucccuucuuuuuuuuuuuuuuuuguaaacagugcuggggagcaaaccaguggcuuuccucauggcaaacaagccacccacugaggccuaugcccuggaccuuuuuuuuuuuuuuuuuugguuuuuugagacaggguuucucuguauagcccuggcuguccuggaacucuguagaccaggcuggccucgaacucagaaauccacccgucucugccucccaagugcugggcuuaaaggugugccccacuaugccuuggaccuuguuuuuuaaagaauauuuauguggccagguguaguggccagccuggucuacaaagugaguuccaggacagccagggauacaaagauaaaccgucucgaaccccccccaaaagaacauuuaugugaauguauauguguucacguguuuacaugccgcauguguguggaugccucuaauguccacaagaggguauugcaucccuugggacuccaagggcacccgagagcuggaauuccaagcagaugguagcaccuggugugggugcugagaauugaacucauguccuuuggaagcacaccaagcacucuuaauugcuguguuaccuguccagcuuuuaaaaacauuagaaaacauuuuacuuuauaucauauguguauguagguguggguggguuuuuguauguaagugacgaagacaaugacauagaacccucagagucgagaugguugugaucugcuugacuugagucuaggaaccaaaugcuaagccaucucuaaagccugaggccagagaaaguuaauuacauuguauuacuguguguauacacauggaugccucagugggguacagaggucaguucucuccugcugcugcugcccgaggcccaggcacugaaguaaacaccacucccugcuaacacuccacaggccucugggguuuugaguguuaccacccagcagaggcugggccagacucuccauccuacuacuuucaccucuugaguuccuagauuagagcugaguaccuccauguuuggccucaaacuuuaaugacuuuuucuuacaauggguuuuuaucaggauugcuacacauauacccucaagguccugcuugucccagucuccuagugguggagcacugcuuuaaacuccuggugggaagguccgagacugcagggguggggagugugggggguggguggaucagaggcucugcucccaggauucccuuaauguagagguuugggguuugggcuuuucuuccuuuaacccuggcuguucuggucuugagaccaucauaucuggcuaccuugugcuuuucuaccuguaaaguccuaaauauaggccagcaacauggcucugccuggagagguauauucugugcaaaccagaggaccugaguucaagaacugugacccacguagagguaggagaaaauggauacaaagcuguccucugaccuucaaauacaugcugugguauggccaauggcccaccaacccgucuaaccacucuuucaucauacaauaauaauaaaucguaaaggugaaaauauggcuuaguaguaaagucucuuaaugcuaaacugggaggccugagguuuggucacuggagucuuggacuccacaaguccuagaauuuauccucaacuccacaugugcuguggcccuaaaucccugauagcaaaaaaaaaaaaaaaaaaaaucaagaagguuaaaagggccagccauaguggcacacagcuuuaaucccagaauucaggaggcaggagcagacggaucucugaauucuggacugcagagcuaguuccaggacagccagagcuacacagagaaaccccucuauaggaaacacaggcccugagccacccucagggucccucgggaacuggcagcugacggggaugaggcccuccuuacccuccuuucuccaagaugaccuuccucucauaguccuucagguacaugggcugcugcuucugcugcuucuccugcuuccccaaggcugcuggcggcuccuccucacucucugaagaugaggcuucggcuguaggacagugagaggacaccugcuguuguccacaacuucccccuccccccagcagagaaugcaauagggcagggcuaggagcagacuaaguucugaacccuggccugccacugccaauuguaacauagaaaagcccccuacccgguauuuauccaggggcgaguaccauauagcccaggcuauacgaaaacccacgaugugcaaaagaaacaaaucaacuacccaaacaaagucuuuaggugcagauauagcuaaauugauagugucggucuaguaaucacaaggcccugcucgauuucaguuaugcagcacagcacugaauguaaacccagcagggagaucacaaguucacucacauccuugacuacauagcaaguuaagaggccagcuugcuuacaugagcaaguaccacaaagaauaacaaagcacuuacgaccuggcacuuaagacucauggauccaagagaaagcuuuccuucuccuguauguugaugccagaggucaaauggcauccauugccucucucacucucucucucucgcucugucucucucucugucucugguuuuucaagacaggguuucacaaugucuuggccuggaacucauucuguagaccaggcuggccucugccucuggaguguuuugggauuaaaggugugcagcaccacuggcugaggcaucccgucgagccucccaggagcuguccgucuccgcuuaccuggcaccaacagcaccgaugcgugugccgaccaguuuuuuuuuuuuuuuuuuuuuuuuuuuuuugguuuuucgagacaggguuucucuauauagcccuggcuguccuggaacucacucuguagaccaggcuggccucgaacucagaaauccaccugccucugccucugccucccgagugcugggauuaaaggcgugugccaccaccgcccggcugcccaccaguuucuauccugugauuucucaggauaaagcucaggucuucagcuuagcauggcaacugcuuuaccaacccaccccauucccagccuuucuggguuuuuugacacaggaucucauuauguaacucagccuggcccugagcccugaguuaucagccuccugaguacugauuauggguuauacacugccacucugggaaggcauacacuucauucaacaacucaauuccauccacacuacgacacuuagagaagaucccccgccccaccuguucucugauagaagguagcaucuuucugguaaauucgaggguccuucuucuucagcaaggacagaguccuguaaaagucucucuccugcuggggaucaaauuccuagagcaggaaaaggaaguaggguugacuucaggaggaaguugggacacaugcagguaggguggugacauaugagaacaggcuucagcagggcccagcaaccuugaggccugaguggaggggagggaggaaaggaggagaagcauacacagugcugugucugggcagcuguggcuuugacaagaguaaaggaagcguugggcagagaagugcaaucucaauaggacacuggagccccacgugguguacuagauacugccacaucagacucuugcguuuaggaguggaaaugugguuccuagggaccacuaaucaggauggugagguaucuguggugauggaggauaaagugaagauaaaguagacaggauaugacaaucucuaggcauagggagggcucuacuggguuaguggaggaguucugaugggaagucuggagccacaucuggauaguagugaggauuugguaucuccuagauauugucacccaauggaugaggguguggaccuagauguucuuauaggacccuaugagauuaagauaaggugcucgguccuucuggggaaauaggaaggauuugguaaaucccuagauacaagggaaauggugcuuguuacucaagggauuuagaugcaauacaugggguuagggucagacucccgcuguauauauaaauuggggugcucuaggagucuugcggcuaaguuagcaaaguagguaaauucagugaccaccaggaagggccuaucugucacuuaagggauggggagggaaaucaagaacauccccauaggguaaggcaccucugugcauccaacugagagcucagugguugggaggcuuggagucucuuccagaaaggaggauguauuuggcgaucccugaguugaggaggguacugccugucacucuacgcaugggggcggguccugaagacuccgggacaaccaagcccgguuagggaaagccccauguacauggguaggacgcgaagccggguugcggaagcucaccacaugcucaucgcuggagucagacucggaacuggagucgccaccgacguccggaucuccauagcgaucuuucacuguggaauauacacgggguuccucauagcuaccaucaccagacccaguuccccacaccuuggccugcgcaggcgccccucacucacgucgcugaaguuccucacgcucgcgguaacggcuguagcgcgcagcaaacgcugcguucaccuuuaggcacccagaggcgcgcgguuccggcauggcggcugugagaccua

SEQ ID NO: 4951 - RNA, 2150 nt, Mus musculus
ucuggacugcagacuucuagacagccaaaauaucuagggucugccgggcgugguggcgcacgccuuuaaucccagcgcuugggaggcagaggcaggcggauuucugaguuccaggacagccuggucuacaaagugaguuccaggacagccagggcuauacagagaaacucuaucucgaaaaaucaaaaaaacaaaacaaaacuagggccugcagaucccauucacauaccucagcaaccaggagcuaccacaacaugucagcuaagggucaaagaccucucagcucuacuggacaagagcagugguaccugcaguggccuuucuccuuugcugcuguuccucacacuucauuucgcaggcugagugacugcacuagcuaccacucguagaauagugguagaacucuauaaucaaccagcagaguaucccacccacagaaaccugagggagaaccacgaaagaaguccuacaugucuccuuuuccagggacccuguucaggaccguguucaggacaaagaagacauguuucccgccauaggaacugggaugaaccuggcauccuccuagaagccagggauguaccugaacaaagagguaaagcggguaaaggaaggagauuuucccuucugcgccggcugggaugcucuagauaugagggggugugugcuccaacacgugcgcgcgugcgcgaggccaaagcaacagacaaaagcucgggcugggggaaaguaagcggcccguggagaggggagaguaccacagugcgugcgcaccccccgggggcagcgcccaggccugggccgagggggccacgaaggggggagaauggaugcgcgcgcacgggggcacugccuccgccauuuuguuuccucggcacaaugggggaagaguaacggccaagcgcgggagcgaggccggaggaggaaggagcgagacgcugagagauggaagagccgagcgaaggggagggucggcgggauggcaacagaccugucacuagcguccucuuggcccagccaucgcugacaagugggagaacgggaggggggaggggcggaggcgggagacgccacauugccacuuaccuugccgguguucccguccuucgccuucaggcgccgccgcccuccugccacgagccuuccggagucuucacaaccccccucaaaaaaaaaaaaaaaagccacgcgguuuucgccggggcugcuucagucccaacugcaauggcgagaaaaggaggaggaggagccggggaccgggggcgagcgagcgggcgggcgggcgcgcgccggggaggugcagggccacgugacuggcagcggcccgcccccgcaucacgugggcgauccaccuaggcccaacccccaguaggcgggugagacgaaaggggcgggggagggcacaucacgugacguugacuuagcgacugggucuguuggcgugacgucaacgucgggccaguucucucacggguuuggucggccacgugaccgugguuggcuucgcuuccaucacgugacaggccuuucuuguuguuucuugacucguuuucacuauugguagacccgaaucaccugacgggagcccauccauuucguuuguuuuuuccaaaggcgguuuuuuccgagcgaccguuaucacgugacgcaauggagcaggggugggcccuucugacgacuccaguucgugugcguuccugggagugcgcgugcgccaugauucgaagucagucuccguaccuugauccacacugcauugaaagacuggcacaugcgguugucaacacugguccagggcuccuacucacgcugucaggcugcugagccaucucaccguuccucauuuuuguauuuuugagauacaguuuugcuauuuuacccacacuggcuuuaaacucgaagauucugccuccacuuugauaucgcuagauuacaaauaagaccaugucacuaggcaacugaggguuuaauagauugccccuguguuaagagugcuuagcgccgggcagccguagcgcaggccuuaauccuagcacuugggaggcagaggcaggaggauuucugaguucgaggccagccuggucuacaaagugaguuccaggacagcuagggcuacacagagaaacccugucucgaaaaaaaaaaaaaag

SEQ ID NO: 4952 - RNA, 83489 nt, Mus musculus
gcaggaauccauagagaccaugaggacccggcuggaacggagcauccagaugcucacucugcuccgagccuuugaggcucgugaucgaaaucuucaagaagacaaccuggagcgggucaacuucuggucagcugccaauguggcuguguugcugcugguggcuguccugcaagucugcacacucaagcgcuucuuccaugacaagcgcccuguacccacguagccccugccacagaggaugagggcagcgggugugugacuugcuggacaccucccagacucagaugagacacuacauaguuggguccuuagcaguggccccaugugucucccuuccucagugaccagggagugccaauggcucacagaccccucggaagggggagggcucagcgacugugccuguuccuuggaggguggaagugcugggcgcagcaguguggggacacugcucuuggaugcccuggcuuucuccugaaaucgugccuuagcuucagucuugcagcuaucaggauggggugaagcuguggugcugccccccacccuccaacuagacaccccaacugcaaugucucugcucuccuccugggguaagccuacuucacuagggucugggaaggagacacaucugcagaguucuugccaggacagucacuuuuauuugaaaggaaggagcccuggccccuuggcccagaggggagccagcuaguaggugguuugggagaggccccuuccuucucucugggugcagggccucagagaaggcuggcccaugagccucaaggaacagagggcauuuguccugggcacuggagucaauaaauuauggucagaaaguuaauagugccuggugacugggcuuagggaugucagcuugggacagaccuagccucaagccagggcagccaggaaggggggacacucccacgaagcucagaagaaaggucgggcaggagccaauggagguggucgccuggcacgaaagaaaaagaccauaaaccauggcugaaugaacugaguccccuggucccgguggcuggcggggcugggaggagggcuuggccacagcaucgcacagagguggauagaauuccuguuucccaugagcacugugugugaggccugguacggauggggacaagaggggcucagaacagaugacacaagacucacgcguguaaaugagugugggcagccucaugagggggugcucaaucuccugagcugggacacacacaaaaggcccacacacguagccaccaguagggcuucccuuuauuuuaguuuauuaauaggauauacagaggcaggcacuuaacaguggucaauccaggcggugggagccgaggcugcagaggcacccagggcccacccuguggggacaucugguugggagccaagaggccucugaugucuccccaguucauacagcccaaaccacaaccggggcugaggagagugaggguggccagagcugaggcccuccaggccugaggaaggcacaaaggcaccucugggugcggagccugggcugggcucagcuugugugguuaauauggccaaaggagcucuauauauacaacuugagccaggugggucagcacuggaccugcugggccuggcucacuccugaggaguccuuaggaaaggugggcaguuccuggaccccagaaagaacaaaggcucuggaggagcuccagaagaguccccccacacuagccuggaccuuuuuuuccugauggucccaaggaugcaguuccuguucugcuagccagagcuccuccucaucccaaagugcaaagcccccaugugcugugcugugggccuccucacccuucauugucauguccacuagggcgaggagggaaagggcagggcuugcccacggggagccuggucccagcauggagggcaaguagcagggcccagaccaccaaaacuguccuacacugugggugcacgaggacccccccagaacauugcccccugcagccuagucgagcagggacggcucggcugggcggauaauggugggccggcugggcgcagcgggcgcucuucugcugcaaagaaaguaaagauacggggagguggaggguagugagggcagaagcagggugaggauggggacccagcccuuccagcccacccgaggggcucccagauuggggguacaagggacuaugucaaguccagauacuuuccuaguauccccaugucacuaguuugccuggguuuuauaggcaaguucucagccuugggaagagcuaguccucucccuccaucagaggguccuagagacugaacucaagucaucaggcuugguagcaagcacuugugccaucuugccugccucacugaucucagaaguggagaccagaaccuggcucaccaggcauugcugacuucagcagggucaacagugguauggugcccagggcuagugagacaugucaccugcugcuuagaggacaggcaggaacccuggcaucagcugguccacugcucuguggcacuggcugagcagggguuggccccuuuagggcucaaugucucaggacacaagcagggaugccugugcuguucuauguccuguuggggcuacacuggaagccaucagaaggggggaaaggugaaagauaccacaaagggagccuaggaugcaggucgugggccuuaccugggcacuccuggagggauaccagggggaauccgugcuggccgagaugguaucugagguggcgcagagaaggggucguuguuggcaaacacacucugugguccaggccgggaugggaugggaggugcugagaaggaggauguggcccccacaggcauaggaaucaggggaggccccgguguaggaccccgcacugcagguggccggccuggugggugcacacuggacacaggucggcgcuguggaguggggcuauggaggaaggaaaggcuguaaucuggaggaaggauauugugaacaucuaccacaagugacugagguggggguagaggcacccaccagccugagccacaccauuccauguugcugaggcuccuguguaccugacaguaaaccuccaagggacaggugugcagacugcacuugaccuucugauccacuuagagcccagccccaguccugauguaucaccucugccucuacauaucugccugcccugcuccccacuggaccuagggacugaaucuugccagguuugggcucuuccuuuuccugagggcuccacaggguccguaguggguccccuguacugacauucccuugacugccacuuuagcacuuggacugugacuaccguagugucucuggcccaucuuucccaucucgaggccaauggaguucuagguucuacaggccuucuaaaacguguucuguaccgucucuauguucuaagaggccaaccucggguaacugucuccugggcuucuugcuuuugcuuucuacuuggacccacggagaaagcacuagaagaugcaagaguugguggagaauuggggugugcgguuuucuccuccagagaucuagcucagguuggcaccuggaagccauggcuccccuguggcuuuaagcagaacagguguugugccauucacuuaagacucuugucccuuuccaaacuucagcugugaacuauuuccuaaugggacagaaggaauaggaaggguggggcuugaacuuguauaugcacauugggggacaaacugcuguccagaccuguggccgcugguguuuuggagccacgugucaucgaccggugggggcacggguguggacacggugcuggugcugauguccccaauaauguugagggccuccuucagugcgugguacaugcgcagcaugucgucccgccgcugagccugcucggcugacucuuccaugaggcugcucuggucugcugaugaauacagguaagccagcagcucaugguggaugaaggccuuugucugaggacaguggugggaaggaaaggucagaccccuauauuagccaauaacucagaagccuguugagauugggaaagcauccaucacagacugagugagagucaaguuuagcuguaaagcuucugccuagaaucucccagggaaggagcugaggugcucagucauucagugcuugccuaagaaucaccaugccuuggguucaaucuccaauaccacaaaaaccaaccaaccaaaccaaccaagcaacccaccaacacaccaagcaacccaccaacacaccaagcaacccaccaacacaccaagcagcccaccaacacaccaagcagcccaccaacacaccaaccaaccaaccuacacaccaaccacccacccacccacccacccaaccaaccaacacaccaaaaccccaaaaagcuacuaaacaaaccaacuuguucuaacuuugcacagcuuuuuaaaauuagguuugcuuuuaaguuaacaguauguauugacugugugugugugugcacgugcacgcgcgccuuuaccuucugaccccccaccccuccccccgucuuccccaguugucauugcugagacaaggucucacagugaaagcccccuacaccggcugaguaucugagaggaugguggacuugugacucuccugcuuccaccugcuggugcugggcugacuggcaugcggcuaggaucuuuggugacuuggaagcugucacucacguuguugaucaugaggugcaugauggucuuuggcauaaggucacggauggacuuguugaugauggccacguaggaguccaccagguuacggauggucuccaccugucgcuccagcugcggguccauggagaagguguucucuugugcuccauccucauucucugccugcagaggacacagagggggaugguucacugugcugggccuacccugcugacaaaugccccaccugaguguguuccagauggcccugguagaccuuguagucugcacugggguaacacugguuagagccgggggaugagaacacagccucccuuuggauggccagggucuguagugacuucaccccaaggacaagagggaaaagacaacaagguggaugaacccuaagugcucuugccguccucaccauggagaaccccuucuggagaacuucuggacccugaugacaacccaugccuccuccgcuucgcuugacucaguggguaccagcuuggugcccucugaggucugaaguaugcugcuaugguuugaauaugggaugucccuagggcucagguguuggucccuugagucucagcugacaguacuguacuucugauuuuuauguguacauugguaugguauguguauaugcagugugugugugcagguguccagaggccacagacagcugucaacugucaugugggugguggggacugaacuuggauccuuugaggaguagccauggcuucugucugcaaagccguccuuuuagaaccauacuacuguuacuugugaagcucugaaaacuucaggcugggggaaguaggccacuagguguguauccccagggauaccuuggccccagcccuuucaugccuuccccucugcuucucgcuuccgcaccucaauaccacugccaugagacagccuauacacaugggaccaugcagccauggacugagcccucuaacauugggagccaaacugaacauuucuuucccuugguguguagcagguauuuauucacuuguguuucauguauguaccuuaugugcauaucacccuuacacauugugugcauguagucuaucccaacucagugccucagaacuuuuauguuuacucugucugucugucugucugucugucugucugucugucugucuaugaaugaaugacagguucuacauaguccuggcuauccuagagcucacuauagagucaaagcuggucuugaaaugggauuaaaggugugcaucaacauaccaggaccuguuauuacauuguaucccaggccuuguagcauucaggaggcaggagcagauagaucugaguuuaaggccagccuggucuacagacuaaacuauaggcuagucagagacacacccuaaaaacaaaacacaauacauuuugagacagggacucucacugaaucuggaguuuguagguuuuucuaggcugucugguaagugggcguuagggauccauacuccccuuuucaccccaaguguguccacuuugccagacucugcaacaacuauaggcacauacgcuaucugcugugucuggcuuguuauuaguguucuuuuagauugacuuuugagucggggccucucacuaggaccuggagaucucugcugugcuauggcuggcuggcuccugagccccagugugcaccaccacacauagcuccugacugaguucuagggcuaacauucaggccucaugcuaucaccuaagccaucuccauagcaaagaaaagcugacuugacacgcuuggccuagaaaucacgggucccuuccuccaugcagggucagcagggaaggugucccuucaccuuuuccuucucuggguagaccccagcgcgcaggaacccccucaccugguccuucucuggguagaccccagcauacaggaacacuucaccugguccuucucuggguagaccccagcacacaggaaccccucaccugguccuucucuggguagaccccagcacacaggaacccccucaccugguccuucucuggguagaccccagcacgcaggaaccccucaccuuuuccuucucuggguagaccccagcacacaggaaccccucaccuuuuccuucucuggguagaccccagcacacaggaacccccucaccugguccuucucuggguagaccccagcacacaggaaccccucaccuuuuccuucucuggguagaccccagcacacaggaaccccucaccugguccuucucuggguagaccccagcgcgcaggaacccccucaccuuuuccuucucuggguagaccccagcacgcaggaacccccucaccugguccuucucuggguagaccccagcacauaggaaccccucaccuuuuccuucucuggguagaccccagcacacaggaaccccucaccuuuuccuucucuggguagaccccagcacacaggaaccccucaccugguccuucucuggguagaccccagcgcgcaggaaccccucaccuuuuccuucucuggguagaccccagcacacaggaacccccucaccugguccuucucuggguagaccccagcgcgcaggaaccccucaccuuuuccuucucuggguagaccccagcacacaggaaccccucaccuuuuccuucucuggguagaccccagcacacaggaaccccucaccugguccuucucuggguagaccccagcgcgcaggaaccccucaccuuuuccuucucuggguagaccccagcacacaggaacccccucaccugguccuucucuggguagaccccagcgcgcaggaaccccucaccugguccuucucuggguagaccccagcgugcaggaacccccucaccugguccuucucuggguagaccccagcacacaggaaccccucaccuuuuccuucucuggguagaccccagcacacaggaacccccucaccuuuuccuucucuggguagaccccagcacacaggaaccccucaccugguccuucucuggguagaccccagcacacaggaaccccucaccugguccuucucuggguagaccccagcgcgcaggaacccccucaccugguccuucucuggguagaccccagcacacaggaaccccucaccuuuuccuucucuggguagaccccagcacacaggaacccccucaccuuuuccuucucuggguagaccccagcacacaggaaccccucaccugguccuucucuggguagaccccagcacacaggaaccccucaccugguccuucucuggguagaccccagcgcgcaggaaccccucaccugguccuucucuggguagaccccagcgcgcaggaacccccucaccugguccuucucuggguagaccccagcgcgcaggaacgaagccuuccagcuguccacaucuuccugggagucacaagccaguucaaucugucgaagguccuuguagacauuccuggagugagugguagagggacuugacuggccacuaagaccaugggcucugggggcucucugccugaucuggguacgaaggugguucuaguaccuucccuaguuuguuaagagguuucugggugugucugccagguauacuauagcaccaaguaccgcacacaguccagcucuggcuuuggaucgcccacugagguguggagacacugagguguuuguaaggaagaccacagcaacaaugucuaccagaauauccuauagcagcaggaauagacucagccuacacugucugcacugucgagcccugaguaagugcauggguguaugugcaugcagaggucagaggucagcaccagacgcccuuccucacuuuaucugagcaccucacucuuuuagacagggucugucucacuggcccgaagcucacagacuugccuagaccggucagcagguuuagcgggcaccgaggauccugcuuucugccuccccagcacccugccagacguuuccuuguacugugugugaguguuguguguaugugaggguugugugugugaagguuguaugugugugaggauuguaucgugugaggguuuugugugugugugugugaagacugugugugugaaggcuauguuuuugugaggauuaugugugugaggguuguguguuugugugagggcuaugugugugugaggauugugugugaggguuguuguguguaugagaguuguaugugugugaggguugcacugaggcccucaugcuuacugcauccaugucaguugucuguccauguugcuccgcccacaccacacaggaaugucccugggauagcucugugcuaggcaagacccuggcaaagggccugcugggcuggcucuuccucaccucugcucuguguugaagauggcaaacacgugcuuguuggacaugaagcccuuuuccacgucccggaucuugagguuguccaguggcagcauguacuucuuuucuuucuccugaggagagagggcaggggucucaccugagcugccggggcagagccagcaacaaucugacagccacugccaacacccggcacuuggugugcugagagcucugucaccccacauuuacucaaacguccccuuguuguuuuuuguuuguuuuuuguuuuuuucgagacaggguuucucuauauagcccuggcuauucuggaacucaacucuguagaccaggcuguccucgaacucagaaauucgucugccucugccucccaggugcuguuuuugauuuuuuggucaaacguucccuuaacauucucucucaucccaggaccuguguacggaccgaccccguccagacuguucuugucccuacacccuguacugccccccuccuggccuuccuaggucuauaugcagaaggucccucagggcugaccucaugccacccuacuacagaugcuaugaugacugccuaccaccuggcugguccagcaguugccagaaaggaaggcugucagcuuuguuuuugauccagagaacacacaugcaguggucacucagaccucacagcccuaacuucaugccuucccagguggcucuccccauuaucugaguuauggcggcaaucacucacagggagggagacuggcgcgcaggaggcuauuucagacgccaggccugggaaacugaugccugggcaccacugucacaggagcgucaguggcuuugcuacuccaugcaugccugacaagcgcucuagcgacccaagccggggacggaacccagggucucucucaggcaagcacgaugcuggccgugcaggcaacacuccuccuccuccugcuuuugagacaggccuuccaugaaguuguguuccuccugccucccaaggagccauaacaauaggccugugacacuuuuccuuccucuucuauuuuugguuuucugagacaggguuucucuguauacuccgacuguccuggaacucacucuguagaccaggcuggccucgaacucagaaaucugccugccucugccucccaagugcugggauuaaaggcaugugccaccacugcccagcuuuuuuuggggggggggcacuuuuccuucugucugcucagauuaggaagcugucuguccagcacagagcagggacacuguguaacuaaccuaagaaugguuguagaugacaacagcucacuggggauuuucugcaccacacagacuuuuuuuuuuuuuuccagaauaaagucuccuauagcccaggguagcauucaauucccuauucagcugaagaugagcugaauuccugauccucucgcaucuugcucaccaaugcuguaaggaguuaccgcuugagccaugagucacacccaguucaugaagcacuaggaaaagcuccaacaacugagcugggccucagcccaucaccuggacauguccuccugugugugucaugugcaacacacugaggagaaccaagaggccuucauggggaagaugauguuuacuucugugagacaagugcuuuuacuaaaccuggagccagcaagccccagccuccuccucuuugcacaccuagugcugaagucccaggcacucacagcacccaugggugcgcaggugcguaaguacucuuccccacagagcacucucuccaggcucacuggagauccuucaugacucuuucucauguuucuguccacugcacgaacagaaagucccagaaagcagcuuuguggaauacaauucugaauucccccguagcucuagugcagaauggggccagucugaacacuguaugaggaacugcuguguucaagcuuugcucugccuuugaacacacugcuucuccucugcguucccgauccccaucugucugaggaaugaugaguguuacucuuggggaggguggcacaguuguggccccaguuuccagccaauucauggacuggcucccagucaaccucaccaggucugacugccugaaugaagcacaggcggagaggcugugagcagggaguguggaacacucgcacacacgcgcacgcgcgugcgcgcgcgcacacacacacacacacacacacacugcauaccgagagcuccagacagggaaggcggccugaagucugucuuguuauaagaaacaaaccugggauuuuggggauccccaaaggagccucuguuuccagaggaggguaaguucccagaagcaacucuguggccccuacccuauggugucacgagacagaaagcuuccugccagcaggccagggccaaguaaaugagucacagacaucuaggcuugccacaucuggaacuguuuaugugugauucugcccaggaucggguggcugccaucucucucucucucucuuucucucacacgcacgcacacacacacacacacacacacacacacacacacacacacacacacacgagcauacgcaugcgcuugcucgcaaaguaugcaacugcacaaggaccuccuucugcggcacgggccaucgacccaagcccuccuccagccugcuuucggauuuccugaaaaucucaacuuucuccagaugugagcaaguggccuuggccuugccacgucagaagaguucagggugcguggaugaacugaauggaggaucuugggaggagcagacucccuggccuguaccauggccacgcugaggaacugaacagccauccccgccaucccaguguucagacuaccuguucaggaggcugggacauguacaguagucugcacauugguuaggcugggcuugggccagcagcaacagugggaacuuccagaccaccuaaggugagugcuaccucucuccacuggggaagauucugggaggaggguggaaaaaguaggcccaggacugagcgagcgcugggguggggagggauguccucaggugaacugggccuuucuccuuauuuccaacgacacuguuaucuucugguuuacuccuaaaauaaagaaaaguccccugcuggucuuuaucuugggcuugucuacaagaguggucugggucucagggauggcugcuaccugggauacuuaggucccuuaccaggaccauuaaaggugucagggucuccacagccccuagaucucagugagcuucaucuuuggcauacauacagagggcuccuuucauaccucuugguggugguguggcccugcuacaggccuugucuacagugaggcccaagugccugcuuucugucuccagaugaggggaauuggaauggucauucccaguccaaaggaagaagcuugucagcuaggcccagggcuacgcuccucugcaaugaaccuugaaaacacacacacacacacacacacacacacacacacacagagucugcccagcuuucagguuacuuuucuuacagcuggagcuggaaacucaacacugggugccucauucugggggauaaucccagagucuuuguuaugcuaaaaaauauggccaggucagagccaggcaugguggcgcauaccuuuaaucccagcacuugggaggcagaggcaggcugauuucugaguuugaggccagccuggucuacaaaguaaguuccaggacagccagggcuacucagagaaacccugucucaaaaaaccaaaaccaaaaccaaaacaaaccaacaaaccaaaaaaccaacaacagcagaaacuagaccagggaagucuggccuuggggugacacuuacaccacuucagggccagggugcuggccagcuccuaagaugggaauggaaugugcauggacaggucacauaugguaccacacugaguccuugugucccuuuggugcacuggugugugugugggucucuccuacaugguggcuggaacacccuacagaggugacugcugguacaggccaccagagcacauguugggagccuggcccugacuaggaugcccccucaguucccauccagcagcagagaacugaggccagggucucuccuucagacggaaguccuccugauaaaaccucacuguaaugcaggcugcccuugaacgagcuauguuagugaaggagccugcugagugugggcaucgcaggcacgcaugcgaugcuaaguggggaugggaccaaagguuccgugcaugcuaagcuacaccaccacggccccuggcuugcuuuccuguuucuucuuuuguguggguguauacucaaguuuguguguaggcacauacucaugcaaguggaucuggaagacagagaaccacuugaggugucaucucucaggcgcugcgcucuggcuuuuugagucaggucucuuauuugccuggagccugucaaggaggcaagccuggcuggccagcaggcacugccugcggagccugcugggaauacgagcgcccuucacgccucccuuuucucuuagguucugggaugagucagagcucccguggcaggauaagcauguuaccagcuggacugucugacaggggcacuuccuacauaacuuggacaggccuggaccuuaccacuggugcugggucucagcacgucagcaugccugacuguaaacucccuuucucaagugacugggggaaugggguaaucagucuggggaccaccucccuugccuaccuuaucaggccacccuuguccccagcugcuuaccuccucauccuuguaccaagacaaugacucagcugucagcacgaaccaguacuccuuggagccacccuucaucaagcugauauuguugauggucaaccagccccugcggaucaccugguggagaggccucagcuuagcagggaggacagcccugcugcuccacccacccccuccuccccaguaaggauagaagccuggcucuguggcagcaauaccuccaccccagccaggauccuaguuccaugucaagccaagcauucccagcuaggaaucagacagggagccgggaccgcuguggggacggaugcagacagucggagggcacaucucuagcucagggacagaauggcaagccagggccccagaagccccuuggggguuacagugauguaaaugacacaggaaacaaaaaugcacguccuaggaguaacaaagggcuuaggccaggaggccagggcuagggcuggggccagacugugcagaaugugacacuggggaucugcacaagguaggcagagaugacucacuggagaacccacagcaggggacagcugugaccucuuucauggacugacccacaaaggugucucacucacacaagcucuucuguguguaggugaccagagcuagggagacagucccacccagagggcuggccagaggaccacuagagacccugaaggguccaccagagugggacuguguuucagcuagcuggaagcccagugggcacacuuuucuaugaguaacaacucaggggucucgguugagagacacaccauggaaagggcucguugggccauagcuguuaucugauggggaacagaggccaggucagccuggggacucaccugacugcuagguacaggcagccugagggggccacguuuucagauucccaugaucccugggacacggaggcacauguagaccugagccucccacccccugaccuggguacucuggggacagcaggaagcaugcagaggugacaacagggaugccugggaccaaggcagcaacagaugggccaggcugcagagcaugugacauguauagcuauggacagguggggaggcugcguuuggguuucucagguaggauggggcagaagaauccaaaauagggugucuggggcccuagaguugagguuccccuuucccuauccuguccuguuuggcucuagaguugccaaaccuaaacagggccugugcccaccuacccugcuacaguggguguguuuggguuccaagcagcaggccaugaaggccaaagcagcuaugaaagguucaggaaucccuccagccuacuuaagucccuucuugggccaagaacaacauaagcuuccacuugacaucccucaucaaagcugagggcaagaaucucucccucccugggaagucaagagaucucagacuccuagagaugccuggagccccaggagggcauaguguucgugcuagaaacagaguuacugacuuauacagauucauuccaaaacagccugggcuuagcuacgaggcuuuucagcauuccaggaaccucaauucuagaccaccuaggcuggcuggugaggcuuguaggcugacugcuuaauccuggaacucacccagccugggguccuguagccaaguucuguccugccagggauggguggcaggguccuuucagucagucuuagcccagcguaagagcuuauugaacuuagucaccacaugucaaccaagggagagaaacuuaggcccaagcuaccacuguaccccaagaagauuaauccaacauaguggggucucuguacuacuguguaacagcugugucacucugucccuuggaggucuagccuagcugccuccacuaaggauacaugagcuggcaaaauccccaaagcgccccccgccccucccacccccugccucuguagacgcccuucccuccccgcuccccacuccccccaccugugugggcacccuuccuucucugcccccugccugugugagcacccuuuccuuccagccccccgcccauguggguaccccaauguagccccagauaacaccgaucccacaaguacagacagacugauuccagggaacagcgaaggcugugccuccuuaucuccaagguagauuuggaaccuagggucacggcuguaaggaacugggugagaaggagcuaggggagguguggcaagagcagaggcagcuaggauggccauuccuggggcacaguaacggcaugcaggcaugcaggacagaaaggacccaucccaggggcuugagcagcaaguaguagcaaggcgagcucggcaggagccaugaugguuuccucucugggugaagaucacuuggaagaccaagcauggccaaggcacccgaggcuacggccggccacgcucaggaucuccaggcugugugugcuuuuguggccaggagaauggaacaagguaggaacaaugaccaccuagaagugcuacuugacugcuuugcuccaggccugaggcuaaucugguccuagaccccucuucucuaacacuggcccagguuucgacuuugacccagccugcuuuugccaggacccaggugcaacaaggacccaccacuuacacacagaaguggcucaaccuuugcaaaagucaaaacuccaagaauaucccugcagagaauggugguggcagcaggagaauauccuggagaaaggggucugucagggcuugaggccaagcugcuugcggggagcaccuccacacagacucagcuuucagcagggcugggccucacacccuucugacaaccccagcucccagcccuugagcaaaaggaagaugaguugcccacaguuaggauggcaaauacaaugcacaccaacugacugguaggaguagucuauggcaacaauucugagcacagcagaaaaggugcugggaucacucugugauaucugucccaggcaauggauaagaaaagugggaaaguggaacugaccauccagcugcuaugaaggcagcaggcuagagggaaccugauuauuuaugccuaugugaguaaaggaguaggauaucauauggaaaauuaaaaaaaaaauaaucgguggguggauaugggggacuuuugguauagcauuggaaauguaaaugaguuaaauaccuaauaaaaaauggaaaaaaaaauaaucagucacaauagcuacagaauggggagucaauggugugcauauuaagaaagaaugccaggguugauuagcagugucugcccuggguucacuguggaggaaaaucacaggaaagaguguuggaucauuuagucaugccugccacaggcacagaaaggcaaaucuccucaugugguaagccauggucuggucagucagugaugucugcaggaagagaaagaggauaaggccuggcagcaagaaugaauuccaagcugggcgugguggcgcaggccuuuaaucccagcagaggcaggcagauuucugaguucgaggccaggauggucuacaaagugagguccaggacagccagggcuauacagagaaacccugucucgaaaaaaaacaaaaaaacaaaaccaaaaaaaaaaacaaaaccaaaaaaacaaaaaaaaaaaaaaaaagaaaugaauuccagcagguccugagcaaaaucugcaugucuaggaagcugagguggggccggaggcaaugugugaaugcauauuugccaucuuugaacuacaggacaccaagagaaccugcuaggacugagcagaggggcgugucucccagagagcugcaauuggguuaguauuuuugugagagcaacagauccccaggacagcgcgagguccagugacagcggugacguguagcucccggguuagugcacguuuuaguuuuuugagcagagggugaaggcaggccuccuuuacugcuaggucucuaaguuagcuaccacacuaagcagguacuuaccaagaucucccccuuugagaauguaaaguuaggguugugggucaaucaagggagagcaggagagauggaaggggcguguagggacagagagaacgcagggaaagcacaaggguaggagaaggaagaucagaggaacaaaaaaacagcaaaagaaaaaaauuacaugcuauuaauuauauucaugguguuaauauuuaauucauuaucuucaucaaaacaaaaaaaagcaacaacauauguacuaccuauggcaagcacacauacaaaaagaaaacucaaaaucaugcauuuguuacauuucuccccaucuggcucuaaaucgugcaagauaaaacagcacagcgccccauccccaccccagucugacaugggaagggaauugggggacagugcagaaacuggacagaaaaacaagcccaaccagacacguaauacuggcaucucugaagccaucuguaaguaugcgaagccucugaagcuggggugggauuauaaaggaggccugggguucuccagccguggcauucaaaccauccccaucuucccugaguugccuguggcacuuuccaugguuucuaccuaccugccuucauuccuggggccaagaguuagaaaacauacaccucggggucacuguaacacaucuccugcuuugagggucaaguuguaacuuucacauuagaugucagaugaggccuuuggguguuugcaauuugccccaagguccuguggaagccuuaguucuaacagcuacaugacccagaagcugacagagcagccuaguacuaaggagucgguucccauaucaaaugcuaugaugagcuaaguaugcuccugucuucagaagggagugacagcagagacuggggagcuaccugauuggguauggcccucuucuuguucagcugcgugcuccucugcugggcacuguaacagaagcagagaaggcauauucagaugagacaugggagggagguaaagagaugcccuggcggcccgggcugaggugccuucccuaggggcccacugacccacuaagggcagaggcaaggccauggcuccugaacauagagaacaacuagagcacaugaaaugagaaaaguguaucuggcuaacccuggcuucuagaaccuucucauggccacuccagaagcaccagcuauuucccacaagucacuagaaguuagagcuucaaagaagagguguaagaugcaggggacugggacaggaagcugguuccaggggacccugagcacaacguaccuggggcuucuuuacauucucuucccaccacugacccuucaucagucuacaaguggcucccaucaccagcccugauaguucuagggcuuacacuggccaaauggcugcuagaaggacuugcccaaacccacuaugggagguucuugcaccuucagcuuugagaagggaaugcagcagaccaaauacaaggccucgugugugcuccccuucacagacccgcagcaacucuagcucccucuuccucucucucuuccucucucucuuccucucucucuuccucucucucuuccucucucucucucucucucucucucucucucucucucucucucucucucugucucuccagguucucacuauguagcccuggcuaucuuagaucucauguagaccaggcuggacaguuacugaaagagaucugccuuccucagcccccccaagugcugggauuguugggcuucaaguucuccaggcugccuccauaugcaguaugugaagugcuggggacgaaaacagagcuuuguguaugccaggugcucugcaugcaguggcgcuguagacagaccacacuacacuuccuguagcuacccaccacucuccuuacugauucugaugcauauucuaacaguaauauaaccaucugaaagaaaccguguccugucacucaucuguuauaguuuucuuuucuuuuuuuuuuuuuauaaagauguacaugugugggcuggugagauggcucaacagauaagagcacccgacuguucuucugaagguccugaguucaauucccagcaaccacaugguggcucacaaccaucccuaacaagaucuggcgcccucuucuggagugucugaagacagcuacaguguacuuacauauaauaaauaaauaaaucuuuaaaaaaaaaaaaaaaaaaaaaaagauguacauguguauguaugucacugugugugccugccugcaugagcuuaugugcaccacacaugugaggugugcauggaggccagagggcacuggaagccuggaguagcaggugguugugagcuaccugauguggguucugggaacagaacccagguccucugcagaaggacacaaauagcaacacacuugguuucaccaccggcuggcugcucugagauucugccuacagcucaaaccagcugaguuucaauugggaaacucaauuuaaaguuguuaagugagcguacaagccaggggccccaguggaggcuaagguaggaggagucugugccuaggcugggcuaccucaggaguucaaguagccuaaacagagacuagggagcagcaacaaagcuucagucaguugcuagaaaggcagugaguguuuggaggagaugggcucuuuauucuagacugguaaggacccacacagaugcccauuuagugcucuucugacaccacucucccagggcucggcuuuuuaucuuuauuuuuuuuggagggcacagcauugugcacacagggaucuaacuagucaugcagcuuagacagcaagcaccuuuaccugcuaaaucaucuuacuggccuuuuuuuuuuuuugagggagggagggucuccuguguuccugacuggcuucuacuucagauauauaaccaaagauaacuuuggaccaauugugcuguuucucucucucucuuccagugggcuaucacaccccuuugauuuggugcuagacuucaugcaugcuaagcaagugcucuaccaacugugccacggcagcagccaucacaggguguuuccuuuaggcccugucuauaaugagccauccugaagaaggugagacuaagcuaagccaucacucaacaguauagugacaaggggccagaugugcuacuuauguauuaugugcuacauagcucccucaaacaggagccaagauggugauggcccuaacuagagacacugggugccauggcagggucucccugaugaggggcguggucaccagcuguugucuccauccugccucacuggcugguguccugccuauugaucucccuguccaguaccagcucccugcaguccccugucagccacugcaugauuucucugcgacggucuccccagugcucaucccucaggcugcugugccacuguccacgacuccccagucugugcgcccuauacggcaggcucuauggugucuuacccagaguccucuucacaaggccuggcuggggcccugguugagagaauggcuguuguaauucaagggcuucuggaacaucccccacagguuugaggcuccccagggaggacgccccgggucacacaccagggaaaaaggcacacagcaggcaauacccacccugugaccagcuccucaguauagaaacagcuggguaagugggaaggccccggaauccagagaaagaaguggaguggucaaaggaaaaacaggagagauugugagaaggaacuguggaugaagugugagaagcagacacauugaggugaggaaacugaaagcaaccaaugggggcuacucugcugcccaugcacggcuggaagagcagggcuuaaacaggcugccuugcccagcccccaaugcagcccaccccagggaagaaaucacccagcuaagggcccuaggcuacacgugcucagggagggcuucugaucgaccagucagucauucgcuucauucauccaccaugugcccgcucagagcucaugguccaccaguucugcccagagacaauagacaguucagccuugugcccucccacuuagcacgucucuaaaacccgagcucuaaaagccccauagccacccucuggacuccaagagccuugagcggacugugucuuuuuuuuuuuuuuuuuuugguuuuucgagacaggguuucucuguauagucuuggcuguccuggaacucacuuuguagaccaggauggccuugaacucagaaaucugccugucucugccucccaagugcugggauuaaaggcgugcgccaccaccgcccggcaaguggacugugucuuaacacauggacuuccuguggacagguggaccuggccuagauuguguacugcuccagcaagggaucuggcacgaaaguacaucaguaguauagauggacacaagggucugucuuuuggugccuggugguauccuauugucuaaagcuaagaaaaucugcaugagccaccagaacacaccccccccccccccccccguggcacccaaguuugcccagcugguccagagcuuauggcugacccaggaccaauacaaucaggugugguaucuguuguuuuggcccuguggucuaauccaggucuugugcaugcuagccaagugcuaacaauggaaacaucccaccccaagguucugguuuuaagucuacagugcguauguaucuguguacagugugugaaaggcagagcccacauggugcuccagcugugaaaagcucuaagaagucaugcagaguaugaaccuggcuggccuccucuucccugagaauggccacagaguacacaccuugucccugagauguccauagacaacaugcuaggugaggacacugugacagaagucacagcacagaaagcuccaaggcacucucaaauggcucuacccuuugcccagcauccccagcagauggaugaccacucuggucuuggugcugccccucugacaauggcuguauacguacuuggcaaauccaaugaagucuucaugguuuguguugauguacgacugcucaaugucaaucagaagaagaaucuagaggaaaguaggggugugugacuacaguguacagaacagcaaggaaggcacaguacacacacacacacacagcagagggcagcagacauaacuggugcauccccccccccccugcucuccccgacaggguguagcgggcaggcuaaaucaccaggacaaggggagaucugcagguggaaaagagccacacaggaaggcugggauaaggggacagugccugguagcucaauguggugggcauggguacugccuugugggcugucuuccuugggccacggccugaccugugaccuggggccuaauguuauuaaguuauggaaguggauuggaauucauucucuucucuuucuuuuucucuuuuauugauacugccauuguugggagucaggauuuauaaauguuaggagaguguuuuaccaccacgcugcuccugagccagcuucaaaucacagcgcaucugacgucagacucgccucugggaucucaucaguucacaugcacgcacacccacgugacaacauguguguauguuauacagauacucucacagcugcacuccgaguucaagccagcaucagcccauguguggcuuucuuuucuuuccuccuuuuuuuuugagacaggauuucucuguguagcccuggcuauccuugaacucagagauccgccugccucugccucccaagugcugggauuaaugaugugcaccaacaugcuuggcuuauguguggcucuguuuucaaacauacuaauguaaaauuaagaguauggcugagggcuggagagagggccugaguucaauucucaguucucacaugguggcucccaccugucucgaacucugguuccaagggauagaugcucucuucuggccucuacaagcaccugauaugcauguagcacacacacauuacaugcagacaaaauauucauucccauaugggucuucucuguguagcucuggcuauacuggaacuugcucuguagaccauauaccuacauaugguccaccugcuucugcccuccugagugcugggaucaaaggugugcaccacuaugcuuguaugcuuggcuaauaaaucuuaaaaaaaaaaaaaaaaaaaaaaagauggaacucaguaccacacgcacuaaaagcccaaucaccucugcaggugcccagcauguguguacaugcccauaccugagacagcugcauucucaaaucuggcagacagagaugccgcuauaguccacugccaaccucauuacagcccugucugcuaggaugcuaaugguccuaguuugcaaaggcugaagucgcuccauggacuguacugacucaggcagcuuucuacccuaguuccuauuaacaacaggccaggcugccuggcagaggggcucugguuccgcuggcaaagguuucugcuggcucaaggccagacacucccuggucacugugucuuuagcuccucagugauaaccaagacaauauacacagaccuaggagguuguuggggagggcgggguguugugcagagucccugaagcuggcucuguaaggccugaacacugucuucccacagcucugcugugaagccugguaguguccacaguggaucccagaggcugugugcacaggaagagcagcagcagccucaggagcagugauggaaacaagcagaaguguucaugguguauuucggugguguauuguuuugacuuucuguuuguuuucuggggacaggguuucccagagcccaggaugaccucuaauuuaacacacagcugagaaagaccuucaacucccgauccuccugccuccaccuccugagcaaucucaagugcaccaucaguguaagguuccugaggugcugggaauagaacccagggcuauguguaugacagaagcauucuguccuuguuuuauuuugagacagucucauaauauaacccagucuguccagccuugaauucuugcucauccuauuucagucucuccauacugugaugacuccauacugugaugacaggccccuucaucaaagccauaucuccuaagccaugggguuacagagugucuaagagguccaguacuaaaugcuggcuuaaagucaaaggagccaguuuuuucaccaugacaggcccaauaugaacacuugcaguaauuuagauuuaagcaccuguaaugagaccccauaauuagauuauuuuuauucuauauguacaaggccuacauauaugacugaucacacugugcgugccuagcgcuugcaacacuaggaguaugggagcuccuggaacuggagucauagaugauugugaguaaacaugggagugcugggaacacaaucgagguccacugaggaggcauggcuccagcuccccuccugaaggguuaaugacagcucaggguauggaagugcaaggcuccagaugcccuagcauuucuccagcagguaggggcagcucuaaaacgauacaguagauucacaguagaaaaugucccaacaauggagaaagucaaccacugccaccauaggugacacauggcccucaacacugggucagaguuggaaaucacagucuccccgaagcacuauggaaaggcccggcaaagaacagaacaccuuggucuugagaaaaugaacaaagauuuaguugcauguauagaacaaucuaaucuguaguugcacaaagacauuaaugccaccugaacaaucaugguggaagacuucucaaugcauuauggggaggccaggauacagguugguggccacagauaguaauaauucguuuuuuccuuucucucuuuuuuuugggaaggugugguaggcgacacagucuccuguagcccaggcuggccuugaacucaguuauguagucaagggaugacaccgaguuucggaucuuccuaacucugcucccaaguuaggaugacaauugugccucaccacauccugacagggugcuggagguggaaacuagggcuucgcaugcuaggcaagugcuauauuagccgcaucaugguccuaggccucagaauggaucuggagcuguuaggauggcuccgcagauaaagacacuugccuuggaagccuggugaacuaaguucgacccccccacaucacccccagaaccucugcauaaagagaaggcaagaacccuccucagagauguccuccagccuccacgugcaugcuauggaaaacacaggcgagauaaacagcuguaaaccaccaaucaaagaaaacacaugguggaacuuguggcucuagcugcauauauagcauaggauggccuagugggccaucaaugggagaagaggcccuuggucuugugaagguucuaugcaaaaguauaggggaaugccagggccaggaagcaggaauggauggguuggggaucagggggaggaggaggggauaggggauuuucagaagaaacuaagaaauuugaaauguaaauaaagaaaauaucuaaaaaaaaaaaaaaaccaaaaccaaaaccaaaaccaaaaccucacaguguaagcauguuuggugcacgccuuuaaucccagcacuuggaaggcagaggcagguagauuucugaguucaaggcaagccuggucuauacacugaguuccaggaucaccagggcuauacagagaaacccugucucgaaaaaccaaacaaccaaacaaaaauaaauaaauaaauaaauaaauaaauaaauauccuuaucuuauucaaaugcugauuucuguccccauaucugguggcaaucuggacaugguacuguugucuauucuaaguaucucuugucucaauguuguguauacaguuguugguuuauucucuguuuucucaauaaaagcugaucugccaauggcugagcacuggagaguguauggcuggacuucugaccucagccaggggaggguaaagaaagagaggaaucucugugaugcucaccauaggaacauauuggaacauauaggaacauauuggagcagagagccagacacaagauacaaguaccuuggagacuauggcugggaggucgccagauuagcuucaaggauuagaacagauuaauaacuacuuagcuauugugucauauagcuugauuaaguacaucuuagagucucugacuaauuuauuuggaagccagguugaguuaaagaaaaauauuaucacuucacaaaacuaaauucucaaaauuugcuagacaugaacaaagaggaaacagagaacugguacaauaccugguccuugguucucccuucucgcucccugauguagguggugacaauucgcucggucuccucucgcagccggggguaggaacucagcuggggagcaagcacaagggcugagcugacaaggucuucauggccaggccaggggaggggaggggagccgggagacaagggcaggccagucaggggcauguggagugggaaaggcaagagggugccgugcaugcugagagccgcuugcaaagccagcgauuggagguggaaaguggcagagagggugaaugacacuuacuacccagaggugccaggcagcccccucccgcccagcacuaggugcaggcaggacaaacugauggcccucacugggcauucgaaugagcauagugcccugcuccaggauaaaaggcacagcgucggggucgcugagcucagggaacccuuugcuggaaaauauucccugaucucugugaauuuggcagccauguggccaauccucagacucccuucuuuuuaucugggguagugagugacccgagccacacuuuccccaggagaggaaagaugcugcuaaacgcaccccaaugcaggaacacacaggaggacacagugguggcaaggggugacaucuagaagugagaaugguuucacagaugugacugugcuuggacauggcaaagguuucccaacuggaccccaaaacugagagggugggacgugugcgcuguaccucccccacucagccugccacgcaaaguuccagauggcacugugcccagcagggguccccuguaggcaagguugucccgaugcucagggcugacaccaaugaagagaugauaggugggaauugaugagggacaggaggagcaagaccuguuaccuucucagcacacuuuuuaaugaccguggcuagcuccgacaccaccaggucaacacacuucaaacucggcucuuugaguuuuacaagcuguuuuuucacgauggcuucaaaggccaugucgggggugaagagccccguccuggucaugcggaggagggcgggacgagguugagagacacccagggguagugcaggccacacgcacaaaugcacacauaggacgggagauaaagagagaaagagaagaaaggagaaugagcugguuagugcauacgcagaaaagccugcacccacaucuguccuggaagcagcuugggauaagcaaggccugggggagcauaggcuggccuacagcucaaggcuaagugcuacaggacacucagcauagggccaaaggcaugugaggaaucuuaaaucaucacgucugugauaagggaccagagggugucaaucagcagccccucugggcuucaguuuuugaaauggccuuguagcacaggcuagccuccaacuuaguauauauacugaggaugaccuugaacuucuaacuuccuacuuccaacuccuggauccaguucugggaucacagguaugagccaccacaucuggucuaugggaugcuaaggauggaaccccaagcuuugugcagccagccaagcacucuacaaacucacccuaacgcuaaccccagcccuugcuuggcuggcuuauuuugcucuguuucccacuggagaagcugaggaagcaaauggggacuuugcuccaguaggacaggcagcugaagcaggugcucucugcccuuucagagcugacaaugucgagguugcacuagcagacgcccucuccuuccccucaagcacucccgcugcuuggcaggagcgugcugucccaggauacaguccucccagaggagccuggugguuugggccaaauggaggcaguugcccaugaagagugggcaugaguccucauugaagaccaugaggacugaguguggaguuaccugggagggguggggauggaacaagggcagcacagggcacagugaaggcuggcagagccacuguggaacccaaguagcucugugaagcugggcacugagcucucaguaugccaccaguguuuauguucuucccagugccaugggaacagagaagugacccacuccaaagaagcaggcauuugucauuuuucaagggggauaacagugaagcuucgggagccuuggccuccaacagcugaagaggaauacccgaucugcuucccucgcaagcagcaaagcaacacagccagaugacauccccauuccaccauacgcaugcugggcuugguaucaggaucccaggagaccugucaccagucuagcugguucuaagaagcccagcauucccccacccccuccugaguggguccagacugacacagucccaucccuguaggauucuuggaagugagguaaccuggggccugauaccaagccugcggccccgcguccgcaggugugguaccuugcuggugcacugccuaacuguacugauuagcuccuggauaaccagguccacgcauuucagacagggcucuuucagcuugaccaccugcuuuuucacaauggccucgaacgccaaauccggcgugaagagcccaguucuaaaaacguccagacccaguggggaagcagggagagauaagucagagagaaacaaaggguguggucagcaacuuucuaagcauggcuaggucccugacaaggaaaacuaucccauuaaagcuggggguaggauaccagagaguccccaacuggggagcccucaggguaacccaaggaucuugggacgcuagagaacaggguauacuucauugauugcaauuaaggaggggacaccaggaggcccacaagugacccaugaugacauggggccugugggcaugauucaagucugguuccacccaaccucuggucacuauagaucucacagaacaaggucauguauccuaggggacacaaguaaucaagagaccuaggacagucacagccaaaacacacgcacuuucucuguccuugaagacuaagauguuuauacaguucuggaaacuauccaugaaccuucuaaaggccucacuagccagggacucagaagguuggggggcccacaugaauggacaggaagagaacaugggaauuccccauggaacuugccugacuccguggauguucuuaauagcauagcugaucucucuucguagaucuuucucaucaaacuccaucugagaagaaaccaaccacacauggagccacguccagggcaccucacagcaggaacaguggcuagcucuguuucuauucaccaguguaucucacaaagaugauguagcaagcucaaacuuacaaacaacugaaggucacagagauggcucaguagguuagcguaccugccacuaagccugcagaccugagugcaucuggguguacuggucugcagagauggcuguaucugggcauacuggacugcagagauggcuuagcaguuaagagcaccggcugcuuuugcaaaggacccagguucaguucccagcacucacauaauggcucacuaaaucaauaacuccauucccugggaucuggcgccuucuuguggucauuguaggcaauugggcauguacaugguacacacagcauacacuaggcaaaauguucauaaacauaaguaaaacacuaaacuuuccagccagcagaccuaaccuacugguaccguuccagguaggugagacauccugucuaagaaaauaaggcuaagccaggcugcgguucucaugcucgccggaugcuugccacauauguguggagcucugggcccuaucuacaacacaggcaaacuggaugugcugacauucacuagccuguaauccuaccauaagggguagagggucaagaucaagcaugacuacacagccaaauaugaguuacaaugagaccuugauuuaaaaauaagugcguaguggcuagguggcagaggcagugcacaccuuuacucucagcacucaggaggcacaggcaagcagucucuagguuugaggccagccuggucuacagagugaguuccaggacaaccagggcuaacacagagaaaccaauuaggggacacugcaggcuguucucugaucuccacacuagcauacacacaccuaugaggugagagcuacggccucaaaggaaaaggacacaaagacaguuugcuuuacuuuucuguuuuguuuuuguuucaguuuuugagacagggucuuuugcaggccauguuaucuucaaacucagucuccuccugccucaacucacacaacucugcaguuacugguguaagccuagcauugugcacuuuuuuuuuuuuuuuuuuuaaagauuuauuuaaguacacuguagcggucuucagaugcaucagaagagggcgucagaucucauuacagauggucgugagccaccaugugguugcugggauucgaacucaggacuuucggaagagcagcaguugcucuuaaccacugagccaucucuucagcccucugugcacauuuguguguguugucagugccuguguguguggaggucagaggacaaccugcaguugguucugugcuucugccugcagaucacacucaggcagucgggcagagcagaggguaccugcugggcuaucucguuggcccccauguaucuuucuucccuccaccaguggaagaaacauggacuuuccuccuguucagcucagagcuucuaaauuaugagaucugggaagauggggacauguccuucagaccaaguuugcugacagcagccucugacaugaugcaggagcuuguaacaucaugguuuguaagaauuuuuaaggccaagacaaagaccaagcaugagagugucugacuuaacuccaggcugaacaccuaccuuuaccaguucaaagggaaagcgcucaugaaagauacgauugaugcgggcuccaccagacaacucuagugugucuacuugaucucccgagccuucaauucgcuucucaaaguccacuccaaacugcugaaccauccuucacgaaagaaaaggcaaaagguuaagacagaguuuucugcacggcccuguaauuacaugaaucaagagauaagcucugcucuuacaaaggcuuuaaguuacauuuguguauuggaaggaggcaugccacagucuaugaguggggucagaggagacuuaugggacucaguucucuccugcuaccagguacgucuuggggauaaaacucaggcuaucuuggcagcaagccuguuuacccgcugagccaccuugucaguccuguggcucauuuucaugggauuguuguaugugaauacagguauugcuguguaaccccaacuggcuuucaacuacagacccuucugucugggccuuccaugcuagcauuacaggcauguaugccaccauguuuggccauuuuucuuucuuuuucaauaucacuguuuaacagccaauguguaaaguaucaacgcuacuuugguaagugcugggcacuauccugguuguucucaagaccucaauagaucuguuaauacuaaaauucuagauggaauucugagggcacagcuaugcaguccuuccccaggucccaugauugacugcauggcugucugucaaggcagcugcuccagaccggcugaggagcaucuuuacuuuccgcuaccucucuaccucggucccacaggagcgacaacaugguaggcugggaaaucuugacuaaguggcucugcacugugaggcucagcuuguaucugugcagagcaggugacagggugagcaccggagaacuuggcaaccacacaaggcaucaacaguucauguaagcauaaaaaaaaaaaggaaaacgaaaaagaacauauuuuggggguaggugugguccugggauggcucaguguguaaagguacuucucacugagucugagggccacaguguuugaccucuuggaacuaaaugaugcaaggaaggaagggacucccaaaugccuaccaaguggcugaaguuugcaccaggccaccacacccaguugaucaugguauauuugcuugcucucuccuuuuucuuuuuuuuucauuuaaacagugucuuguuuucucucucucuuucgugugugugugugugugugugugugugugugcacgugcgcaggaaagaagugacuguccacugucuuuaaaucucucucuacuuuacugaauuucucccugaaggcggagcucagucugucuccccagacuggaucuccccaugacccacgggaucacgggugcacgcccucaggcuuggaggaaggguuucucuccuugcacuaggucaggagauggagcucaggcccucgacuuuaacuugcucauccacguucucagcucagcaaguuuugauuuaucuuccugccaccaccuccuaaggcccaggaugacaggcuuagauaacauaccuuguucagcuguguccaacuugagugccacaggccacaggacuacagcaacgaaugaggcacaacacacaaugacaacuuacuaaaacacugugauuaacacacaaugucaacuuacuaaaacacugugauuaacacacaauggcaacuuacuaaaaugcugggauuagcacacaaugguaacuuguugaaacaaugugacuuuucccuguuuuuuuguaaugcagguacacaguuucaggacaugaacccuacaaaugacagugucauguuaaauguccagagacuggaccccacacucgcaggggcaggguaggacaagggccugaauggagagcaggaugacugggccaggcaaggggaaggggagugaguacgcacugcagcagggcuuuggucuugcgcguggggucaucaggccggaaauucuuguacucuuccacuuccuucuccagggacagcaguuggcucugcagcuugcugcgaagggucggcagugacucucggaugugguuggucaguugcuauagaaaagguaagggucagacaggguaccacaggcccagaggccaggaaagaacacaauccacccucaggccagaauacucagucuugggugcaauccaaagagagccacaaaccuacagacaaaucauugagacggggacagaagcuggaacaaguggagcagagagccuguagcagaugucaguugacacccaaggauggggauggugggaccagugugcaggccugggauggcccucuaacuaagacucaaagguauaugcuuugagcaggacguggggccacaucugcgggagacugagggaggggagggacagagcaagagccccacugcauagcagguggauucccagcagggaaaagaaagauucugaacacaccaaugcuagaggagagcagugcagaggcuccggccugugacgagccccaagucugugggagccagguuguucugugggccuuuuagaauucuuauuuacuucugugaguacguguguugggggguaaguguacauguuagggugccuggguggaggucagagaacauggagucuacugucuccuucuaccguuccuuuaguuuggggacugaaaugaaguccucaggccugagcagcagguggcugcuauggaccacaucgcugagcucacaaacaaucaaugcuccacagagcaccucuuaauucaggggggccagccaagcuauacaccucugguucucaauagccccaggcucuguggaggguuuuccuuccugccccuccacacuuuggccagguccaguggucucugcuuuuagcccuuccuuuuuuuuuuuuuuaaagauuuauuuauuuuuuuguacaugaguacacugucacugucuucagacccaccagaagagggugucagaucccauuacacgugguugcugggaauugaacucaggaccucuggaagagcagucuuaaccacugagccaucucuccagcccccuuuaucccuuccuacaagacacacugcccaaugccugcugcaccugcucuagggaugcugcucucagcuucauucugcacuaaccuccagccacagcuaacacuugaggaauucaucugguggcucguuuaccagcuggcuuuccaguggacauucccuaaggacaauggcucucucuucaggucccaaucuaugagcaaagaggucuuugcuguuguuuuuugacucagguagacucucacuuaucccacaucacauagcugagaaugacuuuggcuuucugagcuccugagugcugggauuacaguagcaccaccacacuggauuuauucgguacuggagaugaagcccagggcuuccacauccuaggccugcacucuauugcuaaguaacacucccacugugggguucuaaacaggugcucugccaccaagccacacccccacacccucacuaggggguucuaggcaggcgcuccaguuuucucacugugucgucacugugaguaaggaggcgugaggcacagagcaguggguggauacuguuuacuguauccugucacacaaggcauguaccuuguccuggacacacauggccucacagaccccuacccuaggaaauauaagggcaagauggacaagagaaagaaggcaugggaaagccaggccaggauuugugcucaaaggcugcacaggguuagauugcaggaguccagacuacagcaaccucccauuuagcuguaguuaccagcccuugguggccucaaaccuccgcuauaccugguucaggguuuucugcaaguguggggugcccaugcggucagccaugugccgguaggcugggugggagaggaagaauuuccucucggcugccagagcagcccggauguccuuuuugcccucgaugucuuucuggcuucgguuaaccacgccgauauagccugaagaaagaaggucaagguaugcguuacgccaggaaggacauggugcuauggcuuugugcugagcuggccagguggagacuagaaacagacugguccaaaaaucacucacgagagcgggcacagggcagcacugagccccaccaagggugugaauggcauggaagguagcugaggaaagcaucgugaacuucaagggcagguaugagugggcuggaggugcaguucaacagggacugccccauguaguugacucccuuucugguccugcauuucaucccccagccuccacuagcuagggaagacucaagcagcagcagugucucuuuguuaugcuuuguuugggaagcuggggaaugagccugguuccuugcaugugcugagcaagggcuauaccacuguaguggcuauuccugguugucaacuugacuauaucuggaaugaacuacaauccagaauuggaaggcucaccagugacccuaauuuggaggcugggagauagaaguuucugaucugaaucuugguauggagaucuugaggcauaguggcuauggauuccagaagacugggaguucaaggucaucugggauuaaaggugugguggaacacaccuuuaaacuuggcuacaccuucugcuggagaccauauaaggauauuggaagaagggagucucacucuugcucuuucgccugcuugccauguggggcugaacaacugcuagguccuuggacuuccauucacagcuacuacugaacgauuguugggaauuggacugcagacuguaagucaucaauaaauuccuuuacucuauagagacuaucuauaaguucugugacucuagagaacccugaguaauacaaccacugagacucauuuccaguaacucaaucuauuucugaugaaacauucuguauuuguuuguuugaaacaaggucucauguagcccaggcugacagagaacuuucuauguagcccaagaugaccuggaauuccugaccccaaccccaccuccagagugcugggauuacagcaaguaccgagcacgaguguggcugcauaccugcuucuuaguguuccagaaaacagcuguaauguagaaacacuguguccagaggagaaccacaaaagauacaccccugaucuguggcccaccccagcccuguguacauaccucuucucaagggcaguagcuuguuuuccaggacaucccuggcgucugugccuucauccaucaagucuagcuuggugaugacaccgaugguccguaggccugaaagaguccagaggucagaagggaucaugaucaagggcccuuggggcccucuacaguccaagagacagggacaagccaugguaucuuuugccuggacaacuguuggcagaguauaaaaugacaguuacugcucuagugacagaacacugguaagcgcauaacaagaccccagcagaaccaaugaacaucacggaaacuagaauccccccugcccauucucaacaucacauuugaaccugagcaaccuggcccaauuacuacuccaaggaccagcccaucaaaguucuccccaagucaaccagaguuagcacaucccacagcaaagccacaccaccaaauaaauccacugugcuucucagccucccuugcucccggaucccuaguuugggguccugaccacgguucacccgagcaguuuauaagcugagcuuccaagccaggguagaagcccauguacuccauggacuugccuuagcauucagaaacccuaggucgacccugugccaggugaggugcggagcacuugccaaggagccugggcucuuuccuaaacaucugguuacacugagccugcaaggugugcacccgugaccucagcccucgggagguagacucaggaggaucacaaguuuaaggucaucucccacuaaacagaguuugaagccaaucuggaccacagaagauccugccuaacuaacaagaaccaccugauacauaaggaacccaggcaccggcuuggacacaccugugaauguguugccuguauguuccaugugugcaagacacacagaggcuaauggaggcccacagaagacugggaucaacuuggccaucacaggugacuaccuuagcuggcacuauugugaaguggguacaccuauaagaauucauaguugauagggaagaggccacacuauggagagaaaugaguggagaggggccugagccaugguugcccaggaagccagcugcugagaagagagacagugagggugaggagaggguaacuguacaauggggccugcccacagaguaacacacuaucacuauaauauaaaguagggcaaggcaugguggcuugcuguaaucuuaauauuugggagggggaggcagguagaaucugauacugagacugccuuggucuacacagugaaguacagguaagccagggcuacauucugaaaccaugauugaaaaauaaacaaagaaaaguugcaaucaacaaaagcaaugaccacagaggcacagacagaaauaaggagagacuguccucuuaaaaaauaaguuuacguguaagaaaaacuuugaaaggaacuguggccagcgcuaucuacauggaaaaagggagcuuugcaggcuccugauuuuuccaugguaacuuuucuguaaaaaccaugaguauuuucaaaggcaaaaaaaaaaaaaaaaaaaaaaaaaaaaaaaaaaaaaaaaaaaagaaaagaaaaaagaaaaaaagaaaagaaaaaugugcucacaaauggugaccgccugcacugcccugcuaauguuugccauggccacgcccacuguguguggacagcggacagcacggcuggaugggcuaagaagcuccugacgagggcacacagcccuaccugcagcucauucugcggccucacaggccuccucugcucaaaaccccacccggacucucccagggugugugcgcccuucucuacuuuuccagguuuuauuucuucuuguuuuuugagagagguucuccuguagcccaggcuggccucucaguguagcagaugaugaaaucuugaucccccugccuucaccucuagugugcggcaccacaccagcgucacagagugcugggauccugccugcuugacaggcacacaccaacagagcuacuccaggcccagacguucucaucucaccagauacaacugcacaaugcagacagaugugccuggaauuauaacuguguccugggagggcucugcuaaagacugggucuuauugauuuauauaugccauuaggucaacuaaguuauguguguguguaugaguguuuggugugcauguauauuuguguaccauguuguaccugcagaggccagaagagggcaucagaucccaggaauugaaaccacagauuguugugggcaucguaugggugcggggaccgaacccauguucucugcaagaacaguuaagugccagccgggcgugguggcacaugccuuuaaucccagcacucgggaggcagaggcaggcggauuucugaguucgaggccagccuggucuacaaagugagcuccaggacagccagggcuauacagagaaacccugucucgaaaaaccaaaaaaauaaaaagaacaguuaagugccauccaccaagcccuuucuagacaggguuucacugugaagcccuggcuagacuugaacucaaggggauccaccugccacugccuaucaaguucugggauuaaaggcgugugcuaccauguccagcagaaaguacucuuaacagauucucagaucaaacccagauaaucauucauucugggcaccucugaucaaacccagauaaucauucaagcugggcaccucugaacggacaaccccucacugggguuaaaucugcagacuaaaaugugggucuuaaaugucucucaaaggcccgugugcuaagcugucuguagaggagagccacugagagguggugaagugaggucuccuugaagcuuguaggucgcuggggucacuugaagcaucacacuuaaagggaucccuugucuuuuucuucuuuuuuuuguuuuguuuuguuuuguuuuuucgagacaggguuucucuguguagcccuggcuguccuggaacucacuuuguagaccaggcuggccucaaauucagaaauccaccugccucugccucccuugaccuuuucuuauuccauguugcuccccacgugcacaggaaaguguuaucugcucacaggcccagcagcaacaaaccaccaaucacaagaggacacucugaaaccaggagccuaacuaacccuguaugcucuuuaaaagacagugacucuccagggccuagcaaacacagaaguggaugcucacagucagcuaauggauggaucacagggcucccaagggaggagcuagagaaaguacccaaggagcuaaagggaacugcaacccuacagguggaacaacaauaugaacuaaccaguaccccggagcucuugacucuagcugcauauguaucagaagauggccuagucggccaucauuggaaagagaggcccauuggacacgcaaacuuuauaugccucagugcaggggaacgccagggccaaaacgugggaguggguggggaggguagugggggggaggguaugggggacuuuugggauagcauuggaaauguaaaugaggaaaauaccuaauuaaaaaaaaaaggaaaaaaaagaaaaaaaaaaagacgguggcucugucacaguguugguuauagugaugugguuacagggaaugcugaaucucaggaggcuucuaacacaacugugacagaaagcaccucagggaggggacccagcacuacuggcugcugcccagugcgggcgguuaccuuggggguccaccuccuuggccagcuugagggcgucugaguuggccaaguccauguuggcaggugugacggcaagaaugaggcugcucucgcggcugaugaacugcaggaucauguccuugaucugguacucgaugucuggcggcuggucccccaccggcaccuuagugaugccugggaggucgaugagggucaaguucaacacugagggggaaaucaacaggcaagguggugagagccccauuuagaguucagagccuacacacagccuguagaaacccaguggacaccagcaaguucccaaggggagucacaccuggggucacuccuaacacuccuacuagaacacauuucacuguguacuuucuguguugggugaguacccucaugcguacacguguguggaggucagaggucacacaaauaucuuccacaauuguucucuaccauauuuauacuuuuuaaaaauuuaauauauuuuuagagaaagagagagaaggagagugugugugugcgugcgcauguguguaagugugcauuugugucaguaugugugaguguguuuguguaucaagaaguagaagucagaggauccaugguagucagcugucuccuuaccauguggguucugggaacuaaacuuggucaccaggcuugccagaaggugucuuuaccauugagcuaucuugcuggcuucuuuugagaaaggguuuccucacugagcccagagcuacacuggguagcuacugagcaccagggauggaccaucugcccagaccugcagaguuccguaauuaaagacgugcagugcagugcagugcugcguucugcauggcugcuauaggagaaugcaagccuuucccuuguguagcaagcacucuacuucccaagccacgugucuucccaucauaccuucuucauuucugaggcagggguucgguauguagcccagacuggccuggaacucaccauguagcucaggcuauaagcccaggugguccaggacccacccaucauccacaaagcucugcuuugcauuccuagcacagcagagaccaugucugggugcacaggucuauaagugcagcacuggggagguaggaacgggggggggggggggcgacgaggaauucaaggucaacuggaccauagaagcaguucgaggcuagucugggcuacauagcuguguuuugaaagaaagggagagacagaaaauaaauagggucagugauagaguucaguggguaaagauuccuuccacuaagccugacgaccugaguuccauuacugggaccuacauggaaggaggagagaauugacuucuucaaguuguccucugaccuccacaugugcaccacauaaugugacaccacauaugcacacaaagaaaagaaaauguaaagaacuacaguaaagagaaugcagcugagugguuaccagaggaccuggcuucaacucccagcacccacaugguggcuucuaaccacugauaaguccagcuccaagggucugacucccucucugacuuccucaggcaccccaggcaugugacugguauguauacagacauccaggcaaaguacacucacauaaaguaaaauuuaaaaaaaauuaaaacaaaacuuuuuacaaaaguuuagaggagauuaguuucaaauacagucuuuaugucuacugaaugcugggauuagugguauacacaacaccacucaugguucauuuuuauguuaaaugugguccuggggguugauuccaugcaugcuacacaagugccugaccacugagccugggucuaauguuuuuugcuuuuguuggagauggggucuuccucuguccucuguccuucaccuccccagagcugggguuauaggcaugugccuaugcccacucuugcccaccauguccaagccuuccuaguccaggaugcucuucucaaaugcucaggaagacccuacuggacaggaacagaguaccagcuucccucuaucccaaccccgccuuuaccguguggugaguagacccgaagguugaugggcacaggggagaugccuuuguuggugccugugacccggucagucucugcuucgaucuccugccggacuucaucaaagucuguaaauuuuuuggacuugcagugcaaaaauuccgcauauucuguuaugggaaaaagauguucaaggugagaaggagggaaaggagaauacacaaggacaugcagugucaugcaugugccaggcaugugccaggcagaggaagaaaugcaaccacuucaguccugcagaacuugaggaacacggcguucauucuuucucuuauuuuauuggguugguuuauauuuugagauagucucacuguguaagcagcuccggccuugcacuccuuuguucaucuuugcuaggauuaaaagugugcauuagcugggcaugauggcgcacgccuuuagucccagcacuugggaggcagaggcaggcagauuucugaguucgaggccagccuggucuacagagugaguuccaggacagccagggcuacacagagaaacccugccucgaaaaaaaucgagaaaaaaaaaguguguacuaccgguucugcucugcuucugugcaugacguguucaugcacacaagcacacaggccugugguggccagagucagccucacagccuuccucuauugcuuuugugacagugccucugaacagagccuaagcucguuagcuugcccaggcuggcuggcagccgguccaucucaaccaccccagcgcugggguuacaagugugcaccccaacaaccaaccuguuauaagaguacugagucauacuuugugacuaacucuuuacugacagcuucuuuucuuuuugauaaagggauuuggucccaggcuagaguggagcucagugugugguccgggauggagugacacuugagaccccaucaccucagugagaagagcuggguacugcagcaugcaccugcaaaccucauacuuaagaggccgaggaaggagcgugagauaaacugggucacacagagcugggcaugguggcgcacgccuuuagucccagcacccgggaggcagaggcaggcggauuucugaguucaaggccagccuggucuacagagugaguuccaggacagccagggcuacacagagaaacccugucucagaaaaaaaaaaaaaacaaacaaaacugggccacacaggaaaucugucugacaaaagacaaaaagaugagcaggaguuuguguuugaacugaaggcaucagcugccaggcugggaucuagaugcuuaaauuugcucaguuaaaggcuggggaggugccaagucuugucucaaagguugcaagaacacacucugguugacacucugaggcagcaaggucuccugcagggagaaggagccaggaugagugcuguguggggcaucuaagaaacagucaccuggccauccggaguacaggaccacagggccagcugcuggaaagagagagaaugcaaagagcucagggccagaaugccuggcaggaaagacucuccacaagcagggccuuggcagucaugcaaggagccuggggcacccagcauggcauacagcaguaugguaacaagggccuguaauccaggccuguaauuccagaucuagggauguggaggcagaggguuuaggaaugugagacuggcaggcaccaguuugggcuacugugagacccugacuuaagaacuacaaagcauguggcuagagaugacucagaaguuuguugugcaaacucaaggguagaaauguggaucccagcacccacaaccaggcaucccacaaacguacauaacccucagcccaaaagggcauggggaagaggcggcucacuggggcuugcugguuuccaagucccagcaugguggugcacaccuuuaauccuacuacucaggaggcagaggcaaggagaauugcuaugaauucaaggcaggccaagguuauacugauuuaaacaaaacaggaacaaguggagagggaugaagagggcaccugacauccucccuucuccaggcucugcagcaggcaggugcacaucagcacaaauagcauacacucacagagacacacagacauggcaucugaggcucaggaggacaugggguggugcugggacuggguaggucagacaccuuguagaggaagugacucucaaacccgaugaccucagcaggaccggcucugucuagcaugggugcuagaagcagggccagugaggguguggacaggaggcucugggacucccccucagcccacacacaaucagcugacccacuucccaagggcagccgugcucuggccuuccaggagacaagcggaaauacucuuccugcagcugccacuaaaaauggaucagucacccagcccccacagaacuucaguucucuuccggaucaaggcagucagcaaaugugagaugguggcaggguaagguagcagagccaggaccaaggccagggcugggcuggcuccuucccuucucccucucccugcuugccacucauucugccuuggccuccuuuaucaucugcauucuguuuguggggcuggaaccuggcagcagagcagcagcagcagcagcucgcaggcacccaguguuugcuacaauuguuagcguaauuagcucuggagggcccuaccuucaccucaacugccuugaucagcagaacagacaaacaaaugugugugaagacagagaagagaggcagccaacaucucugccauuaaugagcagagagccccaaggugcaauguggaaaugcugggguaaaaggcugugucaucucccucucuuaacacaagagagaauccagagagggcaugccacugauacaagccacacaauaccuuuggcagguccuaacauaaaugcccgcuuuaagcucgcuggagcagcucauaccugcaggagcagucggaagccaaaggcagcauuaugaguuagaggccagccugggcuauagagcaaagccuugccuugaaaagaagcucucaaggcugacggcucagucgguaaagugcuugcuaugcaauccugagaaccugcauuugguuuacagaacucacaaaaauaagacagaugugggagugaauguuugucaccuagugcugggaagacacaugggacucacagaccagucagcccacuuuaaacauaauuccaaggcagaaagagacccugcuuccaaaaauaccccuguuaauacaugugcucaaauguuauauaaaaaagugugauccgggcagugguggcacaugccuuuaaucccagcacucgggaggcagaggcagguggauuucugaguucgaggccagccuggucuacaaagugaguucccggucagccagggcuauacagagaaacccuaucucaaagaaaaaaaaaagugugcuggauucagcugccugccaguuggucaucaguagcccaggccauaccucuaugucauugacagcucugcucauccagguccccauguuccacuggccccugggccagcacugcagcauucugauagccacauccccacuggcagcagaguggauucucccugcccuucccugcacagugaaccaguuagguucuccccuggggccucuuagcaggcuacacaggccucagcccagggccugguacacagcagggauaaaggaagaaaccaaaggugagccggggucagcagacauucugcuaagccuggugggccagccagccuucuugccagaguuccccaagggcagcaucacugugugcccaggaaaugaacugggaaggggguuucuaaggagcuucuaccugccugcaugggugugacuauaacgggcugggcuugacucacuacacuggccagcaccugcuucugcuucuuaagcauguauguagguguuggaagauggaagcacaaggaucaggacuuaaucacagcccaccaaagaggaaaccauggugacaggcuccugaugcccacgcccacaaggucugccuucuucagauuugguauuggcaugcaugucuggacaagaaugccugggugcucagacacauguuaaagacccucggacacaaccaacaaccaaauaggaucugugaaccuucugugaaccuugaggguucgaaugaaggccauaaguuccagucucaaacaaaccacaaggaggcuggagaguuggcccgacagucaugacugacuacugcuccugagggaaacugccuggugcucagcacccuugucaggaggcucaugacaccagcagcuccagcucaggaggauccaacaccacggacucuacacgcauccacacgcaugcaccuuacaacaauagaucugaaaaacacgacgggauaggacucaguuugguagagaaccuuuugaugccagcagcacaugaaccccauguggcggcaugcucaugugacugcagcaggauggggcagaggcucaagcucaccaucagcuacacauugaguuugaggcuggccuacccaacacucugacucaaaaaucaaacaaacaaacagaacagucuaaaggauuugugcaugaaggauuuuucagagccuuacacaggagcguuagcacacauucacuacuccuguuuagccuauagcuucuucagauuugagaccaguagggacugucaccuugucuaagauguacugcuacuaugauuacaagaagcaguuauuacaacuagcccccaacuugagucacaccugcuccaagcucaguuuuuucuuagacccuagcuucagguauaagcaaauucaaguccagccugagcuacaugagauucagucuuaaacaaaauucaacucaagaaagcacaguuuuaucuaacaagugacccuguggaacauggugaggagccauggcuguguuuggagagcaagacaggcugggcucuggcaagcacaggcuauguacugacaucucuuuuauggcccaucgaucauagaccaagccaggucaaggcgaaggcugaggaugggagagaaaagcccuguacccagaguuuagcaggaugauucuggguaagggcaggguucauccaugggccacuaagcuuccuggugccugugcucuuagguaauuuuuaaacaguaccagcuacuacucaaggcucaacagaccagucugaacaagaagcucccaagcacuugggugucuaaaguacugaaggggaagaccacgcuuggccucacaagccucaucuuuagacuccugaaccuuucaggagugaacagcugucugcccaaaucccuggcucuguagcuuaggucccaagcuucagugugaggaacucaugaucucuggggcucagcuauaccucccucucuggccucucuaccucugcacacacuacugcucucuaaacagcccagauacacucuuuucagccagaggaguguggugaaugcaugucugcagcaucuauuaggccagagguggggaaguggggcagccuggugacaacauaacacaugugacagaaacacagggcugcuuuccaaugucccaccaaggcugugcauaauaugggcaaugccaccauuaggcaaagggucagaggcauucaagcuuaggggacacaggacagaacacaccugagagacacaccuguccucucagcccaaaaagauccaacuaugccccuauaacugucaccuugcccuaagcagccaugccuccucccaugugacccacuuuggcacuagucuaaggucccuucuuaccauagcuauacaggucuggucuuauccccaagguaaguuccaacaaagaucuaaguaguaaacucaggcagaggugggacguuuguguucccuugaagauggagaaagucagggacugacuugauccuuuaugcaggccagcucugggcagguguuccuuucauggucuucuccccagcccuacccuagaccucaggauuccaguagacucuggcaaugaaggaaucucaaaacacaacaggucugcuagccaccagcaccccaguguucccuguacaugccagucaggcccuggguaugcuguccccgcuacucaggagguucauauagagaaucaaaaguucaaggcccaucuggaauacaaugaguucaaauccugccuagcugcaaagugagacucugucucaaaagaagugaaaauacacaguuggugggacaggcuauggcucagagugcucaucuagucugcaugaauucugggguuccauccccagcaccccaugaaccaggcagagcaguacauacuuauaaucccagcacccagcaccuggaaggcaggaagaucaggagcucaaggucacccccagauacaaguggaggucagccugagcuaacaaguacaaacaagcaagcaagcaagcaacaggcuagggauguaugucagagcacuugccuaccaugugcaaggccugaggaucugauacccucuucugaccucuacagggaccaggcacacacaugggaacagagagaaauguagggaaaacacucauacaauuaaaaauauauaaaaauuuucaaaauaaauaaaacuacaauaaagucacauacaguggcucauuagcacuguuauccuagcacucagguccaagagaaccagaggcuaacccgggcaccagcugcccugacgagcagccaaccugcagguauaacaagccuggcacacaaccaagucuuccaauugucugcacuuugcaggcaccuacaaagggaagacaggagcccgggaaagccuggcucccuucucugcagccaugcaggcuuucccaggguggccagggaccaggagcagcaacaguggcagcugauguuccaugaaaaaguacaaaaguaagccaugcagugguggugcacagcuuuaaugccagcacuuggaggcagaggcagguggaucacugugaguucgaggcuagccuggucuacagagugaguuccaggccagccacagagaaaccuugccucaaaaagccaaaaggaaaaagugcaaaauagggauuucuaaggugagguggaaccccugaaggcgaugaaagcaagcacagggauagaggucagggccuauggcagcagagcugagcacaagccugauggaagaggcagcagcccauccugugguuggcacaccaaaccagcagcuuacgcuggagccuccccuccacgccuaacugguagaaucaggagaacaacugcagggcccuggaaugucaggccgcacuggauuggcugaggaucccaggccaguggcccccuaaaaacgcagguaaccuggcugggccucaguucccaucuguaaauucauuaacaugccauacugggagcaacuggcagcaugagacuauggaucaagccucaaauaccaggcacagugguccuuccaguuggggcuggucuaugaccauacagaaaguacaaggcagcaauucugguugccaggcaagacuucucaaaaaaauaaaauaaacuaaaauaaauaaaucagaaaguaacugugggcaccagguagccugguccugccuggggacucaggguuguagaaggguguucuucaauuuauugcugcuguuugaagacaugcucuuccguagcccaagguggcccugagcucucuaugcaucacaggaugaccuggagcgucuagcccuucucacauucccggugcugggcuuacagcuaugcaccuucaggccagguucauucugcugggcggggggggugggggggguggggggguggggguggugguggggggugguggugguggugguggugguggugguggugaaagcagggcuuccgacaugccagggagcuguccacgagcugcuaccucugcgucccucgcuuuacuuauuauuucuacuuugucuugguuuugaauuucuauuucucuuuucuuuuuuuaaauuuuuuuuuuacagauuuacuuauuuuauguaugugaguacacuguugcugucuucagacacaccagaagagggcaacggaucccauuacagaugguugugagccaccaugugguugcugggaauugaacucaggaccucuggaagagcagucagugcucuuaaccaccgagccaucucuccagucccugaauuucuauuucucauaccuguuuuggaaaagaugagcugcagaaugagaggccuccgggugacaauuccugauccucguggaaggaagucccugggagaagagaaagcagcagaaaugacucagugcugcuggugaccacaggcacuaggcaacuguuuccugcaaguuuuaacaaacgcaccaaccccagcugcguuccuggaaagcccucggcuaccgaggcucugcagcccaaggucugcaggggaccugaacuaaguaggaagacacagagcuguguacacacaaucugcucuagcacuuccacuaagcccuccuugcauuguauuucagacaaucuugcccauggcaaaagagccacaagaaagacuggggaaggaucaaguucaaagccaaccgaacaaacaaccgccagucaccccaguacccuggaagcugaggcaggccagacaggacuacacagcaagaagcugucucaaaauaaaacaagggcugggguguggcucaguugguagagagcuuccccagcaggauucccagcacggaagaaaauggccaugguggcuaaugccuauaccagcuaauguagaggccaaaaaucccaaguuaggucaccaucagcacugcugcauggcuggcccacaguuaucccuguguggucucccuaacuagguguaaaaauuaguauagcugccaggcauugguggcgcaggccuuuauucccagcacucagaggcagaggcaggugugaguuccaggccagccuggucuacaaaggcagaggggggaggggagaagagggagagaagaguauggcugucuuggagccaugcacaucuucucagacauguggcccagguuacaagcuaccacagagauagacuugaaccugaacaggcaaagcugaucuuuugugauaggaaucagggcaaaggcuuuuccuuggaggaacaggcaggaagacacacaacugaacuuucuugggaggcaaaaauuagccucaaugcugaucuguacggugaucagcaguuuuuguuuuguuuugauuuaaaguuaucagaacaaucaggguguguauuuacgaugcauacuuaauugugucucucaagaaaggucacuagcagggcauaggagauaggagggucaaaaaguucauuacugccggggcgugguggugcaugccuuuaaucccaguacucgggaggcagaggcaggcggauuucugaguucuaggccagccuggucuacaaagggcuacacagagaaacccugugggggggggggggaagaauuugcaaauagauacagagugucugugaaucccaggcucaggaagaacucuggcugaguggcuuccagagacacaagugacaaucugaggggcaggagggaacucggaaguaggagacucagaaugucaagguugacuuuggcuacaacacaggugccaggucagccucaucaacuagggcuacagcucagcagcacagcaccaggcuagcaugggcagcuaauggcaccauccccaacacugcaaaggaaugaaagacaggagaggggaggaagaaaguccacugccagcaaggcugaugccugagcuuaaugcccaggacugagaugguggaaagagagagccaacccacaagugguccucugaccuccacacaugcaccacgauauacacaggagcacugauacauaugugugcacacacacuaaauaaaagaggcaugaccuguuaaaagcuucacagcucagcgggugugugugugugugugugugcugaugggccauccgacaggaggaaagguguagggggagugguguaggucaauauugaaggcccauccgacauuaguggggggugggggguguaggucaauacuaacacccauccaaaagcuuaggcagucagccacauaaaagaaaaagagucuuuuaucuucucgaaggaacuuccuccuggguggaccaaguaaggaggauuuguuuugaucuuaaagaaaacaccacugaacuacaauagagcccaaggagcgaggcaugagagggaggagacacccucuuccucaacaaugauggcuguuguaaaucuguaaacaguuauggucagugaguucaaggucauaccuggcuacagagaguuauagaccagccugaguugagacccugucucaaaaguccuaaacuaaaucaauucacuaauuuagucaaauacucuguaggcacuguggagcaguagcacaggugugacaagcaggaaguagagcacuguguggauuuaacagcacagcagggagaucccagguagcucagcugccucuucucagagaacugagugaggugcagagacugggcccugcccaaggcugcggugcaccagcaauggcagcaacucagacugaaucacaagagguccaucugaagacccugaucagcaggucccagaaucucagcuucuagucuacaaugcagccucucagagggugaaucugucccugaacacccccccccccucuccaggaccaguaacacauaacacagcagugcagugacuuuacauuuggucaaucugagaugucaggcagccugaggacaauggugacgccucagacaucaccagccucugucccagacaagggauauagagaguuucaauggugacggcugugaugcccagaacaagcuccaguucucacaaggaaagacuggggccuugguggucaaucgggaagacaacagagaaggcagaagccaaguaagagacagcagucaugucacugggcagacugggagccggcagccagagcugacgucaugcaguuucccugaacccugggacuaagcaaagugaaauggcuaaggggguaaaggcaucugcugccaaguuugaagacuuaaguuucacaaagaagaaggacagagcucuggaaaguuguccuuuagacuccacugcuuccaugccaagacuaucccucuacacacacacacacacacacacacacacacacacacacacacacuagacaucuagauaagauagguaaaauaaaaaucuaacauuuucuuucuccuguuuuaaaaaaaugggugucugauacaggugggggguggcagugcacaccuuuaaucccagcaacugggaggcagaggcaggcagaucucuuuaaauucaaggccagcuuagucuaaaaaaaaagugugugugcguguuuuucauagaaaagaaaggaaaagaaaaggaaaggaaaugagagagaaaagagaagagaagaggcuagagagauggcucagccguuaagaacacuggcugcucuuccagagguccugagucugaguucaauucccagcaaccacaugguggcucacaaccauauauaauggggucugauucucucuucuggcauccuacagauauagcacucauacacauaaauaaaaagaaaucuauuuuuaaaagggugggguguguguguguguguguguguguguguguguguguaguuggagcaauggcucagcaguuaagagcacuaguugcucuuccagaggacccagguucaauucccagcacccaacauggugacuaacagccaucucuaacuuagggaauccaucaccuucugaucucaagcaccaggcaugauacauaaacacacacacacacacacacacacaggcaaaacacuuucauacauaaaauaaaaaauucuuuuuuuaaggauguguuuauuuuuuuauuuauaugaguacaaugcagcugucuucagacacacacuagaagagugcaucgaaucccagugcagaugguugcaugucaccaugugguuguugggaauugaacucaggaccucuggaagagcagucagugcucuuaacugcugagccaucucuccagcccuucuucuucuucuuuuuuuuuaaagaguauuuccugggcagugcagcagagcacacacuauggcuucccagacagcucuccuacaaaugccaacuguccuuagcuggcagcagcaauagccuccagcuaucuaguucuuccuuccccaggccaccugccuccacaggccugaguacuuuucuuagcuguugcuaugaccuuuccuguguguccuggcugcccuaacguucuagucccacuuagccaguucugugcuaugcgacgugggucugcuuccuucucucucaggucuggguuuccugguuaguaaaacucugccaacugugagggauggcaacaaauuugugggggaugucgagaacucuggcucaaagacauccacaccucgauacguaaacguaagaucauuucucuaggccugguacagggacagcacaugguagguggucaguuaaguguaaaguguugcaucauuucucauuccgaaaaggagcugccuccuucuguuuccuucccuuuuuucuuuggcagagugacucaugcagcccaggcuggccucaaacccuauggagcagaggaugguuuguaacuccuaaccuucccggucucuacuucccaagugccaggauuacacaugugcaucaccauguuuauguagugcugauggacuugaggcuuuacacgaaugcuaggccaguauguuaauaagucacacacacaaauaccccuuccccaacacagauauucagaaagcuuuucuacaaaggucuuguguccacucagagcuggaccaauacaguccgggucuccagacuaucuagguucacuaguggcucucgccacaaaccauugaccuuugcagggguuucugccaagccacccuucccuaggggacugcccaccuaguaauagucagaggcuguauugagagccuauccuuccuuccuucccacuccugcuaguucagccucagacagaugguaguugguucuguaacagaucagagcuccugcauuuggucaagucaccagcagcuugaacagugccuuauaaaucagugucggcugcuaggauucaauguuauugaagagacagaaggcaucugagccacugcccagagagggcucuuuaucaggcccucucugggcaguggcucaguuauggcauaggaggacauccccguucacaggacuagugacagggaccauuguaaacagcuuuuccuccucagagccucuagggcucuaagccuuaggccccuuggaggaugaaaagggcuccugggaggggacaaaaaagagguagcacaacggcugauccaaaacccaggucuguuuauuuuuuucuguacagagagaguggagaagguagagacagcuaugugaaccaacagcuggaggugggucuccaggccuccagggagggaagccaaacagaagcaaggaaggaugagucagccauugcuugagaaaccuggcaggauguagguaaagguccugcguggagacccuuccccgucuccguaauuccggagaccucggagccugaagccaugagauuagaggucaugccgcauaagcuccaccugcuaucucuggcaaacugaccagggccucuggugaaggugggugugucucuucucaagugacagggugaagccuuccuguugccugcuaaacucugcacgcacagccugcuccuaucaacgccaucccugccugcccacacaggcucagucuucccccauuacaggccaaaucugacuguaagccccuuaagccucuuccucccuaccugucugucccuacaccaugcuucuaucccagcagcggccacaucauggcaggaccaagccugcucuccccaaucuccccuucuacugacccagaauugggaacaaaacaggugggaugaaggacugacucugccauuucacagacaaggacacugaagcucagguggugguaguggcaacccggcaccugccuggccaugugaguucaguucuggcgcugcuuaccacguaccacccagcuucugcccagcagucccucccuagccaggaauccggcaggacccaaaucagucccacccuuggcacucaggccuagugccaccugcucacagucacauccgagagccagccugggcggggaacaaggacaggaaauagcuagagugucuugguggcugugacuccagaacuccucaaggcccagauguaauccagaacuggauuacuucuagaacguuccuggacaaucuggucaguugggccaccucuagcucccgcagcuugcuugcuuucuuucuuucuuucuuucuuucuuucuuucuuucuuucuuucuuucuuucuuucuuucuuucuuucuuuuuuaaagauuuauuuauugauuauauguaaguacacugucgcugucuucagacacuccagaagagggagucagaucucauuauggaugguugugagccaccaugugguugcugggauuugaacuccagaccuucggaagagcagucgggugcucuuacccacugagccaucucaccagcccucccgcagcuuucuuguugguuaagcaggcacaaugacaccugccccaaagggaaguuaggauuaccaaguuuuugccauacuaucuaaaaauacaucauucuuggggcuagggagauggcuuggucacuaaguguccaccaaacaaucgugaggaaggagcaggugaggauccccaguacccacacaaagucaagcagucaugcccaccucccagcacuuggggcauggagaaagaccccugggguuuaugggacucauuagccgagcccaaagugaugaacuccauccagacucaguaaaguccccagucuaaaaaccuaugguagacaauacagcaaaagaaacccaucauccauuucuggcaggcacacccacacccaugacagcauccauccuauacaaccaaaguaaacuuggagcaaccuguaaccacuccucugcuuguaacuuucaggggguuccaccugccccccaagggccuuggaggccuugguauuacucaacgaucagccacuacucccccaucgauucccuggagcuggguugagaggaggaagagcacagcaucuuccugccucagggccucuguuuauccucacacagugaccuuucuuaugacagcucuaguuuccuguguacacuaagggcucagcuagguugucccuuccucagagaggucuagcugcuuccuggugagccaacacccaccgggcccugccagauuucuuuuuccucacuuugucagaugaucagcugcagcagaacaugaacaccuccagaauagacaggagaugaggccccucuccucagagaucugcuccccagcacacugauccaggacauagacaccacagucaaagaccagucacugcuaacaugagguaaccaugacagauagcaagauguccaagagaaagccacuaaugaccuauauguccacccagcaggagaggcuaaggcaaccggucugagaaauaguccagggccuggcacccuccaguauguggagcauagaguacgcucuguauggaggaagucuucuccauacuugggauguuuuuguguuugaugguuugcuuucuuuaucuugagguaggaucucaugcagccuaggcuuugaagccucucugaagcugaguaagagccugcacuccugaucuccugccucugcaagugcuaagaucacaggugugcagcacugugucuggcuggcagauggagcccagagauuugugcaugccagguaagcaugauagccacuaagccagccucgggggaggucaucugcuugcauccuuucuucagggagacagcuggcacauggacucaggauaacacagcaccugcuucccugggugugguggcccucaugugaugccaccacucacugguggccgguagaucuggaguucaagguuauccucaguuacacaguaagccugaggccagcugggcuccacaaaacccugccuuaaaaaaauaugagaaaacagagugguuguauauaucugaaauuucuugcacucaggaggcaggauuacuguuaguuaaagaccagccugggcuguaugagacucuaucucaaacaaaacaaaaguuauguugcagucuccaaggugaugcgaauuccaggugauugcagaucaauuuauaacuuuauaacaggcaaauaucugaccugucaucauccaguuguaucgaauagcuaaaaacauuuuacagaaugacagggaagcugucugaccuguggcgccauggcucucaacuccgcccuuucagggcccuugaugucucagaccugcucguggaagagcuguguccaugucuagcccugcccuguguccuuggcagaagacuuuuguaucgugggccaggugcugugcuguguaaaaggcagcguaagggaggaacugagagcgaucgccauuucuguggcagcuucuguguuagauggcugguggauguggauucccaacucuauggguucaacuguucccuagggaggaccaccagaacauuccauagccauucaccucacaggcugaccccuuugcagacgcuccucugacagcugcccugcucccccccccccuugucucuggauuuuuguccuccaguagcaaucacacguccuucuugccucccaguucugaaguaaccuaccugucaguuccacaaggacagggaaccaugucccaguacugucuggcacucagcgggcaauguguuugccugaguuccaucaccagaacuucauaaaauaaguauggcagcacacgcauuucaucccagcacucagauggagacaagaagaucaguagucgucauccuuagcuacaaacugaguuugagaccaaccuaggcuacaugaacccauuccaaaacaaaaaacaaacaaacaccugcuaauaaauggccuguauaggguacacacaccccacaggagcuggccugacuaugaacaagggacucuugcuguacucccaagaggcuuauccuguccccauuuugucuuuugguugucuaaagucucaaaauguagcuccagcugaucugaacccugaaucccccugacuugguauucuguacuagaacggcacauaacggcuuucucuacucacaucugguagauaaggaaucugaagcuucagguuaaaguaacucagaccaaagccacagguaaaaaccccgagcacugagacccccagcuaaacugcugcaacccugcccucagcuuuugagcacugucugcugauccccagcacaucugggagccaggguaagaagacgccagugaacucugaacacaggaggccauugccgcuuccuccugacaccaauuaagaauauggguggccacggguagagucuaaagccugauguuucagucacaggcucuccaugugugaccugcacaaggacaucacugucacagugucuccaccugcagaugggguccuaacaugugaccauguccuuaggacaccaguagaagcaggcagagguggcacaggaaucgagguguggugucggccaugugcagggugcugucacaaaggcaaugaauggugugggggcuggggggggaugucaacuccaagaaccacaagaagcacaugcccuucuccuuggcaccccugugaggacaucagcacagccuuuccugucaggugacucaacaccaccuuaaaccugcuuccuccucaacugucaccugcuuccuucagguccuucagcucacacaagucuggugacccucaggcacugucaggagaaugacaaccaagaacaaccagaaguccagguaagacagugaugagagauagugggugaggcaaagucaaggaaugccaugugauaugucaaagaacuggccagggaauuagguaaugcaaucgguguggaugucuuuugcuugugugugggugaugugagagugcacguguguaccugagcacacggacucaggcugaggucggugucuuccuccacugcccuccaccguauuuacugaggaggugucugucucuccugaauacagagauuguaggucugcucaucuagccagucagcgucuucagggacuuccuaccugcgugucccuccuaaugaaagcaggcaacuacaccuacgcagauauucaugcaagcucugaaggcccaaagucugcuccucuggcuugcauggacaaugacaaucuuuucaguaauugacaaauggccaggaagaguaacacacaccuaggaugccuguauuccagaggaauauggcaaaaauaguuuaaguccagauuagccuagguuauauagagagacagccugacuacuacccccccccacacacacacacacaaaaggugggugggauuaggcuggagagcuagcucagcaguuaagaggagccggguuugauucacagcacccauaccaccuguaacucuaguuccaaggacacccagcacacucuauuggucuccucagacacggacaugcaugugcuauacauacacauaugcaggcaaaaacucauauacacaaaauuuuaaaauccuguuuuggagggagugggguucaagacagggauucucuguguagcccuggcuguccuggaacucucuucauagacgagguuguccucaaacucauagauccgccugccucugccucccgagugcugugauuaaaggcaagugccaccacugcccagcuuaacaaauuuuuuuuuccuuuaaagaaacaaaugagguuggcacacaccuuuaucauagcacucaaaaaacauagacagguagaucucugugaguuccaggccagccagagggaagcagugagacccugucuaucccccacucccuggcaauaaagaggaaagaaacuggaaugacggaugaguagacaucaagaguauucagagugaauaccacccaaagcaacaaggcagaaagaaagccuugugcccaaauccagaagcagcagcccacucucugggcuuugucuacuuuuccuccuuucccuucaagaugggcuagaauucagggccuuucacacaccaaacuaguccuugcccacucggacaucuucccaacccucaaaggcacagagaacauucuccaaaagagacugcgugcucagcuguggcagagagcggcgggcucgaggggagggaaauguguucccuagccucagcagaaagcuaaggaagaacuaagacagagggaauugaggaaaugccaauaaauguggccagcgucagcagugcuaugccugauggcuacagaagaauuaaaagcaaacagaccaaagccucaaggccugggguuccaaagguaaaaugccccccuaggauacaggaagcccuggguccuaucccucgccccaccuaagccaggcagggcagugcacaccugcaaucccagcacugcacaggggaguagagguaggggaggcaggaguucaaggucaucuuugcauagacauugaauuggaggucaacuugguucuguuuuuuaaaaagugggggcgggggggcuuggggcgcugagaggagaggaaagauccaaaauuucccaaagaaaaaagacucagauugcuaagauuuggaauaaauguaguaauaucacaaccaaauggaaaaaaaaaaaggaagaggggcugucaagacagcucaguagguaagcaagcuugcugugcaagucagaaaccugagugugauccagaagcaauauaaagauggagagcuaacucuaaagcugcccucuguccuccauguacauacacuccuacacauagcacacucacacacacauacgcacacacgcacucacacacuagcacacacacaaaucaugaaugaaugaacuaauauuuguaaacauuuguauauuuuugagacaaggccucacucuguagccuaccuagucuggagccacuauguagaccagguucaucuugaacucacagagaucuaccugucucugacuccaucacacccagcuaagaucuguuguauuuuuauuuuaugugcaagagaguuugccugcauguaugaaugugcaccauauguaugcagugcccucagagaccacaugagggugucagaucuccaggaacuagaguuacagaggacugugagcugccaacuggguggugggaagagaaccagguccucuuaaagaacaagugccauuaaccaucucuucagucucauaaaauauuaucugaaaaagacuaaaaggacagcaugggcgaaauugaaaacccuggaggaaaaaaauuacaaagaaaccaaaaggcugaacauggugaagucucuggaggcguaaagggaauaaagggccugaauuaaguguucaaaagcuucccugcagagggcggugguggcgcugucuuuaaucuuagcacuccggaggcagaggcaggcagauuucugaguucaaggccagucuggucuacaaagugaguuccaggacagccaaggcuacagagagaaacccugucucgaaaaaacaaacaaacaaaaaaaauuacuaaaaaagcuucccuccaaaaagcccagaggcagcaacuucaugguagauuguaagagacccugaagagaaggagcaucagcucuucagagacucucccacagaauggacuggagggcacacuucugagcucacccugcaaggccagcauucuucacccgacucaggaagucagacggaagcaucaaacaguucccuuccuccuggaagcugugagcguaaaagggaguuuugugccagaggagacagggaggcccggggcauaucacaggcuauggcugcugcacuuggucacccagcagagcuaaaggguuagccccaccucugaagacaccacacucuaauggacagcuguugccucugagaaaagaaagccaucagugguccuucuggcuguggcccacaggccaccagaacaaccugucuggaaagagauguccacuggcacagcaaugauaucaggauuauuacugggguaaacuaaccacaggacauccacucuacaggaagaaacucaaugcugguucuguaaagcuggccaaaagcuggugguuagagagcuccaggauuugcgggagaauugacuacagguuuuuugucuguuuguuuguuuuggggggagggguugguuguuuguuucuuugguuucuguuuguuuguuuguuugauuguuuuugguuuguuuuuguuuuuucaagacaggguuucucuguguugccauggcugugcugaacucacuuuguagaccaggcuggccucgaacucagaaauccgccugccucugccucccaagugcugggauuaaagaugugcaccaccauagcccagcauguuucuuuguuuaaauagggucucucuauguaguacuggaacgguaauuguaaucaggguggccaugaacucagagaucucgugucugucuccugaguguggggauuaaaggcaugcuccgccaugcccagcugaaccuaccccuguuaacugacaaacuguucuaagugcuaaaguuuauaacuauugauucaggcugcucucaaucucucucagaaaagccucugcagugagcaacacuucauguggacaugaucaauauggaagagugaccgcagggugcucgggacagaucugaacaggacagcuguaucaaugcuuccaauguuucaagaaacauuuggaaucaggaacagaaagcuguuaagagggccaggcguaguggugcacgucuuuaaucccagcacucgggaggcagaggcaggcagauuucugaguucacggccagccuggucuacagagugaguuccaggacagccagggcuauacagagaaacccugucuugaaaaaccaaaaaaaaaaaaaaaaaaaaaaaaaccaaaaaccaaaaaccaaaacacaaaaaagaaagauacuaagaagccaggcauacgccucuaaucccagcacucaagaggcagguagaucucugugaggccuauacagggaguucuagaacagccaaaucuauauagagagacuguauauaaaaaaacaaaacaaaacaaaaaacaacaacaacaacgccauguguuguggugcaugccuuuaaucugaucuacagagcaaguuccaggacagguaaggguacaaaagaaucccugccuugaaaaacuuaaacaaacaaacaaauaaauaaauagcaaauaaaauaaugacaaggaggaaugcugagaaacugucuucuggacagggcacaccugcagcuacaugcagcccugcgcccugugcaggauccagccugccagcauuucauuaugcucagaggaaggggccaugagccucauccccucacccaggggcuacaggcagugaaagggcucugagaggcagugucaugagcaguaagacacacacacacacacacacacacacacacacacguacagguacacacauacaggcacacauacacaccuuuugcaagcaaccauaacuaaaucagugggaggagaggaggggcagaggggaggggaaaaagaugccucagcuaaugucuucuucuuuuuuuuuuuuuuucugaaacaggucuuucuucauacuuuggcuauccuguaacucauuauguagaucaggcuggccuugaacucauaaagaucugccagccucuaccucuggaguggucguauuaaagucauguaccacacacccaacucuucccuacuugucuauugccaugacagaacaccaugagaaaagcaauuuauaagccgggcagugguggcgcaugccuuuagucccagcacucaggaggcagaggcaggcagauuucugaguucgaggccagccuggucuacagagugaguuccaggacagccagggcuacacagagaaacccugucucgaaaaaccaaaaagaaaggcaacuuguaaaaggaagcauuugagcuggacucacaguaccagagagguaagguaguuaggcuaugaccagcaugguggggaacacugcagcagacaggcagccauagcacuggaguaguacaucugguguaggcugagaacuuacaucugaucugcaagcaagaggcagagaaugagaacuaacugggaauggugugagcuuuugaaaccuuaaagcccaccccaaaguguuuugagcaagaggguggaguauguguaguuaauauaacaaaaguuauauuuuauuuugcugauggucaucacacaagguucuaaauuccuauguucuuucuaagccuaucucccuaagguaacucaccugugcgacauaucauauuuagcugagggucaggucuaaugucuaauggaaaucugauucaagggucaggauccuuggggagacucuccagccacaugacggaucaaggugucaucucuccagaugugcagagcagagcacugcucuuggucgcuuauauacuguacaguggguaucaugggguucuagcacugugguuauucggagugagugaugucacuggguucuggcuaucaggugcagccuuggguguagugggauccugacugagcuauuucuaccugucuaaaaggcaucuuuuacuauucucaguacacucgcugacccaggccaggcuggauuagacuacaugaugagauuccaucccaaaacacaggagggcuuaggauggagucagugccagaguggcuugucgaacaugcgagcaggucaaucuccaauccccaaaaauaaguaaguaaaauugguaaaugcccggagcuuggcacagcacaggagacaguggacuccugaaaccauuaggagaggaagccaaacaggcagcuccugggaguccaaaccacacacacagacacaguaccacaagagcuugguugugggaugagccgaggugcccaaacucaggggaaggaguggcuggcgugcgugcgugcgugcgugcgcgcacaggaccuaaggcacucgcaaggcuggagccggcuggagcuccccaugaaguggcuaaguccaucucagaagaacaaucuaugcuucucuuaucuauggcuccuacuguuuuugagagagggucucucacaccuuagcccagguugaacucuuggcaaugcuccugucuccagugacccugccucagcacugaguuuugucuucaaggcauucauucuuuuguaggcguaaggcagggggaugggagaguugcuuucugccucuggcuucacugucuuucaggaaagugcgucacaggcuuuuagauccaccaguuuuaaguggcugcuagggguuuuguggauucagauugugaaaccauucucaaugauuucaggacauuugaaucuccccaagcucuacgucccccacgcgcucacucacucccucccuugccaccuccuggaagcacaacuccacucugucucggggagcuagccuguggauucguguggcuuccaaguagauucguguggcuucuguggcuggcuucuccugucugucuuucuauugguuuuugguggcuuguuguuguugcuuacuugcuuuuacaauuuuaaaaaggccuucacguacaugacauuguguuuucauauaugaguauuagacauugauuccauuccccacacuagucuucaugccucuacacuuguauuggcuuguuucucgugccucacacacacucaugacuugcugucucggcauaaacucuacgacuaugguuggcacugggcuugccuaguacauaggagccccagguuccaucuucagcccccauaaagcagaugugguuggugcuaggucaucccagcacugggaaaguaaaggcagaaagaucagaaguuuaaggccagccucuucuagguuugaggccugucugggcaacaugggacccugucucaaaaaaaccaauugcuguccacacaaagcccaggcaggccuuguccccuccuuuugcuguauguaggugcagugucucaaugagauccagcuccacagagcacuaaacaaauuguuuugguccagcuggguggggcccaggucacaguguggcaaagggcacaccuuucuccuuugcugagugacucuuggugacuaaagcaaagguggguguaaggugacacagggagauggcccagguaccugcaaagcaggaacacacccaggaagaggaagaaaccuuaggucaaacaaagagggaguauaaauguuucuaaaagaaauuacaagggggccaaugguacaguagcauagggucuugggauugcccuggggaagagacauuucccuggaagccugaaggaggcaggaagugacagagcggccugagggacaacgguggucaggaagugcagacagguucaggcugaucagggggaugauuaucaaggcuugguggggcuggaauagaauaaagaagggggcuaugauggcucagcagcaggugcugucugucaaaucuugaagacagagagaggaaggagagaagcaagucuuagaaguuguccucucaucaccaacacacacacucauauacacacucacacaaacacacacucacacucucauacauacccacucacacacacacacacacucuuucacacacucuuacacacacacacacucucacacacuuacacacacucacacacacacucccccucaugcgcauuucacguuguuaaggcuggaugugaugccacacaccuuuuagucucacauguuggaaggcagaggcauguggaccucuguaaugagucugagaacagccccgucuacauagaaaaauaaaaaagaaaaaauauacaauugcauuugugguacacaauuacugauguuuucugaguggcuauuuucuaaccaauauacuuaacacguuuccaacauuuccagcaucagggcuggagcacaggccugcaccaccaugugcuccuggguuuuggacaggcuccuacuauggggagcagggagggggagucaaaugaacaagagugaggcagcaggcaaugcaggggcguggacagcugaugaaauagcacagcaaucaaaacuaauaggaguuuggugugcacagacagaauuccccacuggggccaccugauaugucugucauucacagcacugaacaucuccaacaaggugacggccagaaccuacaccuuacccacaccugcaacuauauccucugauaccuacaucuacaaacagugcacaugaagcagaaaaaugaauaccguaaaacccuacccucccugggccuaaggcucacuuggucaagugcuugccuggcauacacaguccugagcucuguccucagcaucacacagacuuaagugcugguugcaugcuugucaugcuaacaccugggagguaaagucaagagcaccgggaguccaaggucacccucagauacaugaugauucugaagccagccuaggacaggauaggcuucgacgggucuuuauaaacagccuuuuuuauuuccuuuuuuggugcuauagauagaaacauggucuacaguugacuaggucuccaucccugagcuaucgugucuuagcuuuuuauuuuguuuaguagaaauccacaacguaacugggguuggggacccacaucuuuaagcccaguacuuggaggcugauguucaaagccagccuuguguacacagugaguuccaagacaagcagaauugcuuagugaaacucuaagaugggugauagauggauagccugacagacagacagagcaagcgauccacaagcuaacuguaaaaugggcauucagagcugggcauggugcugcaccucuaauaccagcacgcacaagccaaggcagaaggggcucaagcuccaggucagugugagaaacaaaguaagaauucuugccgggcgugguggcgcacaccuuuaaucccagcacucaggaggcagagacaggcggauuucugaguucgagaccagccuguucuacagagcgaacuccaggacagccagagcuacacagagaaacccugucucaaaaaacaaaaacaaacaaacaaacaaaaccccccaaaaccaaaaccaaaccaaacaaacaaaaauagaauucucaaaaagacaaacaaauagaaacaaaauuaauguuuaaaggacuuagaacauucaaaacaauugagaaaaagaacaaagcguccucaaggcgccugauuucaacacuaagcagagagcugcacucauaaacagauguggcuugugcagaugugggaacugcugggcagugcuccagcagcauccaaaagagacugugcccaucugacaaaagccauccaaugaaauacaagauuguacaaugcuuugcaaaagaaaaauauaaaacaacucuucaacuuuucaacuuacacuuuauaaucuauauaaaaugcaagagacagcuaggaaacgggcuucaacaguagagugcuuaucuagaaugccccaaugagggguuggagguguggcucugccccucuacccccuaauuaggggcuggaaagccgacucagcaggagggcacuugccugaaauccaucagugagaaacuagggguauuauuuaaagguggaacuccugccuagaaucccucagugaggcacugagggcguggcucagugguagaaccccugacuagaaucccauggagagagaauaggggucugguucagggguagaggccuuuccuaguauacaugaggccaugaguugcauccccagaccuagaaaaaucaaaaugaagguuggaaagucggcuuagcggcucagcaggcaaagcacuuacaugcaaacuugaggacuaacguagcgccaagcucuugugguaucugccuguaaugccaguguuugugggcagagacaggagauccccagaacaugcuggcuagccagauuagcagauuuagacaagcuuuguguaagugagagauucuuccacaguacuuaagggagacauuggacaccaaucuuuguccuucacgcaagaacccacacaugcacacaaacucacacauacacuugcguccucaugcauaaaaccuuuagggccuggauacuuacaaaggauaagauaugcaaaaccaaacccaguaacuuucaaguaaggaaacauggcagaugcccucucccugggaauguccugcuggcccacauuauggaguccuacaagaugcacaaagcggaccuaaaguaguuccuuacccaaaaugaaaaaacucacagucagcugugagaacaagccagauaagcugggagaaguuacuguuguuuguguucuaucaaaguccaaggucaugagagccuaggacggacagccugagagccuagagcagaggagggaagcaggggacaugcgauccuguguuaggagggcaacggcagccaugugacaggggccuuccaucaacagugacagucuuaacagagccugcaguagggagaggccaaggaaggcagacaugggcaacaugcccuaaauguuuuuaaauugcaucuuauugauguuucucugcuuggagguggaauugcuaugguccugaugggaggacaacuuucaggagucugcucucuuccacuauacaggucucagggaugcaccucaggucauuaggcuuggcaccaagcaccuuucucccauugagcccagccccucucuuuauaacucugcuguagccagugcacaccuuuaccuuacucccagcacucaggagacagaggcaggcagaucucugaauccggagccagccuggucuauagacagccagggcuacacaggagaacaccaucucuaauacccaaaauaauuacauuaauaacucuaauguggucuuaaagaagaagagguaacucagugguagagcccugggagcgauccccagugccaugagaaaccuuaaagccugaugugauggcaucugcugacaaucccagcacucaggcagcagagcaggaagaucaggagcccagaagugacagaaguuugaggcccagccuagauuacauaaaacuaccaacuuuuuaaaaauccaggcaugacugugguggaaaggccuacaaucccaguacuugagguugaagcagguugucggagggaaaaaaacagcaucuaggccugguguaguaacgucggcacagggaggcgacagcaggaaguacagaagcacaagccccgcccuggcugugcauuuaacuuaguuugagguuagcaaugugacaugagaccucaagaaaacuucaaagaaaagaaaaguuuaagacucaguuuucaccacaugccagggcaaaccccauguaggcccuucccuagaaaacaacuuauacccaaauccuugacagccuaugcaagacaguguccccuggcagugccaccuaggcaaaggcuacagaagccaggcuuccuuccgcuuggcugagugggaagucaacauugcaaaaugauggccaaggggaccuaaagcacaggaagacugagcugagcagggcuccagauaccggccacaggcuccuggacuugaucucuaccagccuucacuggguagccaugaggauucuagcaaccaugauguccucucaguacaguggcacacucugaaugccagcacuaauaguggaugcagaaggcucaggaauucaaggucacucucaccacuggcugguucccugcagcuaaggaugcuggggcaggcauuccagaccagaaagcuaccauccucuagaacagcaguucucaaucugugagucacaacacuuuggaggucaaacaacccuuucacaggggucacauaccagauagccugcauaucagauauuuauacuacaauucuuaacaguaacaaaaauuacaguuuugaaguaacaacaaaagucauuuuaugguugggucaucuaaagaagauugagaacaacaacucuagaaaaaccucaucuaucaguacaaaagacagaggcccugagccaggacagaguuguguacugaggccaccucuggggcuuucgaugggaauggccucugugugcugggguguauccucgguaagcagcaucacaguaggacaaugccugccugcucuccaagccaucagagucugggaacaugcguuaggagcaggcucucgggugccuccuucuucaccagggaguagggauauucccagguagccuugcuggccuugcuuacauacccguggaucacagucagaccucaccucagcuuuucuagagaaaggcagcagaggaccaagguacagugacacugccuauaaccccagcauuagggaggcuaaggcaaggacuuuucagguuugaauccagcugagcuguauagcaaaacucuguaucaaaaauaaaauaaacaaacaaaucauaggcuagggagaucaucaccauggauaaagcacuugcuggccaaacaugaguucacuuccuaaaacagaaaagccuggugagauggcucaguggguaagagcacccgacugcucuuccgaagguccggaguucaaaucccagcaaccacaugguggcucacaaccaucuguaacaagaucugacgcccucuucuggagugucugaagacagcuacaguguacuuacauauaauaaauaaauaaaucuuaaaaaaaaaaaaaaaaaaaaaaaaagaaaagccugagcacggcauaugugccugugauccuaacuccagagaaggggaaggacagacaaugagaccaggcucugagugagacgcuagcucaaaaaauuauaauuaagggucuggagagauggcucaguagcuaagagcacaggcugcucuugcagagaaacaggguucaauucccaguaaccacaagauggaucacaaccauguguaacuccaucuccaggggauccaauguccucuuccuugggugacauguacaugaaacagaaagaaauacucauacacauuuaaaaaaaaaaguuuuuaagugaaaauaguccuuggccuccaucacuccccuccacacaggcgcacauauagauacacccacgaauaccaauauagcaaugauaauaacaggacuggaaacaggcuggccauaugccaguugaggguuugccuagugugcaucaagccugaguuccaugccuagcugcacacaaagcagguauugagugcuuguaaucccagcacucagauagacauaugaagaugcagaguucuuuuuuuuuaagauuuauuuauuuauuauauguaaguacacuguaguugucuuuagacacuccagaaggagucagaucucauuacgaaugguugugagccaccaugugguugcugggauuugaacucaggaccuucggaagagcagucagagcucuuaacugcugagccaucucuccagccccagaugcagaguucaaggucacucccaguuacauguggaacucaagaccacagugccauacauuacauaaggcacagucuugagagaggggauauggugagagcgagguggcuaagaacccacggggaggaagaggaggaggcgcaagcaguguggugccaggaucggcagguucuugggagucgcugguuuuguucuacaaguggaagcugaguggcucugagcagauagguggcacaugggacauagggacaggagggaggccucuaagagaguccgaaggcauguauccaacuccaacugugaaguggcugccaccgccagggggagggcacguagccuuccccauucacacuacacucuacaaggcuccuuccaugaagugcauuuagaguccuggaacaaugagggcaaaagagcuuugaugucugucaccaaaagguccacacauaagccacagcgcacuucacagccacacaggcacaaagcacaggucagcaagucauuccacugcuucaccucagcaagaagacagcugccuccuccaagauguucugcaugccugccgcuccagccuccuacacacaggcaccuggagagccuuaagugaagcccacccaaagccuccacacacagaacuccggaccuuggcaccugggaaguuugccaaagacuuuauuccaggcucaggaggaagacugggaaaucucaguuaggggaaucuacagggacaagccucuggguaaggcccaggagagaagccaagagguuggcuucauaauacccacuccaagggauuuuugcuagugagagggagcacacaggccuccuggugugguaagcacaucaucaaggcuguagcuaacagcccaccgagagagcugcugcucucaacagcacgacuaccucagccccaacugcugcuccugcccgccucacucagcggucaggaugcuccaagcuacaacuggaaacugacguggaaagauuucuagaagugcccaggccagaaagcuaguuguagagggcuggugaaauggcucagagguuaagagcacuggcuacuacucuuccagaggauccagguucaauuccuaguacccauauggcagcugacaacuuuccaaaaacuccugcuccagggaauccaacacugucucacacagaccugcaagcagucaaaucaccaguguacauuaaaaauacauuaaaaaaaaaacagaaaacaaaaaaaacaagccuggcggugguggcacacgccuuuagucccagcacuugggaggcagaggcaggcggauuucugaguucaaggccagccuggucuacaaagugaguuccaggacagccagggcuauacagagaaacccugucucaaaaauccaaaaaaggaaaaaaaaaaaaaaaaacaccaccaacaaacaaacaaacaaaccacaaaccagcugugggcucagcgguuaagugcuacacaagaaauccagagucuggauuccuagaacccacauauaugcuaggcggauuuuguagcccgcuucugaguccaaccuagaaaggcaauggaucaaugagcuagccagacuagcuggaucagugagcucagaguuugauugagaggcccugacucaauggaugcagugggagauaccaggccuccuugggcacucaugcucacacaugaaaacacacauauacauacaugcauaccauauacaucugaaaaaaaaaaagaaaaggaaaaaggaagauuguuuuuguggacuuuguuguuauaccauuuuucccuucaguuuguuugggauuuuugagacaggucuucuguagcucaggcuagccuccacuugucugaguagaagaggcacaccuuaaacuucucucuccuccugcaccucucaggugcugggauuacagccagcuuuucuucguguuauuguucuggugcuuguuuguuugcuuguuuguuuccugaggcaaggucugacucugugccccaaacugaccuugaacuauggcuaaugcuucagccucucaaacgcugugcuuacaggcgugagcucccacacucagcuagggaaagcagcuguccagcaaucuaagcagagugaucagggugcucuguggggaagacaagggguggccuaagaacagcaggcacccuccgcugagagcgggacuccagaggggccgggaagcuggacggccugggucugcuacugugcccacucugcucuuguaauuaaaaacugacagguacuguccugagccccauguaucccaggcuaugccaaaucugcaucgggccaucagcuaaccagguaugugcagggcacucuaccuguugguccuucuguguggauacuguucugucccaccagucuccaguucaacugaggggcagccaugugacaguggaugcuaaaaccagucucacuucugacuccaugcuaucuaucaccagauuucucauucuuccagaauguuguuuaguuaccugcccacccauuuuucugucuaguuaguucugggucccugucaagucuccagcaccugguccauuaggcccaacuaaggcuugacagugaagacgcacaccugacaaccuuaaagaaaucuggcuuucaugacaaaugucaccucccucuccagucuguuucccaaccuguaacuguaacugagaaaaguauaaaagcagcaacuaucucccaaaaacuugggugggaugcagcugguagacugguucaguugccuagcaggcaacaagcccuggguuccaucccagcaaggaauaaaccagaaugaugguacacaucuggaauuccagcacacagacacaggaaagacugggaguuuaaggucacccucagcuacuuaggaaauucuaggcuagccugggcuucaugaggccccaucucaaaagaaacaggaggugugaggaagacacuuggcagucaugagcacuuacugcucuugcagaggaccacauggcagcucacaacugucugcagcuccaguuccagccuucaagggcacugcacauguguggugcacauaaacucauggaagcaugcacagagagagagagagagagaggaaguagaccuuaaagagaaacuacacggaagcaaagugcccuccuagccucuggcuaaaguuaaggcuggccucccagaaaccucuaccacacauggaagcagacuuccuuaguguagcaucuggcucaggaggcaugacaacguccuccauucgcucagcuugcagagaggccaugugagcagcucauuacugacuguauuuucuccaaaaacauugacacuuuaauaagggccuaauuacagcuagcacuuggccccuccccuguaaauuaggguucagcagaugcccaaguuucucccagcaaccaaggagccugucauuucagcauuuguauucaaaccuggcacagccuagaccagcugcagcuccaagcaacugcaagagugagagcaacgggcgucccuucgguggccagcucuuacccagcacuggaaaugcucaaucgaguccagggugguagaaccggcugccauugcagcacugggaaagugggggaggaucacaagcuugggaccagccugggguacguauaaaaaacauuguguauuaaaaacagaagaaaagccagguagugauggcagauuaaaccuuuaauccuagcacucaggaggcagaggcagacuggucucuaugaguucaaggccacccugaucuacagaguuccagaacagccaggguuacauagagaaacccuguuucaaaacacaaaacaacaaccaccaccaccaccacuauccuggugagaugcucacuggauaaagacaccugcugccaagccugaugacuugaguuggcucuaugggacccacaaaggagaggaacaacuccuacaagcuguccucugaccaccacaugcacuguaccuaccacacacaaccucugauacccacacacauaugaacacauguccaaauguaccugugcacacugccacccgugccuccugauccaaggaaaaugggagaaggucugaacaggcgaaaugcguaaagagaaaacugaccauguggaacagcccacccaagcguccagccagaggcagggaaugugccuccccaggagagaaguggccugugccaagccccacagccaucccuuuuaaaccucacuccacaguucagcuuccugacacucucaggugcgcugucagcucagaaccuguacuggcuauuuccacauccugggaugcuucuccaaucuucaggguaucuuucccaacuucucccugccucuuccccucuccguuucccagcgcuauuggacggcaccagugucuucaucuagucucugcuggaagguuauuuggcucaaggccauaacccuaggcaugaggcaaaguugugcuaagcacuggaaaacacuguccagugaacacucacuuggccuauggaagaguuauugcuauuacacguuuucuccccccccccuuacacacacacacucacacacacacacucacacacacacacucucucacacacacucacacacacacacauacacacacacacaccuauuuauuuaauucccaacagagcccacccagguuagcugaguccuggguucuaggccugaggcuggaacucuauuuuauuuuuucagggaagcaggaucucauguagcccaggcuagcagaaccagcucugcugcgaagcacaccuugaauuccugaucuucugccuccacuuuccaagcacccgguuucugugcugcuggguguggaacccccacucaugcuaagcacuugccaacugagcugcaguauugggcucccuuuuuguuuuucuuuaaaaaaauuuuuuucccgaacauuucauuuauguauccucuuugggcuugugucuccgugugcauacaucacacagaaauugcuucucugcuucuaccauuggaguucagaaaucaacccaggucaucaggcuugguggcaaaccccuuucccuacugagccaucuugccagccuucgugaaagucauagacaagugggacucggccucagugacaugcaccagguaacgcuguaaggcagucaaacacucaaggaacaaacuguaaccccacuuccuucugagauuccgauucagaaaggcaauacauucacaggaaggagucuagccuccgcuuuccaggcuggaaccccaacuuccuggguuccuguccaaaugggggugggguaggggaaaaaagcccagcuagccucuuugccagucccucaauuaaauagcaacgauuagguagaaaccaagcccuccugagagccauagcuagcucacaaagcuggcuggcucagaugcugguuucaaaugcuaacgcuucuaaaaugguaaaagcaguccugguuagaagauccagugaguuacccgugaagucagcucaccccagggugagggucucagucuuacuuuuucacuucugggggagcagacauuauaccacugccacucugcccagauuacauacagcucugucuuagagcagagaaaccuggggucuggcugccucaccuaccaugcacaaaguucucaguuccauccccaguacuacauaaacccaaacaugguggugcacuccugcaaugccagaacucagaagguaaagguaggagauccagaguucuagguuagccucagcucuauagccauuucaaugucagccaagauucaaucauuggcgcucagguaaaacgccaggcaucacuaugcacgccugucaucacagcacuguaaugguccaggcagagagaucccuggggcucgcuggccagucagccuagacuacaagugacucaaacccacaaagacgacggcuccugaggaaccaugauuaaggcugcccucugaccccacacacucauauucagacacuugugcacagacacacacucaggaaccuggggccuagaaugcccaaucaaugcccuugacuaaagucacagcuuugguagacccaugcuuggggccucaggccucuaccucauuauuacuaaaaccuucaggguaguuucaggcucuguagaaaucuggaccucaugugaaaccuguuacauuucaagcccuuggccuccagggcuagcaaucugcaugcaagucucggcaaggggcugggcccacugagcuguccuaguguacacuaauguucuuagaaaaaucuaaggcagcccugacaggaagcauuuugagcugucccuaggugcugggcuggcccaagcccuuggcacacucuccuuugcuccuggcugacaaccagaugccccuggauggauauucaagaacagcagaggaaagaaacagcacaagggucagacagacucauaguucugacucuguuuaauaaaguccauagcaggaaauaaagaaugggauugagugggccucuuggcaaaguccugcaacacagguacguuaugcauucuagaguaaaaugaacuuaaugccauaguggugugugcuugugaccccagcacuuagaaaaugaaaucggacaacugcugcuacaauucuggaggccaaccuaugcuauaguaaguuccaggucagccuggacuacaguaugagacuguuucaaaauaaacaaacaaaaauuuuuuuaaaauuaaaaaacaaaaaaccaaaauaacccccacccaggaacggugcuguaugccuuugaucccagcacucaggagguagaacuaggugcaucccuguauguucaaggccagccugucuacauucugagaugcuuuuuaaaacauugaucaauagcuaggcuugguggacuugccuuuaaucucaucacuugagagguagaggcaagucucucaguuagaggccagccuggccuauaaagguggcuccaggacagccaggcucuguuacucagagaaacacugucucaaaaaaaccaaaaaacaaauagauaaauaaacgaacaaacaaacaaacaaacagggauauguguauauacauauacauaaaauuuuuauuucauuaccuaaaagccauagguguuuuugaguaugaaugcaaucaaagagaacauaaauaucaacaauauuucuuauuaguuuggugcugggaacugaccccugggucuuauucaugcuaggcaaguacuccaugcccgagcgucaccacacagcccucucauggcuuuuuuuuuuuuuuuuggagacaggacuaacaauggagcccauguugaacucaaacucaagaaaucuccugccucagacucccaaaauccuaagaucacaggugcagcuaauucaaccuaaauguacacuuccaaguacccagucccugcagucuugaaucaacuuuugagguuuuuuugagacugggucucaauauguagcccuagcugcccuagaacucuacucuauguagagugagcuagccucaaauuuagagauguucugccuccacaaaagacugguaacaacaauaacagagggugugugugugagugugugugugugacccaaugauagggugagacagagagagguggaucccuggagcucacuggccagcgagaauagcugagugagaucaguuagcugcauggugugugugugugugugugugugugugugugugagagagagagagagagagagagagagagagagagagacccaaugagaucggugagcugcauggucagugagagaccaugucucuacaauuuaagauggaaggacaaugacauagcucaauggauacuaggacuugcuauauaagucugcggcccgguguuuaauccccacauaaauuuugaaggacuucacaaagauuaugcccucugacuuccacaaaugcacucuggcacacacuuggacacacacacacacacacacacacacacacaaugauaauguccacagcaaagcaaauguuaacacuggguaggcacacacugcagcaucauacauggaacacuuccuggaauggagaagugcugcugcggggagaggcagagggggaggggacaggaguaaaucaacaucccuccuucacucacuuccuggauccuacaaacagcugcaaguggaauuugcccacuggacagauggaacaagcugaggcucccagagcuaucuagagagcauuccaacugggaagcucuagguuaggggauccuagcccaagaaagaauccuaaagaauguuucuucccaaguucuccaaccucugucacucagagaggauggacaggcagggaugccugggugggaauggagaacagacuaauggauggauucaaagagccagucggcccaagagaaccagauaacaggaggcucccaaaguucagccagucagauggcagaggccaacucacguaaauaaggggcacagaugggcauuugcacacgagaggucaccuuagauggcuagccagacaacgguggacuucagagugaguuuggacagaugggacaaccaaauggugccgguaggaagccugucuagaacagauaaccagcuaaccaggcaagagagcaggcuccagaaaauaacuggccagacagaccccaggggucauuccccauggauggcuaaguggcaaguguuaucuucaacaucuuagcacacacacuaagauuuccagguagcagaaggaaagaggaguggaucuaucccggacuacagguaaagcgaugucagaguugcccagccauagccggaacuagaagcaccaagaggggucggcacugaccgucuugccccaaacaccgcccacuaucaucgacuagucccagacuuggaucugcaucuccagucccugcggaaagccauggagacucuugccccagaccuuauccacugccaccggugcugcggcguccgcgagccgcaguuccgccauuccccgcccgcccuccgcgcccuaggccgccgcccgcccucccggccggagccccagaaccgccgccggcgcgcucgcucaccggcccacgaaguucucgagcaccgaacuuuugccggcgcucuggccgcccaccacggcgaucugcggcagguccagguggcagcucugaccgauggagcugaaggcguccugcagcuuguuaaccagcgggaugagcucuuccaucccgcgguugcccaugguguccgccuccgccgcgcggaucccccgacuaagacucucgguuccgaugugucuguggccguugcuuccuccugcucugcucugccggcccgcccggucuccccuucgccgcgacgcccgcucccggcucggccucagagucgccgccucauccgguucucaggcgacacccgacccgagcgaaca

SEQ ID NO: 4953 - RNA, 2927 nt, Mus musculus
gugggcaggacaaauccuuaaaggguccacgccccgugaguagagggugacccggaugauggcggccggcgcggccguagcacuggcccuguggcuacuccugccagcaguaggagugggagaggcagggccgccgccuauccaggacggcgaguucacauuucugcuucccgccgggagaaagcaguguuucuaucaguccgcaccggccaaugcuagucuugagaccgaguaccaggugagagagggggucccgggcucggaauagagcagggcugggggcguggccaacaggcgggaggggcggggcagagguguggccagaacgcuaauagucuugcagagaaggggcaugcucugcucagagcucuuuggguuggguucuagggaaguuccuggcggcuguuggguagguuacgauuaaguuagcggucagguagacagccaccuuagacuacucaagggcguuggcagggugguugauaaaagaccucacguggauguauccaucuuagggacugggaagaaaccuuguagguguggauggauguuggucuucagauaggcccuugggggaauccaaauagcuugcuggguuaaaacaaaacaaaacaaaacaaaaaccgcuugcugcuaaacuacgacgacccgaguuuccuaacucuaugguagaagugcagcucugacuaaucucccuccacaggcgcuacuccucuaucucaagcaaauaccugggauuugugguuguucuuuuuucuucuuaaagauagguucuuggugaucuuacaugggucuuucccgguucgguuuaacccaggcuuucuguggcagauaggcuugcacaaagcugccaguuccccaauucuuaccugcucuucaggugaucggaggugcugggcuggacguggacuucaccuuggagagcccucagggugugcuguuggucagugagucucgaaaggcugaugggguacacacgugagugaaguccugcccugccuugguucaguuacagcccugcagcuccccaguggccucagguuaccauccuacugguuccacagaccagcuggcuggucacuccagggucacgucuaugucucaucugucugcccaggguggagccuacugaggccggagacuacaggcugugcuuugacaacuccuucagcaccaucucagaaaagcuuguguucuuugagcucaucuuugacagcuuccaagaugaggaggagguagaagguugggcggaggcuguggagccagaagagaugcuugaugucaaaauggaagacaucaaggugagcuggguaugauggugcaugcuuagaaucccaguucugaggaggcugaggcaggaugccagugaguucaagaccaaccuuauuuacauagcaagcucccgucucacaaaaccaacagaaagggccgggaauaauugaguuggcagagcacuuaccuaggacgcucccacagcugagcccccacacccagcacugcacacacuggguaugguucucuugguccugaggaucacaaguucaaggucauccuuggcuugcacagacuagcagaguuuggugaaguggcuugauaggcaaaggcaacugcaccaagccuggcuaccuggggucgucugccaugcacgugugccccaaucccucuuaaaaagaaaagucucacacccacccaaaaaacaaaaaaaaaaacaccaaggggaaaaccccucaguuucuagagaagacgugaggcaggugaacggauagccagagccgugcguggugggguagguaggcauucugacuuaagcagccugacccguuccuuugugcccuggcaggaauccauagagaccaugaggacccggcuggaacggagcauccagaugcucacucugcuccgagccuuugaggcucgugaucgaaaucuucaagaagacaaccuggagcgggucaacuucuggucagcugccaauguggcuguguugcugcugguggcuguccugcaagucugcacacucaagcgcuucuuccaugacaagcgcccuguacccacguagccccugccacagaggaugagggcagcgggugugugacuugcuggacaccucccagacucagaugagacacuacauaguuggguccuuagcaguggccccaugugucucccuuccucagugaccagggagugccaauggcucacagaccccucggaagggggagggcucagcgacugugccuguuccuuggaggguggaagugcugggcgcagcaguguggggacacugcucuuggaugcccuggcuuucuccugaaaucgugccuuagcuucagucuugcagcuaucaggauggggugaagcuguggugcugccccccacccuccaacuagacaccccaacugcaaugucucugcucuccuccugggguaagccuacuucacuagggucugggaaggagacacaucugcagaguucuugccaggacagucacuuuuauuugaaaggaaggagcccuggccccuuggcccagaggggagccagcuaguaggugguuugggagaggccccuuccuucucucugggugcagggccucagagaaggcuggcccaugagccucaaggaacagagggcauuuguccugggcacuggagucaauaaauuauggucagaaaguuaauagugccuggugacugggcuuagggaugucagcuugggacagaccuagccucaagccagggcagccaggaaggggggacacucccacgaagcucagaagaaaggucgggcaggagccaauggagguggucgccuggcacgaaagaaaaagaccauaaaccauggcugaaugaacugaguccccuggucccgguggcuggcggggcugggaggagggcuuggccacagcaucgcacagagguggauagaau

SEQ ID NO: 4954 - RNA, 5837 nt, Mus musculus
cacagaauuucaccgcuucccggacacuuagccgcccgcguugcuguuugaguguucaagggacgacccacgcccuuccacacccugggucgccuucugacgcuuuccuuuccaccuccaaagcaaaacagaaguaugcgaagcccccucccacccccgaccccuacacuucuugcagcaaguuugcuuuccugucuaggaaugggcacauagauuucugacccaaguacaguugcagguuuuaucuggauccguccauaaacacaaacacucagcgagaaauguauauaaaacgcggcggcgugugcgggugagcgaguuggcucagugggugagggugcaagccugaagaccugaguuugaucccagggauccacauacuggaaggagagagaaccagaaccaacuccagcaaauuguccucuaacuuccacacacacuccccuguacuaauuaauuaauuagaaagaagaaacauuacuugguuugggggguaggacccaguaguuagaauaauuauaauuauuaauggaagaauuccauagcaagauaugguaacacugaaacuaggaagaaggcaggcagaucucugugagcaaaguccaaacuggucuggacagcaaguuccagacuagccugggcuacacagauucuguuuccuccuccucuucuuuccuucuuucuuucuuuucuuuccuuuucuucuuuuguuuuguuucuguuucuguuuguuuuguuuuucaagacaagguuucucuguguagcccugguuguccuggacucuguagaccaggcuggccuagaacucagagaucugccugccucuaacuccugagugcugggauuaaauguugaguguuuacuaccaccccacuaccaccugucaagagacccuguuucaaagcuaaaguugaaauuauuuuaaauaauucaucugagaaucaauggguuccuuccuguguugacagaaauguugauuuuugguuuauuuccuuaggcaccugcugguaccgcuuuauccuguuacaaggaguugaacacacagaagggcaucucuucccucgaagcaaaaccaaccacauguggccuuuuuccccucuugacacuggauggcuaaaccagaaggcugucugccauggauagagaaguuuugaugaaucaaaggcuuagggauuuucuaaaagggacucagauucugucccugccuagcucccugcagaacaaaccagggcuaguguguuggcuuagugcaugcagccaggacugaccugaugugaguucaaauccgaggacccacaugagaggagagaacucgucccugugaccugcacauucauauugugaugugucacaggcaguaauaaaaaaguaaauaauacauaaugcaaaacaaacuaccagaagcugaaccgugagacaggagagagaacgggacacacugcauuggguugguaggguaccuggcuucguccccagcaucacguaaaccaagccuguugucacaaucuguggucucagcacuccccgagggaggcaggaggaccaugaggauagccucagcuacacagauaguagaagccagaagacagaaagguguaaaaagcugcuuuugugaguugauuucucucgguuuuuguuuguuuguuuguuuguuuguuuuugagacagggucucucuauuacauggcucuggcuguccuggaacccacuauguaggccaggcuggccucaaacucagagagauccaucugccugucaaagacaugugccaccgcccgaacagcuugguucuuuuucucccuugaguuuugaggcgcuuaugcgugugcucacacguauauguaggccagaguucaacgucagguguccuccuugguugccucucaccuaauuaaaacucaugguauuacugaauuuuguguguguacacacaugcccaugagugcugggggucagcuaacagcuuacagaaguccguuuucuccugagugggucuccgucccagccugccacacauggcaguucacacauggcagcucccuggcuuggcaacaggagacucacuauaaauaaccuguaacuccugggcucagugauccccuuucucugucuccugaacagcugggacucccccuccucugccuugcccuccccacugggccuccuuagagucaccaggaaggaaucucuucccugaagucaagcugugugcugagcuggucacaguggccggggccuuccaugagguaggucugggugcugcuucucugcagcacucugcucuggccagcuugucccuggccaguuugcccagauccacaccugccugugauaucuccaagccucugccagucccugcgguugggcaauggccucaggucaugaggaauugaaucaggcuguacugggcaauagccucuagccauaaaaaaauggcuuaacccagccuugacuauucaccaacagagauaauauacuaagccaguuacugaaaacaccccacgcugcucccaguugaaauagcuguaacuucuuuuuguuuguuuguuuuuguuuuucgagacaggguuucucuguauagcccuggcuguccuggaacucacucuguagaucaggcuggccucaaacucagaaaucugccugccucugccucccaagugcugggauuaaaggcaugcgccaccaugcccggcagcuguaacuucuugauggcuaugguguguguguguguguguguguauguguguacacuauguaugugguguauauguauaguguguguauguauuguguguguguuuuaugguauguaugugugugcauauguguaugguauaugugguguacaugaaugguauauguguguguauaugugcuguauguguaugguguguguaguguauuuguaugguuuaugugaguguguguguuauguauguguguaugguguguauuguguggucuguauauguguauguauguauuguguguguauguguguguauauguguauguauguauguauguguguguauguguguauguauguguaugguauguguauguguaugugugauauguaugugugugugugugucccugaccauccucaugugcccacuguaggaauaaagccaugacagccuguuggggguggagccugcuucucugacuccuucuucagcugccacccguguuggcuccuguguggcccugggccacagacuuugcuccagaagguuucuucccuguuucuuccccucugcuugcuuuccucucacuagcuugagaggauucuggaacuugaccaggaaaauguugggugcugcuccccucccagcagccaccccaggaguggacauagucaccccagagacagucuuagucucugacuucuuccaccuccuucuccuccaccccagcccucuccucuuaccucccuauuccccuccuccuccucuucuucccuccucccuccuuuuuuuuauuuuuauuuuuauuuuuuuagguuuuugagccaucguugcuggcuaguuuugucaacuggacacaagcuaaagccaucugagaggagggagcauuaauuaagaaaacgccuccauaagauccaucgagaaagcauuuucucuguguagcccuggcuguccuggaacucacuguguagaccaggcuggccucaaacucagaaauccaccugucucugccucccgagugcugggauuaaaggccugcaccacacccggcugucccuccucccuccuuuucaacucuagaaaauaccugcccuuuuuuugccuaaagcaagacauacaaguugcuuggauuuaaauuauuuuguucgaaauuugugguguguguguuuguguguguccaucugcacaugcuugugcaugccgcagccggauucuacaccaagugcuuuccuuguuaucuguccaccuuaucuuuaaaguugguauaaacccagaacucauugacuggauaaauuaaaugggcuggcuagcaagccacaggaauggccugaucaaccugcagcugccugcacacaaugccugcaggugcacacgucccacccccuccacaccuggcuucucccccuuggcgcuguguguccagcucaggaacccugcuugcacagcagacacuauaccaaccaacagagccaucgcugcuggcuggcuaguuuugucaacuggacacaagcuaaagccaucugagaggagagagcauuaauuaagaaaaugccuccauaagauccaucgggaaagcauuuucuuaauuagcagcugauaggggaugguccagcccaccguggguggggccaucccugggcuuggguucuggguucuauaagagcccugaggagcaaagcaaggcaguaagcagcuccucaccagagccucugcaucacuuccugacuggguucccacccaguuugagcuccugcuugggcuucccccaauggcuccugacuagggauauggaagccaaauaaacccuuccuccuaaagcugguuuuguuucucguguuucaacacagcaauaguaaccccaagacacaucugucuagucccggggggggggggguguguguguguuuuuuuuuuuuuuuuuuuuugguuuuucgagacaggguuucucuguguagcccuggcuguccuggaacucacucuguagaccaggcuggccucaaacucagaaaucugccugccucugccucugccugggguuuuguuuguuuuuuguugugugugauuguuuuguggguuuuuguuguuauuguuguuguuuccuuguuuguuuguuuuuugaaauagagucucuauguaaccaggcuggccuggaacucccagacauccccacgccucugccucccgagugcuggaccaguuuuuauuuguguguguguguguguguguguguguguguguguguguagcccuggcuguccuggaacucacucuguagaccaggcuggccuugaacucagaaauccgccugccucugccucccaauugcugggauuaaaggcauggcccagcugauuuuuuuuuuuaagacaggaauuuacaauguaaccuagucuagccucaaacuaacucuguaucuaaggcuagccuuaaacggauguuucugcuucccccuccagggagccaggaugccaggcuuguaccaccaacuucaguuacuagggggguuagggauagaaccugggguguccagcaagcuagacaagccucuagccacgggagucccagccccagucggucaggccuuuuauaucuccuuuuuguuuuugauuuugaaaccauguuuccacaggcugcggaaaacucucuucccugucccugaggucacagaagucaucgagcuccucuuccugugcacagccugcuugaaagaauuauuaaugcuaaaacgguauuuauuuuauuuuuuauuuuuucauugaaaaaaaaaaagagcacaacacauguguucaaaccuugggugucacugacaaagauuugguucauaugaucugggaaauauuucucggaaccuaacagguuaacaaaguaauaaaagagcagguaagaugggucagguggguaaaggugcuagcuacuggacggagagaaguaauucucaccuccacacacacuguggcuguaacccuacaccucccuccucaauuaaauaaguguaauucugaaaguaagccaggcuguggagacacucgccucuaacccaauacccagaggcagaagcaggaggcucucugaauucaaaacuugccuggucuacaucuacagagugaguuccagggcagccauggcaacauagagaaacuuuaua

SEQ ID NO: 4955 - RNA, 4864 nt, Mus musculus
cggguucggacucggcgcgaucagucauggcggcuuuccgcgacaugguggaggugagcaacuggcuacugagccugcugggggccaaccgcgccgaggcgcagcagcggcggcugcucgggagcuacgagcagaugauggagcggcugcuggagaugcaggacggcgccuaccggcagcuucggggugagggccgguccccugcgccccagccccgggggacuucucggggggagcugguacuccugggccucaguuuccccaucugacaauugccauggcucagaggcguccagauaagugucauagcucacaaugcgcgacucuauacgaucguacuucguagcucaggcgccuuuggaagucuuuaugauccagcccccaccuccacuccugcucgccguucuugagggucuuccgagggagagcagucacacccgagccuugauuucuccaccggugaaaccguugucaugacaacgguugucaucuagggacuuaagcguaauuaaauauagaguuagcagggcacgacccuuuauuaacuuuccaggacucaggcuuaaauguagcucugacuaguagagaacuacuuagcugagaaauucaaagaaccuuucagcuccucagugccuuggucacaggugugagcaaucucccaucucaguguccuucccugucaaagguuuguuugaacuuuguuuuguuuuguuucaagacaggguuucucuguguagcccuggcuguccuggaacucacucuguagaccaggcuggucucgaauucaaauccgccugccucugccucccaagugcugggauuuaaggcaugcgccaccacguccggcccugggaacauuuuuuaaaguuucgugccuucccaauagacuugugaacagagccugccgugagcuggaccucgggugacagcagggaaggagucccuugguggcuggcauccuacuggagaggagacaggauaacauuuguacugcagugaugggcugaggagacaaaugcuuucuaucauuaggagggguaacaugggcgggacuggggagggguuucugcaaagauauugggggaaaccugaaacuguugagggggcagggauacacuugacuggcaugcaugaaacccuggguuccaugccaggcauggcagaaugggccugucagaccaguguuccagagacaagcaggagggucaggaauggaaggcuggaaggaauucaaagcagccugauugacagaagaccaaaaguaaaaugagaaguuuuaucucugagauuguagcucagagagaacacauguggcuacaggaggccuugggagcaagcaguaguaaugaaguaaaaaccugagggcuggcaggaugguucacuggguagagacacuuggugccuaccugacgauguuaaguuugauuccugggagccaggugguagaacugaccccugcagcuuguccucugaccuccacacgcaaaccugcuguuucuucuuugaaugagucauuagcggcuugaacaugugcucuuagaauuugggagaccgaagcaggaggcugcugagaauucaaggcuaaccucaguuacauaauuagcuacagagaaacccucugucacccucacccaggucccaccccacaugccuuuugagguggguucugcguagguaguacagugcuugccuagcaugugugauggaggcucuaaauucaaacccaauaccauaagauaauuaaaauuaaguaauuugauggcuauacuuugugaccugcuucuguagaauaauuugggaggauaagacagaaggauucuuugagcccaggaguuuguggccaaccuggacagcacagugagacccucaucuuaucauucaacauccccuccccccaaaucauagaguuuauaacagaagcuggcgagggagcugcacaccgacacccccccccccccauucagagaucagaggccaaccugagcuacauaagacuacuucccaaacaaaagauaccaagugcggcuuaguggguaaaaggccugcccagcacacagaaagucuuggcuuccacccccagcaccacacaggaugggcaugguggacaacuuaggggcgucacuucuguccuucuaccaagugggucccagaaauggaacucaguccgucagacuuguuagcaucucauccggcuauuaggauuuuuguagugcuuauagcguagggucucuugaguuuaaccuaagccagaguagaacucugcauccuccugccucugccuccugagcaauggaugacagcuacacacugccauucucaguaucgccuguguucuggcagagcaggagcaaggcccagauguugggaggugcucagauguagcagaacucugacugggugguggcaugaggcaccgucagaguucgccugggcagaagacagaaugaaagggcaccugcuucugucccauugcagagacucuggcuguggaggaggaaguggcucagagccuucuugaacugaaagaauguacgcgccagggggacaccgagcugcagcagcuggagguggagcuccagaggaccagcaaggaggacaccugugugcaggcuaggcuacgauauccuuugcuauguccgguggccgcucagugcagugccagaguuccugccuagaauccuccagagagagaggugggaguguggcucagugguagagccccugccuggaaucccccacugaggggcuggcuugugcucugguagagccugccuagcgugugucaggucuuagcuuuugucccuaacacugaaggaagaaaaggccugagcacuuggugcucugaccugguggggcagugaggugggugaugguccuuccugucugagccuuggccuuaacccagugcacucagcucaucacagagcugcaggagcucagggagauggaggaagagcuccagcgccaggagagggauguagaugaggacaacaccgucaccauccccucugcaguguagguucugcaggcugggccuacucuugcccuguggcgugguugacauggaugcugugguaacugucuucucucccuuccccucguucuaccuagguauguggcucaucucuaucaccaaauuaguaaaauacagugggauuaugaaugcgagccagggaugaucaagggcaguauccuuugagaagucgauguuggggugggaggaggcaccugggggaaaugggugcaucuucacauacuagacacagucaggcgugguggcacaacccgcccucgcacugugaaggcagaggcaguggaucucacuggaguuugaggcuagccucgucaacuagcuagaguacguuucaggacagccagggcuacacugagaaacccugugcccaagaguacaaaguggacucuugcagagauagcgaugcaucauguucauggggugucacccuccacauccagaugcagacagugucuauagaugauggguaaagggaagacaauuuaacugugcgcuacaauaguaucaggggagggcaucguagacagaagauaaaaauguaguagaucguuuucucagccugcggguaaccuggagccuacauguucuccagaccagcugcaaauccuuggugaaccucccguuucugucucucaagugcugggacuguggguguuugccaucacauccagcaaauauaucauuuuuaauuaaaaagaaaugauccaucuaggcacgucucaccgagccuaaugacuggaauucaaucccugggacccacuggugggagaacagcuauauacguugucaucugaguccacagggacacuguggcauguuugcacucacacacacccagauaaauaaacauaaaaagaaauuagccugauaucaucccagcacuugggaagcugaggcaggaggagucaccacaguucaagguuagcgacuggaccugggaggaccgaaaacacuuuccuuucaucucguccucaguccaccacggccccacaguggcccagcccauccacuuggacagugcacagcucucgccgaaguucaucagugacuaccucuggagccugguggacaccacgugggagccagagccuugaccucauaccuugcacagaacugggguugagggagccaaggaggggaucacucuaaaauuaaaugucuguaugugagugcguucauugauuuaucuacuugcuuugagacagcauggaguccaggcuggccugcagcuucuuuuuuauuuguaauuacauuuacuguaugaauguuuugucugcaugugugucuguuagcuguguauuccaggagagguuagagagggcuucagacccccugaaacuggaguuaugggugguucugagcugccauguggcuacugggaaucgaaccuguauucuauagaagagcagccagugcucuuaauuguugagcugucucuccauccccuuaauuacaauuuuaaaaaaugugugccuagccgggcgugguggcgcacgccuuuaaucccagcacuugggaggcagaggcaggcggauuucugaguucgaggccagccuggucuacagagugaguuccaggacagccagggcuauacagagaaacccugucuugaaaaaacaaaaaaaaaaaaaaaacaaacaaacaaaaaaacaaaaacaaaaaugugugcaguuggggcuggagagauggcucagugguuaagagcacacugauugcucuuccagagguucuggguucaauucccaucuguaaugggauccgaugcccucuucuggugugucugaagacagccacaguguacucacauacauuaaauaaauacucuuuuua

SEQ ID NO: 4956 - RNA, 2009 nt, Mus musculus
uagcagcgugauaucagcauggccugcuuagccaucagucugaugcaauggcugagccuccgccaggcccuugugcaaccauggccgguuaaccauugaccaggggggucaauggcagccuauggaaauaaaaggcagccgcagcggcccgggaaccacacccacgaaacugucagccauggcugugcuugcucucugccuccuguggaccuuagcaucagcagugcgacccgcuccaguggccccucugggugguccagagccagcucaauaugaagagcugacccugcucuuucacggggcccugcagcuaggccaggcccucaauggcguguacagagccacagaggcucgccugacagaagcugggcacagccugggccucuaugacagagcacuggaauuccuggggacagaagucaggcagggccaggaugccacacaggagcuucgcaccagccugucggagauucaggugagcacuggagcuggguguugguggcagguaagagucugaggaaaugguaaacccagaacagaggaaacauacccugaugacacaccauccuugagcagguggaagaggacgcuuuacaccuucgagcugaagccacagcccgaucacugggggaaguggcccgggcccagcaggcucugcgggacacuguacggagacuacaagugcagcugagaggcgccuggcucggucaagcccaccaagaauuugagaccuuaaagguaagggacucccaggucugagagggguauagccugcuucucagaaagaggccaccacugaauccugggcuagaggacccuccaguuguauaugggguuccagccucagugaccuucuggaagugaccuuugcaaguaagggcaagaagcaggcacagcugugguucuagaacuccagaggcaggggcaggagaaauagaagguuaaaggcagccuuggcuacaaaguuaggccagcugacuacauggugauaccuugucucaaagagaacaagagaaagaacaauccuagcacugggaauaaaggcagguguguguguguguguguguguguguguguguggguguguguggguguguguguguguggaguccaaggugauuucuggcuagguagacauccggguuaagcuugggguacaugaagcccugucucaaaauauguaaaugaaugaaugaguaagggaccaacaagguaguuaguucagcagguaaaggcugccaagcccaugaccugagauggauucccaggacccacgcaguccuggugcuauguaucaagaaaccaaucaauauuguuugaugugcaucuacaaacuauacagagcaagucccauuuuagauauacuuuacaaacagggaaacugaggccagagggucuuggacauuugcugggccccauggaugguaacagagaaacuugcaguggucaggagaugggaggugacccagaucucccagcuaagguuuauauacuaccccacaggcucgagcugauaagcagagccaccucuuaugggcucucacuggccacgugcagcgacagcagcgggagauggcagagcagcaacaguggcugcgacagauccagcagaggugagccuggugggauuacucugggguagcaguggaaguugccuagguccacugaagggcaccuccccgaagcacuggccuugacggggcucuaccucccucccuagacuccacacagcagcccucccagccugagacuaccuggaugccaccgaggaccaguugugcugcaaggaacacugaagcgcuccaccaggcccaugaacagggcugacagagccggcugcccaucagcuggaccuggccagugcaccccgcuuccuggcagagcggagacagaagcaagcaggcgggauggaaggcagaagacagagcccuguggaggagggcuggaaaaagacacgagcccccuuaugcccacacaccccacaauaaaagagaacagaggcaaucuau

SEQ ID NO: 4957 - RNA, 2009 nt, Mus musculus
auagauugccucuguucucuuuuauuguggggugugugggcauaagggggcucgugucuuuuuccagcccuccuccacagggcucugucuucugccuuccaucccgccugcuugcuucugucuccgcucugccaggaagcggggugcacuggccagguccagcugaugggcagccggcucugucagcccuguucaugggccugguggagcgcuucaguguuccuugcagcacaacugguccucgguggcauccagguagucucaggcugggagggcugcuguguggagucuagggagggagguagagccccgucaaggccagugcuucggggaggugcccuucaguggaccuaggcaacuuccacugcuaccccagaguaaucccaccaggcucaccucugcuggaucugucgcagccacuguugcugcucugccaucucccgcugcugucgcugcacguggccagugagagcccauaagagguggcucugcuuaucagcucgagccugugggguaguauauaaaccuuagcugggagaucugggucaccucccaucuccugaccacugcaaguuucucuguuaccauccauggggcccagcaaauguccaagacccucuggccucaguuucccuguuuguaaaguauaucuaaaaugggacuugcucuguauaguuuguagaugcacaucaaacaauauugauugguuucuugauacauagcaccaggacugcguggguccugggaauccaucucaggucaugggcuuggcagccuuuaccugcugaacuaacuaccuuguuggucccuuacucauucauucauuuacauauuuugagacagggcuucauguaccccaagcuuaacccggaugucuaccuagccagaaaucaccuuggacuccacacacacacacacccacacacacccacacacacacacacacacacacacacacacaccugccuuuauucccagugcuaggauuguucuuucucuuguucucuuugagacaagguaucaccauguagucagcuggccuaacuuuguagccaaggcugccuuuaaccuucuauuucuccugccccugccucuggaguucuagaaccacagcugugccugcuucuugcccuuacuugcaaaggucacuuccagaaggucacugaggcuggaaccccauauacaacuggaggguccucuagcccaggauucagugguggccucuuucugagaagcaggcuauaccccucucagaccugggagucccuuaccuuuaaggucucaaauucuuggugggcuugaccgagccaggcgccucucagcugcacuuguagucuccguacagugucccgcagagccugcugggcccgggccacuucccccagugaucgggcuguggcuucagcucgaagguguaaagcguccucuuccaccugcucaaggauggugugucaucaggguauguuuccucuguucuggguuuaccauuuccucagacucuuaccugccaccaacacccagcuccagugcucaccugaaucuccgacaggcuggugcgaagcuccuguguggcauccuggcccugccugacuucuguccccaggaauuccagugcucugucauagaggcccaggcugugcccagcuucugucaggcgagccucuguggcucuguacacgccauugagggccuggccuagcugcagggccccgugaaagagcagggucagcucuucauauugagcuggcucuggaccacccagaggggccacuggagcgggucgcacugcugaugcuaagguccacaggaggcagagagcaagcacagccauggcugacaguuucgugggugugguucccgggccgcugcggcugccuuuuauuuccauaggcugccauugaccccccuggucaaugguuaaccggccaugguugcacaagggccuggcggaggcucagccauugcaucagacugauggcuaagcaggccaugcugauaucacgcugcua

SEQ ID NO: 4958 - RNA, 11999 nt, Mus musculus
agaggcuugggcccacuccacacuggguuaugcaaaugugaucgugcucccgccccacuggguuaugcaaauaaggcauccuguggccccgcccccaccucgaucacggagucugcgcggagcggcaaguccggcgguccagacuucaucucgguguccgccugccugaccagcgaucuaucugacuguucuacggcgccgggaccguguagagggagcgaggguucaggcggcggcggccuagacagggugagggagaagcgugggcgcccccucuuuuuagcccggggagcugcccagccuggacacgcagguccagaccauggacauggguccuucugauccuuucccuguggguccauugcggcgagggggggcgagggcgauagggggaggggaggcggcgaucuagggcuuuagaugggguugggggaggggagucuggagaaggggaccccccccacccggggggagaccucaagagccaggccacagugcugcgaggguggcugugggugaaugaugguguaguugccccuuguuggugugugguuguguaacugguuguguggcugucuggcugugauggguucggguguguccacugauugugugugugugugugugugugugugugugugugugugugugagagagagagagagagagagagagagagagagagaggagagagagaauauacacugguguguguguguugguguggugucuaguugugugaucugucauuuuguaguuacuguuguauuccuucugauguugugugucuguuuugcaauccggcaggugucugcucuuaccugccuuuugugugugcugcaagucccugucgcauauaucccauauaucccuaccugaccauguggcugagacuguggguggcacacugucucugcuaugacuguggagaggguguucaugugugugauugucauugagcgccuuguaacugggggugugacucugugacccauucugugacucuuauuguguggagugacucugcugugauucuaagugguuagcaaccuugagucuaucuaugguggugacuguaucaggacagggauuuguggggggcugggcugucuuucugugugucucucugacugugucuuugaggggguauguuccauccgugugggugucuaugacaggccauaugcaaacuguguguguguguguguguguguguguguguguguguguguguguguuuaggggugcuggggauuugugugaaugagcaaaucugguuugcucagcaugagacaggcaccccacacagugugcuuggcucuugcuguggaauggguggaugucauguucugagaugucccuguguguaguguuugggauggaggccacgccuggguuauaucuuaugugggagugcccauaugggugacucugcacaccuggaaucuggugacccucucuccaauaugucauucuguggaguaggccucaauggagcccuggaugcacaguacccaccuucaucugccugggccucaguuuccacauccgugcaauggagaugaauguucuugccuugcuggccucacggaguggcugugaguugguggcaguggagguggaugccuggaagaagcccuagggcucuuucacaggugagaccaggugucaguagguauaagcuggcuugacuguauuggcuacugaugccuugggaauugaaguuagauguagggggguugguaagaggagacuggagaggcagcuggccugggaggaugggggguguucgaggcagcugggagagagggagugucuggcuaucagcccacaccagaucccacagcccauggggacaggggagggagauguggaggccaugguggaagaaacuuggagaagggagagggcaagaggccugggauuuccugggcaaagaagaugaaguucccuaaaauaugacaaagguguguaccaaggagagaggcacccuucucuaaaggcugguuagagguucccauaaaaggcauggggucuguagaauuucuuuaauugaagaugucacuauagaaucuuuugagagaaccaaccucugcagguugcugucugaccuccacaugaacugugugacacacaugcacagacucaacaaauaauaaauguaacuaagaaagaaagaaagaaagaagaaagaagaaaaagccuuagcucucuaguaggccucaaagccuacuagaagaggcaggaaucuccagugagcaggagcaggggccagcaaggugggagcugaacgcagaguacagccaggauaaagagcagacccagaacuccaugaaggcucacugucucagugaugcgcccccaaguucccccgccucucccuccacaggccccagcuucgccauggcuggagggagaccucaccugaagcggaguuucucuaucaucccuugcuucgucuuuguggaggugagaaccucagagccacucugagaaaggacucugucccucugucccucugucccucugccccucagucccuguccagccuaucucccugcuccugccccacacucaucuccccaccuuucuggcuccagccaguccuaccucuggcucugaccucuuacaccccauuaccucagcaccucugcugcugcccccucucucuugaggcgugguggcaggacuggaaccagaagcauuccucucuggauucuggcccuauuuuccccuaacccaucacacuucgggacuuugcaugccugagccucaauuucuucaucucuaaaaugugcauaauuaacagggcaugguggcacauauguguaaccucagcugaaggagaaagauuuuagggaagucagggccagccuggccuacaugagacugucucaaaaaaauguguguauauauauauauauauauauauauauauauauauauauauauauauauauauagacagaaagagagagaaaagaaugcaaggcacagccauuguaaugcauacuuguaauccugacauucaagagaaggaggcagaggccagagaaugucugcaaauucaaggccaguccauauacauggucaggccagcuaggacuguggaugagagccugucucaaagcaaacuagccacacgcaccuuuaaucacagcacuugggaggcaaaggcauguauauucuggugaacucaaggccagccuggucuacauagugaguuccaggccagccagggaaaccuuguuccaaauaaaacaaaaaaguuuaucucaggccagccugagauacauaaugagauuguguaaaaauaauaagcaaauaaauagguaaauaaaacaugggguugagaaugugggucagugaccagagauuugccuagcccaugaagcccuggguucuaucuccagcacugaauaaacaaggugcacugaccuacagcuauaaccccagcacuagggagguggaagcaggaggaucaggaggcagguccaauuccauagugaauuuuaagcuauccuggacuacaggaaaccuugucucaaaaacaaaacaaaaacucauuagaaacaagauaacggcaccacugcuacaguugaagccuagcauguaugaacuccuuccuucucuccucugcugugguuucaauauccaucuuccacuuucucucucccuccaucucucuccguuuccuugucucugucuuugaccucacagccucugaccucuuccuaucucuuuuugcuucucuccggccccugacuggcugcagucuguguugcuaggcaucgugguccuucuugcguaccgccuggaguucacggacaccuucccugugcacacccagggcuucuucugcuaugacagcgcuuaugccaagccguaucccgggccugaggcugccagccgagcgcccccugcccucaucuaugccuuggucacugcugggcccacccucacggugagaugguguggaucaccaggcugaaugccagaguagaaccucccagaaugcaggaaggcuggguuggaguugguggagcccuggacuugaaggccaggaagaccccaucuuggucuuguucacagauccugcugggggagcuggcccgugccuucuucccugcgccacccuccuccaguccugucaguggggagagcaccaucguguccggggccugcugccgcuucagucccccacugaggaggcugguccguuuccugggugagaaaugcagccuggggucaguccaauggucuuggggagggaggugaguucagggacagaggaaaugggccaguuccaccuuaaaaagaaucucaggccaguggaucaagauggcucaauggauaaaggugcuugccaccaagccugccuggcaugaguuggauuauccagacccacauggucgaaggggagaagcaguucuugagcugcccucugacuacacucaagauaugguacacacccacauacguacaugcaugcacacacauaacuagacacaagcaugcacaugcacacacacauacacuuagauacauacacacauagaugcauucacagacauagauacauucaugcacacacacacacacacacacacauauauauauauauauacacacacacauagacacacacacacaugaaaauaaaagaaaaucuuuuuuaaaagccagagauggcacacaaccguugucccagagaugggaagaugggagguggagacagguggguucauggaagcuuugggccacccagucuggucuacuuggcaaauuuucaggccugugagaagaucuaucucaaaccgaaugugaaggugugggaggaaugacaacugaaauuguccucucaccuccacaacaugcaugugcacuuagacacaagacuucuagccugugugguggugcacauauguaagcccaggacuuggaaggcugugguagggagaucucaaguuuggaagcuagccugggcuagaaguaagucaguaucaaaaaaaaaaaaaaaaaaaaaaaaaaaaaaggcgugugguuugucacauuucuauaaacucaacauucaaaaguucuggacuggagcugagagauggcuuuucaguuuugccaaggacccaguucaggucccagcacccacaucaggcagcccacagcuggcugugauuaguuccacgggaugugacucacucuggucuccauggccaucugcacccauguagugcacauaaacccacagaagcacacauacauacauauaaaaauaacaaguaaaucaauuuuguuuuuguuuuugauuuucgagacaggguuucucuguguagcccuggcuguccuggaacucacuuuguagaccaggcuggccuagaacugagauaucugccugccucugccucccaagugcuggaauuaaaggcgugcgccaccgugcccggcuaguaaaucaauuuuuaaaaguucaagcuagguugaaaauucuuagccagguguguaugaaugugagugagugugugugagugugugugcauguauguguauauauaucucaggcuuaaggccagucagggcuacauagcuagacucuaccuggaggagaggggguuggggucaugauugucagaggguuccaagggugagauucaaucccuaggauuuauaugcuagaaggacagacauauaggucugacacaaguuguccucugaccuccacacacauaagcacacacaaacaaauaaacauaauucuuaaacacuguaagaggaagagaaggggaaggagaggggagucccagaaacuccaauaagucuuucuaggagguccggaagucauggugcuaaggggucccagaguggcugcaauagcgucagggagagccugcccgugacacagaauaugucuuagagacagacuauagauauauacuauaguugggggggggggcugugguagcaccgaagguaaggggacuucagccgagacauaauagggcuccagauuggcuugaguggccaucccagcaagacaauugagaccagcaacugaucuaaaggaguguggugccaggccugacaacguugaguuagauuuccaugaccuuugugguagaagaacuaaauaccucagauuuucuguccucugacuucaacacaaaauauaacgaugcccacacaaauagauauaccccaaauaaauguaaaaaaaaaaaauccucccccccccaccccaccccacccccccccccccccgagagaggauuucucuguguugcccuggcuguucuggaacucuuuguagaccagauaggucgcucagagauccgccugccucugccucccgagugccaccaccacccacaaggggcuuaauggaaccgugugggacacucgggaggaguccaguggaagggacaugaccucucuccuccccaucgccagggguguacucuuuuggccucuucaccacgaccauuuuugcaaaugcgggacaaguggugaccgguaaccccacaccucacuuccugucggugugucgccccaacuacacggcccugggcugcccaccaccgucuccugaccggccagggccugaccgcuucgucacggaccagagcgccugugcaggcagucccagcuugguggccgccgcacgccgcgccuuucccugcaaggaugcggcccugugcgccuacgcugucaccuauacugcggugaggcccugggggagcugcuaggggucuggaagugggggcaccuugaccugggagaagucggggaaggaggucaugcccgcugaaauggagccuuaagguugaggccacacccucguggugcaucccagccuuggccccaucacuacuccccuauugucuuugacugugccuuuugggauuccgccccuuggaguugcuaagaaguugcaggcccuggaccauggcuaggacacuaagccuauggguuuugacuccgccuccuagaguccucgccccuccccuuugucgcaccucugaucuuuaagccuuauuaauucgguuccgggccuuuuucuauucccgcgcuuuccugccuugauuucuucccuuuucuggccucuggaaugacugaugccaccaguaugcccgucccagacaacuucaauggguccaugagguuccgaggcuacuucugagcucccggaccugccucuuuggcgcuaauugacucccgaguucuguguucaugcuuuaaugcagcaagcaucuuuccuugucucggggaagcauguuccaaagguucucaucccgucccuuuuggcgcucugaccacacuaccugcaugcagaaccacugacaccccauuccaggcaccccuucucucucugcuucucgucuccaccucuacgggucccugccccuuuccuggaggccacccugacucuuucgagccucccacgcguuggcucgaaaggcacagauuaauccucugaucgguuugggucucacagauguacgugacccuaguguuccgcgugaagggcucucgccuggugaaaccuucccucugccuggcccugcugugccccgccuuccuggugggcgugguccgcguggcggaguaucgcaaccauuggucggacgugcuggcuggcuuucugacgggagcagccaucgccaccuuuuugguaaguccccuucccacauaucucugaauagaagaccucucgucaggccucugacacaagaggcagaguugcucaacgaagcugaaaggaacagaugcugcaugaccuggggagggcaguuguccuuuacuucggcccugacugcuugcuuguucucaucugugaaauggguugacagcgucauaacaugaagagcaaaauuuaaagggaugccacaacacuacgcaacugaggaaaauacuauuuuacgggggaagauggcucaauugguaaagugcuuacuuuucaaacaaggauuugaguucagaucucuagcacccauaagaaagacagaaguggugugcuugcugucucagcaccaggaaggcagaggcaggaugguuccugggcuucacuggcuggccagucuacauuaaucuaggagcuccaggccaccacuccugaggagugauaacagagguugaccccaccuucacacauaccaaccuacgaccuccacaaacacauggacacaccugcaugugugcacucuccguugcagacacacucacaugcaucuguacauacacaaacauccauaucacccauacauuuaaaaauauauauaguugggcggugguggcgccuaccuuuaaucccagcacuggggaggcagaggaaggcagauuucugaguucaagaccagccuggucugcagagugaguuccaggacagccaggacuauacagagaaacccugucucaaaaaaccucuguguguguguguguguguguguguguauuaaaauuuuauuuaguuuuaauuuuguuuguuuugccugcauuaagugugaguuugugugugcgugugugugcaugcaagugcaugugcgagcaucaugugugagugugaguaugaucuugugaauuuguguguguauaugggugugucugguaccugaagaggccagaagaguauacuagaacuggaguuacagaugguugugagaugcuaugagggugcaggaaacaacccaggaccuuuugcaagagcagucagugcucuuaaccacugagccaccuucugagaccccuaaauauauauuuuaaaguaucuuuuggccagugaugguggcacaccccuucaaucccagaacuuggguaguaaaggcaggcagaucucuugaguuugaggccaucuuggucuguagggucucacuaugcaggccugacuggcuuggaaugcagauguguagagcagcuagccuugaacucagagaccugucugcuucugccuucuaaguacagggugccuuuuaaguacgggcacuaaaguugugcaccaccgcuccuggcaagacuggguuuuuugagacagacucucgugaagcucaggcuguccuugaacuagcuauccagccaagcauagcuuuguucugcugauccuccugccucagcucccuagugcugagauuagcuaugucccaucagugcccuguuuuguggugauggagauggaugggacccagggcuucaugaaugcuaggcaagcauucuauggagugagccauaacuuagccccucauagaagaacauuuggggaaaagucggugagaaagcucagcuggugaaggcauugccaccugagccuagaucccaugcuggagcucagaugguaaaaagagcugacuaagagcaaaagguuuucauuugacccccacaaaugcagugcguuguagguaaccuucccacacaguggguagugauaauaaaauauaauaauauuuuugagauaguaaacaauugauauucagggcuggagagauggcucggcacuggugcucuugaaaaggaucuagguucauuucucagcgcccucauggcggcucacgaccaucuguaacuccaggagaaucuaaugcccucuucuggccuucuuggccaccaggcacucagguagugcacggacacacaugcaaaaacacuuauagacagaaaauaaaaauuagucucaaaaauguuuuaaaaacucaauaucuauaucaaagaauugcaguauuccaaauuucaaacaagugcagcuggguguuguggugcacgccucuaaucccagcacucuggggaagguacaaauggaucuuuugcauucaaggcaggccaagccuacacagggaguccaggugagccacagagagacucugucucaaaaacaaaacaaaacaaaacaaaacagaaaaccaacccaaaaacaucaauaaauaaacaguaaaauugucaagaaagguugugucuggauauucaaaccucaguuucuaucugaaaaauggagaggguguuuucauaguuuuguguuguugguuucgggccucaaccugcuccugucuuucuggccuaggucaccuguguugugcacaauuuccagagccgaccccacucuggucgaaggcucucccccugggaggaccugagccaggcccccaccauggacagcccccucgaaaaguuaaguguggcucagguaagggggcccggggguugcuccgcgcuggagagggugguggguggaggaggcccauggagguaggaagucaagugagaggugucaugcgggguagaggagccacccagcccuggggaugaaguccuaggaagaaagcaaccuuacugcauggaaggcuacacuccucucuuccucucaaauuuacaucauugaucuggagaucacuguugcauuucccaugggggcgucugacggaucagccguuuuuugucugugaguugugggcuccugggauccucuagccccgccccucuuauuuuuuugucccaggaacccgagaccugcaggccgcauucgacaccggcacggcucaccccauccaguaaguuuuggggaaguguguguguguguguguguguguguguguguguguguguguguuagggguuaaggguggggaguaaacaggguaggcagaggucucaucuggccugggcuucugugccacccuccccgguuugcuaaccucucgaucuccgauugucaccucuagagccgcagaacugugcccgccguggccaccugauucccagcuguguguccuccagggcgccagcuaugugcuccucgccccgugugccccgcccucgacugaggucugagccaacaccccugccucugccgcugccucuuccugcaccgacucccagucagggucccucgccuuccuccccuggacccgggggcccaggcgggggaggugggcggggccggaagcugcugcugcccacgccccugcuaagggaccuguacacccucaguggacuccaucccuccccuuuccaccgcgacaacuucagcccuuaucuguuugccagccgcgaccaccugcugugagauccaccaccuagaaucuacccagugaccguuuccccccugccacgcguguguguggcaugugagugcuaaaggccccugcccuccaaaccagccaggcccacccagcgucagaagauggcuggaagggacgcuucaaggcagggaaucucuuggcugcucuuuggccuuuugggauaucuggguaggcaaaaauaaccaggugggcccauguccccaggauuucccuuuuaacggcugaugcuugaccuaauugaccauugccuagccagugagagcucugaguuaucagaauucaacccaaaaguuuacaaaaguuuaugggaaccucucacuucuuagcuuccucaagcaggagggugcuacuguggccgguguucaagugucuaaacagccaauaagagcccuuggcguucagaauugcagagagugggugggaaugauuccagucaaugggggaccgcccgugucaaagccaagucaaagccaaggagggcuauccagcucuccucgggaacacggaauccagcuggagagggggggggcaggcucccccacagcagaguccugcggcaccccuucccuucuagaccuucccccaggugcaccaucucacacccuccaacucccuacuuaaguagggcuugccccaguucacagguuuuagaauucuggacgcugucucccuuggcugugccuagggcaccuccccccacuccccgccaaaccuucuauuauuacuagggcuguggaaaaugacuuuauuuucucgggacccacccuucuucuucacacugcccccaugccucagucucaugcaguugugccaucuuggggggcauggguggagcagaaggggguuccccuacccugaauagccaaaggcagugggcagaugagacacugucccccuuuccugccccccuccucaucuuuaauaaagaccuguuuguaacagaag

SEQ ID NO: 4959 - RNA, 11999 nt, Mus musculus
cuucuguuacaaacaggucuuuauuaaagaugaggaggggggcaggaaagggggacagugucucaucugcccacugccuuuggcuauucaggguaggggaacccccuucugcuccacccaugccccccaagauggcacaacugcaugagacugaggcaugggggcagugugaagaagaagggugggucccgagaaaauaaagucauuuuccacagcccuaguaauaauagaagguuuggcggggaguggggggaggugcccuaggcacagccaagggagacagcguccagaauucuaaaaccugugaacuggggcaagcccuacuuaaguagggaguuggagggugugagauggugcaccugggggaaggucuagaagggaaggggugccgcaggacucugcugugggggagccugcccccccccucuccagcuggauuccguguucccgaggagagcuggauagcccuccuuggcuuugacuuggcuuugacacgggcggucccccauugacuggaaucauucccacccacucucugcaauucugaacgccaagggcucuuauuggcuguuuagacacuugaacaccggccacaguagcacccuccugcuugaggaagcuaagaagugagagguucccauaaacuuuuguaaacuuuuggguugaauucugauaacucagagcucucacuggcuaggcaauggucaauuaggucaagcaucagccguuaaaagggaaauccuggggacaugggcccaccugguuauuuuugccuacccagauaucccaaaaggccaaagagcagccaagagauucccugccuugaagcgucccuuccagccaucuucugacgcugggugggccuggcugguuuggagggcaggggccuuuagcacucacaugccacacacacgcguggcaggggggaaacggucacuggguagauucuaggugguggaucucacagcagguggucgcggcuggcaaacagauaagggcugaaguugucgcgguggaaaggggagggauggaguccacugaggguguacaggucccuuagcaggggcgugggcagcagcagcuuccggccccgcccaccucccccgccugggcccccggguccaggggaggaaggcgagggacccugacugggagucggugcaggaagaggcagcggcagaggcagggguguuggcucagaccucagucgagggcggggcacacggggcgaggagcacauagcuggcgcccuggaggacacacagcugggaaucagguggccacggcgggcacaguucugcggcucuagaggugacaaucggagaucgagagguuagcaaaccggggaggguggcacagaagcccaggccagaugagaccucugccuacccuguuuacuccccacccuuaaccccuaacacacacacacacacacacacacacacacacacacacacacacuuccccaaaacuuacuggauggggugagccgugccggugucgaaugcggccugcaggucucggguuccugggacaaaaaaauaagaggggcggggcuagaggaucccaggagcccacaacucacagacaaaaaacggcugauccgucagacgcccccaugggaaaugcaacagugaucuccagaucaaugauguaaauuugagaggaagagaggaguguagccuuccaugcaguaagguugcuuucuuccuaggacuucauccccagggcuggguggcuccucuaccccgcaugacaccucucacuugacuuccuaccuccaugggccuccuccacccaccacccucuccagcgcggagcaacccccgggcccccuuaccugagccacacuuaacuuuucgagggggcuguccauggugggggccuggcucagguccucccagggggagagccuucgaccagaguggggucggcucuggaaauugugcacaacacaggugaccuaggccagaaagacaggagcagguugaggcccgaaaccaacaacacaaaacuaugaaaacacccucuccauuuuucagauagaaacugagguuugaauauccagacacaaccuuucuugacaauuuuacuguuuauuuauugauguuuuuggguugguuuucuguuuuguuuuguuuuguuuuguuuuugagacagagucucucuguggcucaccuggacucccuguguaggcuuggccugccuugaaugcaaaagauccauuuguaccuuccccagagugcugggauuagaggcgugcaccacaacacccagcugcacuuguuugaaauuuggaauacugcaauucuuugauauagauauugaguuuuuaaaacauuuuugagacuaauuuuuauuuucugucuauaaguguuuuugcauguguguccgugcacuaccugagugccugguggccaagaaggccagaagagggcauuagauucuccuggaguuacagauggucgugagccgccaugagggcgcugagaaaugaaccuagauccuuuucaagagcaccagugccgagccaucucuccagcccugaauaucaauuguuuacuaucucaaaaauauuauuauauuuuauuaucacuacccacugugugggaagguuaccuacaacgcacugcauuugugggggucaaaugaaaaccuuuugcucuuagucagcucuuuuuaccaucugagcuccagcaugggaucuaggcucagguggcaaugccuucaccagcugagcuuucucaccgacuuuuccccaaauguucuucuaugaggggcuaaguuauggcucacuccauagaaugcuugccuagcauucaugaagcccugggucccauccaucuccaucaccacaaaacagggcacugaugggacauagcuaaucucagcacuagggagcugaggcaggaggaucagcagaacaaagcuaugcuuggcuggauagcuaguucaaggacagccugagcuucacgagagucugucucaaaaaacccagucuugccaggagcgguggugcacaacuuuagugcccguacuuaaaaggcacccuguacuuagaaggcagaagcagacaggucucugaguucaaggcuagcugcucuacacaucugcauuccaagccagucaggccugcauagugagacccuacagaccaagauggccucaaacucaagagaucugccugccuuuacuacccaaguucugggauugaaggggugugccaccaucacuggccaaaagauacuuuaaaauauauauuuaggggucucagaagguggcucagugguuaagagcacugacugcucuugcaaaagguccuggguuguuuccugcacccucauagcaucucacaaccaucuguaacuccaguucuaguauacucuucuggccucuucagguaccagacacacccauauacacacacaaauucacaagaucauacucacacucacacaugaugcucgcacaugcacuugcaugcacacacacgcacacacaaacucacacuuaaugcaggcaaaacaaacaaaauuaaaacuaaauaaaauuuuaauacacacacacacacacacacacacacagagguuuuuugagacaggguuucucuguauaguccuggcuguccuggaacucacucugcagaccaggcuggucuugaacucagaaaucugccuuccucugccuccccagugcugggauuaaagguaggcgccaccaccgcccaacuauauauauuuuuaaauguaugggugauauggauguuuguguauguacagaugcaugugagugugucugcaacggagagugcacacaugcagguguguccauguguuuguggaggucguagguugguaugugugaagguggggucaaccucuguuaucacuccucaggagugguggccuggagcuccuagauuaauguagacuggccagccagugaagcccaggaaccauccugccucugccuuccuggugcugagacagcaagcacaccacuucugucuuucuuaugggugcuagagaucugaacucaaauccuuguuugaaaaguaagcacuuuaccaauugagccaucuucccccguaaaauaguauuuuccucaguugcguaguguuguggcaucccuuuaaauuuugcucuucauguuaugacgcugucaacccauuucacagaugagaacaagcaagcagucagggccgaaguaaaggacaacugcccuccccaggucaugcagcaucuguuccuuucagcuucguugagcaacucugccucuugugucagaggccugacgagaggucuucuauucagagauaugugggaaggggacuuaccaaaaagguggcgauggcugcucccgucagaaagccagccagcacguccgaccaaugguugcgauacuccgccacgcggaccacgcccaccaggaaggcggggcacagcagggccaggcagagggaagguuucaccaggcgagagcccuucacgcggaacacuagggucacguacaucugugagacccaaaccgaucagaggauuaaucugugccuuucgagccaacgcgugggaggcucgaaagagucaggguggccuccaggaaaggggcagggacccguagagguggagacgagaagcagagagagaaggggugccuggaauggggugucagugguucugcaugcagguaguguggucagagcgccaaaagggacgggaugagaaccuuuggaacaugcuuccccgagacaaggaaagaugcuugcugcauuaaagcaugaacacagaacucgggagucaauuagcgccaaagaggcagguccgggagcucagaaguagccucggaaccucauggacccauugaaguugucugggacgggcauacugguggcaucagucauuccagaggccagaaaagggaagaaaucaaggcaggaaagcgcgggaauagaaaaaggcccggaaccgaauuaauaaggcuuaaagaucagaggugcgacaaaggggaggggcgaggacucuaggaggcggagucaaaacccauaggcuuaguguccuagccaugguccagggccugcaacuucuuagcaacuccaaggggcggaaucccaaaaggcacagucaaagacaauaggggaguagugauggggccaaggcugggaugcaccacgaggguguggccucaaccuuaaggcuccauuucagcgggcaugaccuccuuccccgacuucucccaggucaaggugcccccacuuccagaccccuagcagcucccccagggccucaccgcaguauaggugacagcguaggcgcacagggccgcauccuugcagggaaaggcgcggcgugcggcggccaccaagcugggacugccugcacaggcgcucugguccgugacgaagcggucaggcccuggccggucaggagacgguggugggcagcccagggccguguaguuggggcgacacaccgacaggaagugaggugugggguuaccggucaccacuugucccgcauuugcaaaaauggucguggugaagaggccaaaagaguacaccccuggcgauggggaggagagaggucaugucccuuccacuggacuccucccgagugucccacacgguuccauuaagccccuuguggguggugguggcacucgggaggcagaggcaggcggaucucugagcgaccuaucuggucuacaaagaguuccagaacagccagggcaacacagagaaauccucucucgggggggggggggggugggguggggugggggggggaggauuuuuuuuuuuuacauuuauuugggguauaucuauuugugugggcaucguuauauuuuguguugaagucagaggacagaaaaucugagguauuuaguucuucuaccacaaaggucauggaaaucuaacucaacguugucaggccuggcaccacacuccuuuagaucaguugcuggucucaauugucuugcugggauggccacucaagccaaucuggagcccuauuaugucucggcugaaguccccuuaccuucggugcuaccacagcccccccccccaacuauaguauauaucuauagucugucucuaagacauauucugugucacgggcaggcucucccugacgcuauugcagccacucugggaccccuuagcaccaugacuuccggaccuccuagaaagacuuauuggaguuucugggacuccccucuccuuccccuucucuuccucuuacaguguuuaagaauuauguuuauuuguuugugugugcuuauguguguggaggucagaggacaacuugugucagaccuauaugucuguccuucuagcauauaaauccuagggauugaaucucacccuuggaacccucugacaaucaugaccccaacccccucuccuccagguagagucuagcuauguagcccugacuggccuuaagccugagauauauauacacauacaugcacacacacucacacacacucacucacauucauacacaccuggcuaagaauuuucaaccuagcuugaacuuuuaaaaauugauuuacuagccgggcacgguggcgcacgccuuuaauuccagcacuugggaggcagaggcaggcagauaucucaguucuaggccagccuggucuacaaagugaguuccaggacagccagggcuacacagagaaacccugucucgaaaaucaaaaacaaaaacaaaauugauuuacuuguuauuuuuauauguauguaugugugcuucuguggguuuaugugcacuacaugggugcagauggccauggagaccagagugagucacaucccguggaacuaaucacagccagcugugggcugccugaugugggugcugggaccugaacuggguccuuggcaaaacugaaaagccaucucucagcuccaguccagaacuuuugaauguugaguuuauagaaaugugacaaaccacacgccuuuuuuuuuuuuuuuuuuuuuuuuuuuuuugauacugacuuacuucuagcccaggcuagcuuccaaacuugagaucucccuaccacagccuuccaaguccugggcuuacauaugugcaccaccacacaggcuagaagucuugugucuaagugcacaugcauguuguggaggugagaggacaauuucaguugucauuccucccacaccuucacauucgguuugagauagaucuucucacaggccugaaaauuugccaaguagaccagacuggguggcccaaagcuuccaugaacccaccugucuccaccucccaucuucccaucucugggacaacgguugugugccaucucuggcuuuuaaaaaagauuuucuuuuauuuucaugugugugugugucuauguguguguguauauauauauauauaugugugugugugugugugugugugcaugaauguaucuaugucugugaaugcaucuauguguguauguaucuaaguguaugugugugugcaugugcaugcuugugucuaguuaugugugugcaugcauguacguauguggguguguaccauaucuugaguguagucagagggcagcucaagaacugcuucuccccuucgaccaugugggucuggauaauccaacucaugccaggcaggcuugguggcaagcaccuuuauccauugagccaucuugauccacuggccugagauucuuuuuaagguggaacuggcccauuuccucugucccugaacucaccucccuccccaagaccauuggacugaccccaggcugcauuucucacccaggaaacggaccagccuccucagugggggacugaagcggcagcaggccccggacacgauggugcucuccccacugacaggacuggaggaggguggcgcagggaagaaggcacgggccagcucccccagcaggaucugugaacaagaccaagauggggucuuccuggccuucaaguccagggcuccaccaacuccaacccagccuuccugcauucugggagguucuacucuggcauucagccuggugauccacaccaucucaccgugagggugggcccagcagugaccaaggcauagaugagggcagggggcgcucggcuggcagccucaggcccgggauacggcuuggcauaagcgcugucauagcagaagaagcccugggugugcacagggaagguguccgugaacuccaggcgguacgcaagaaggaccacgaugccuagcaacacagacugcagccagucaggggccggagagaagcaaaaagagauaggaagaggucagaggcugugaggucaaagacagagacaaggaaacggagagagauggagggagagagaaaguggaagauggauauugaaaccacagcagaggagagaaggaaggaguucauacaugcuaggcuucaacuguagcaguggugccguuaucuuguuucuaaugaguuuuuguuuuguuuuugagacaagguuuccuguaguccaggauagcuuaaaauucacuauggaauuggaccugccuccugauccuccugcuuccaccucccuagugcugggguuauagcuguaggucagugcaccuuguuuauucagugcuggagauagaacccagggcuucaugggcuaggcaaaucucuggucacugacccacauucucaaccccauguuuuauuuaccuauuuauuugcuuauuauuuuuacacaaucucauuauguaucucaggcuggccugagauaaacuuuuuuguuuuauuuggaacaagguuucccuggcuggccuggaacucacuauguagaccaggcuggccuugaguucaccagaauauacaugccuuugccucccaagugcugugauuaaaggugcguguggcuaguuugcuuugagacaggcucucauccacaguccuagcuggccugaccauguauauggacuggccuugaauuugcagacauucucuggccucugccuccuucucuugaaugucaggauuacaaguaugcauuacaauggcugugccuugcauucuuuucucucucuuucugucuauauauauauauauauauauauauauauauauauauauauauauauauauauacacacauuuuuuugagacagucucauguaggccaggcuggcccugacuucccuaaaaucuuucuccuucagcugagguuacacauaugugccaccaugcccuguuaauuaugcacauuuuagagaugaagaaauugaggcucaggcaugcaaagucccgaagugugauggguuaggggaaaauagggccagaauccagagaggaaugcuucugguuccaguccugccaccacgccucaagagagagggggcagcagcagaggugcugagguaaugggguguaagaggucagagccagagguaggacuggcuggagccagaaagguggggagaugaguguggggcaggagcagggagauaggcuggacagggacugaggggcagagggacagagggacagagggacagaguccuuucucagaguggcucugagguucucaccuccacaaagacgaagcaagggaugauagagaaacuccgcuucaggugaggucucccuccagccauggcgaagcuggggccuguggagggagaggcgggggaacuugggggcgcaucacugagacagugagccuucauggaguucugggucugcucuuuauccuggcuguacucugcguucagcucccaccuugcuggccccugcuccugcucacuggagauuccugccucuucuaguaggcuuugaggccuacuagagagcuaaggcuuuuucuucuuucuucuuucuuucuuucuuucuuaguuacauuuauuauuuguugagucugugcaugugugucacacaguucauguggaggucagacagcaaccugcagagguugguucucucaaaagauucuauagugacaucuucaauuaaagaaauucuacagaccccaugccuuuuaugggaaccucuaaccagccuuuagagaagggugccucucuccuugguacacaccuuugucauauuuuagggaacuucaucuucuuugcccaggaaaucccaggccucuugcccucucccuucuccaaguuucuuccaccauggccuccacaucucccuccccuguccccaugggcugugggaucuggugugggcugauagccagacacucccucucucccagcugccucgaacaccccccauccucccaggccagcugccucuccagucuccucuuaccaaccccccuacaucuaacuucaauucccaaggcaucaguagccaauacagucaagccagcuuauaccuacugacaccuggucucaccugugaaagagcccuagggcuucuuccaggcauccaccuccacugccaccaacucacagccacuccgugaggccagcaaggcaagaacauucaucuccauugcacggauguggaaacugaggcccaggcagaugaagguggguacugugcauccagggcuccauugaggccuacuccacagaaugacauauuggagagagggucaccagauuccaggugugcagagucacccauaugggcacucccacauaagauauaacccaggcguggccuccaucccaaacacuacacacagggacaucucagaacaugacauccacccauuccacagcaagagccaagcacacuguguggggugccugucucaugcugagcaaaccagauuugcucauucacacaaauccccagcaccccuaaacacacacacacacacacacacacacacacacacacacacacacacaguuugcauauggccugucauagacacccacacggauggaacauacccccucaaagacacagucagagagacacacagaaagacagcccagccccccacaaaucccuguccugauacagucaccaccauagauagacucaagguugcuaaccacuuagaaucacagcagagucacuccacacaauaagagucacagaaugggucacagagucacacccccaguuacaaggcgcucaaugacaaucacacacaugaacacccucuccacagucauagcagagacagugugccacccacagucucagccacauggucagguagggauauaugggauauaugcgacagggacuugcagcacacacaaaaggcagguaagagcagacaccugccggauugcaaaacagacacacaacaucagaaggaauacaacaguaacuacaaaaugacagaucacacaacuagacaccacaccaacacacacacaccaguguauauucucucucuccucucucucucucucucucucucucucucucucucucacacacacacacacacacacacacacacacacacacacacaaucaguggacacacccgaacccaucacagccagacagccacacaaccaguuacacaaccacacaccaacaaggggcaacuacaccaucauucacccacagccacccucgcagcacuguggccuggcucuugaggucuccccccgggugggggggguccccuucuccagacuccccucccccaaccccaucuaaagcccuagaucgccgccuccccucccccuaucgcccucgcccccccucgccgcaauggacccacagggaaaggaucagaaggacccauguccauggucuggaccugcguguccaggcugggcagcuccccgggcuaaaaagagggggcgcccacgcuucucccucacccugucuaggccgccgccgccugaacccucgcucccucuacacggucccggcgccguagaacagucagauagaucgcuggucaggcaggcggacaccgagaugaagucuggaccgccggacuugccgcuccgcgcagacuccgugaucgaggugggggcggggccacaggaugccuuauuugcauaacccaguggggcgggagcacgaucacauuugcauaacccaguguggagugggcccaagccucu

SEQ ID NO: 4960 - RNA, 706 nt, Mus musculus
uaccuggagccgccaaugcucucgcgcuguggguguacugagcggcaggcucugaaggggccuucgcgucacgaagaggacggacccgcggccuuccccugccgccucaagggcggcugcaaacagcagcgacgucugcgcagagcgcggagcgccgagcaacagcaauggcggcccggcagcgccauccucuccuggccuugccgcgcagccggcauucagcacccgccucagcgccuccgccauuugcugagugccgcugaccaaucaaaagcgauaucucaucuugggcccgcccacacagaggccucauuggcuauaguucacagacuaaguucgucgcuggagcugucagccaaugaucaaaacacggagcguggaggaaguggguacuuugagggaauugcugcaagaagccgugugaucgauuaaaaggaaaggaaggucgaggguccaaacgugcuccaaagagacgcccaggcucuaggucggagcuguagagaauggcucagucguuacgagcacuggcugcuccuccaaaagacccggguucaguucccaccaucuacuaggugauucacagccaugcacaaguacagugugagggaauccgacgcccucuucuggacuccgcggacacguggcacccauauauuuauggccccgcgcuuauacacacacucauguaaaaauaaaucuaaacauu

SEQ ID NO: 4961 - RNA, 4684 nt, Mus musculus
cuuagaagcuccuggucagcuguguccggcagcugcugcugacccagcuguggacuaggggaaaggggaaagaggaaagggaaggagaggugggggggacgaaacaggggcgcuggagcccugagcuuccugaagcuagggcugcaucauggacaaacucagggugccccucuggccucggguaggcccccucugucuccuacuugcuggggcagccugggcaccuucacccagccucccggaccccaaguuugagagcaaagguaagaacuguacaugggcaaugcuguggucugaauucccagcccgagucccaggggcuaaauguccccugaaccuccagaugggguccuaggggccaaacuggugucugaacucgaugaggcaucucagagucuccucgcccuggagugaugcucagggcagaggcuuaagauugguugguuuguuuguuuguuuguuuguuuguuuguuuguuugaagcaggaucucgcuagacauuccaggauguccuggaauugcuaggaugaaaggcaugugucacucgccuguacuguuucugguuuugaggcggcgucuguguagccaaagcugcccucagacucauuauguaauugagguugagcuugaauuccugauucuccugccuccaccuccaguugcugggaugaccugcaagagccaacacauucggcucuguuucguguuuugagggagucugggauaugguagaaauggcaaggguaagguagugcuagguccgcucuccugggggaggggaucgagcucccagagacugugaaacagacccgcugcagacuguaaacucaguuuggcgggcggauggugcuagguccuuuggacggcuugcuaggaggaggaagggggcgggggacacgguuggcgcuaucgggggacagccgggugccugcgggaaccgauaggaggccgaguucucugcgcucacacacacccgcuagggcggggcgaacagcgcucaacuugcagggugagugggcgugcgcacggaggaguagaacaaggcaggcggggucgcuacucuugggaguucugaggcgccacuuuugcaagaccccucgaaggcccuuuuggagaagagggcggggcacuaaaauuaucggaucugcacaggcgacaagagggaggguaagggcaccguggaaggcagaccugggcuucccugaucucccccuccccccgccauggcuauccccuuuucuagcggcccugcuggcaucccggggcuccgaagaacuucugugcuucacccaacgcuuggaagacuugguguguuucugggaggaagcggcgagcuccgggauggacuucaacuacagcuucucauaccagcucgagugaguccucaggacuggguggccuuaggagggguggguagagcagagcuuccuggaugggccuggagacuagguuaagggugggaaacuccgggaacggaggaggggauggggguggugcggaugguguggaggucgccccuggguggccggagcuggaauaauucuuuuccaucaauggacucagguauuacguuggaauuagggcacuaccaucgugguagucaaaaaugcucugguccccacgauguggaccaaagaaauccgaaacucuccaaucaccuccugcccucccuacuuguucaaccuuuucuucuugguucccccgaucgcacaggggugagucacgaaagucauguagccugcaccaggcucccaccguccgcggcuccgugcguuucugguguucacugccaacagcggacacaucgaguuuugugccgcuggagcugcaggugacggaggcguccgguucuccucgcuaucaccgcaucauccauaucaaugaaguagguaggugagaggggaugggagcgacaucgaugggguggggaccgaacuggguccccgccuacaggauccauuucacuuucugcagugcuccuggacgcccccgcggggcugcuggcgcgccgggcagaagagggcagccacguggugcugcgcuggcugccaccuccuggagcaccuaugaccacccacauccgauaugaaguggacgugucggcaggcaaccgggcaggagggacacaaagggugagagcuaagagaacagccgcacccaaccuucccaaagucccacuccuucaagugccucucccagugcccaacaucccaucgcuauuuuaaaacugcucucuugccugacauuuagauauuuaaaaaaugauguuuauuugugugggagaggugcacacuugccacugugcacuuguagaggucaaaggacaacuuuugugagcuuucuauucccaucacuuggguccacugagccauaucgucggcccauaccauuggagcucugucccccgacccccaugagcauuucugauggaugcucaugccucuggggcaacccaucagagagcuucggccccuuucacaaccugguacaaauucccagauaucaagaucucugucaggugucugucucugccuuuauagggcccacagccaguuccugacuuuggggucuucuaucugauuggcuuugagccaagaacgggacugaucaguugauacuauuauuugaacacccccaaguacccuccccauaauuagggugccuccgugaaagcccccaaaucccuuucucacuggguguguugguuagcugucuccuggcuccacccgcccccagguggagguccuggaaggccgcacugaguguguucugagcaaccugcggggcgggacgcgcuacaccuucgcuguucgagcgcgcauggccgagccgagcuucagcggauucuggagugccuggucugagcccgcgucacuacugaccgcuagcggugaggcccuaguuccucggggugcaggaggagcugggccaaacaccaggcaaacucccugaccuucuugccucccagaccuggacccucucaucuugacgcugucucucauucugguccucaucucgcuguugcugacgguucuggcccugcugucccaccgccggugagccccucaccugaggucugacuuagaucguccccugggaucgcccuuucuagagaaagcgaaguucagauggggugagcacuugcccaggguaacaagcagcaggucagugcuagaacacacacacuccugaaugucacucuugggcaguggcuggaguucccuugaccuuagcgcaggcuccuuccugcauuccuuuguggguuccauuucccaaugucgucaacuuugucaaaucaaccagaaaguuuaaugggaaagauuuaagccaguggcuuuaaugaucugacuagcugagauauuuacaauucccagugcacucaaagcuuugcccuuccggcuuuucuguaagcacacauccuguuugccuuucauggcugcguuuauuuacuuuguugaaaaacaugcaugcaauuuuggugguucuggggauccaacccaucccuagccuacggacgggaauggugaagagugugaggcaggauauaccaaacuccuaugcauccuucaaaauucuguuauccuuugguggggccuugcuaaugccuccuccguagacuguugcucauuccugcaggaaugcugaaagucacuguggugguggguuuaagagggcacaggugagugugcagugucacagguccauggacuuguuucuaacgauuucaauaggacucugcagcagaagaucuggccuggcaucccaagcccagagagcgaguuugagggucucuucaccacccacaaggguaacuuccagguaggugaccuguuuguguucucuauucugggggcugcugcugccgcugcacacugaaggugccucugagcgcagguguucuuuuuccagcuguggcugcugcagcgugaugguugucugugguggagcccgggcagcuccuucccugaggauccaccugcccaccuagagguccucucagagccacgcugggcagugacucaggcuggggacccaggggcagaugaugaggggcccuuacuggagccggugggcagugagcaugcccaggacaccuacuugguauuggauaagugguugcugccccggaccccaugcagugagaaccucucagggccugggggcaguguggacccugugacuauggaugaagcuucagaaacaucuuccugcccgucugacuuggccucaaagcccaggccagagggcaccucaccuuccagcuuugaguacaccauccuggaccccagcucucagcuccugugcccucgggcacugccucccgagcuaccucccacuccaccucacuugaaguaccuauaccuugugguguccgauucuggcaucucaacagauuacaguucggggggcucucagggaguccacggggacucaucugauggccccuacucccaccccuaugagaacagccuugucccagacucagagccucugcaucccggcuauguggccugcuccuaggacuccagccuacaacgucuugaacgggauuggugaagccauacuuaaagucagagcugaccuuggcccucugagcaggaagagacagccuugcaauguuaagauuaagaguuaucugucuguauauagaaauauauauauauaucgauuuuucuaccuugac

SEQ ID NO: 4962 - RNA, 1133 nt, Mus musculus
gugcugaaugggcgugagcuucauaaccagaguagcgaagccuggacuggguggaucucagguggcagggccuccgaaaccaggcagcgaagggugggcagugaucuccaccuagaauccgguagaaacucaauguaaggugcacggagguggaacagagccucacugccaucccacaucucucuccggccucccccuaccccccccccccgcaguuccuggccacgcuagaaggaaagcugccccuauacaacacccgcauccuucugcccgucgccagugucaaggacaaguucuuuggucagugugggccaaagggggaugaaugggaggggcgcgagguggccuuaagucaaggccaaggaggaggugcaugguguggcgaaggcugggaagggaaaaagaaacggucccucacccuccccaucacccaccccugccucucucuguagaugaagaggagagugaggaugaugaccgugauguggugacccgcgcugccuucaagcuccguucccagaaguuaaucgaagcccgcagcaagaagcgcaauagguugcgcagaucuuagacucgcagucaaguccuaucggaugccuccgggacucuagggagcccuccgacccucuggguccaccuacggguggugugugucugggagccccggaggcuccuucaagggcuuggaggaagcucaagcagggagcaccgcaggccagcagcgcccggaggagagaaaaggccgagccagaaguucccacaguaaaucucucgaggcggguuggugcccgccucggaaucgcgcaauaaaggucacugaacaacccccuggguauucaccucuuuuugacccugcaccgcccccaaaaggcugcccccacaaaaugcagggccacagacacuucgcggcuucuagccugagauggcauggcuuccaucaccuaugguacagauucagugugcccuccuucuccuccagacauaggagacacccucgacaccugggauugaucaaccccaaccuaguauaaagcacuucccucccagggacacagaccuguugucguguccccugcacccauaugucugagugacagauugacccgcacuucugggaaggaacgggacuucua

SEQ ID NO: 4963 - RNA, 11442 nt, Mus musculus
ugaaauuaaaaaacagccacacaauguggacaagucacauuuauuguucugaggucacaggucaagucauccauuuaucucccaccagccggggaggcaggggugaggugggugcagggacuaacuccccuuaggaauccaagguaggcgagcucauuauucaucucuggaggccacuggggccucaggaacauggcuuggcaagccugggccagaaguggggcuuagagccccucaggguuccugcuucccagaggauggccaggaagcccagggugggcaggccuuggucugcagacuucaggaucaguagacugguugcaggccuugagguucuaggagagaagacagagauagggcugggauggagucacugcaagagcaugcggaagcccgagccagccccagcacuggacaacagugggguucagcuggcaggcggacugccuagcacgcaaacaggccuggguucagccuucagcaccacgaccuccugggcaugugguguaguagaggcaggacugacaacugccuggccuauguaacaaaacucucuuaagaagcacuuggggagaggugggggaagggcuggagagcuggcucaguaguuaagagugcgacugcucuuccagagguccugaguucaauucccagcaaccacaugguggcucacaaccaucugugaugggauccaaugcccucuucuggugugucugaagacaaggacuggguacucguacauaaaauaaaauaaauaaauaaaaauaaauuaaaaaaaaaaaaaaauaaagaagccgcagcagcagcacucgggaggcagaggcaggcagauuucugaguuugaggccagccuggucuacagagugaguuccaggacagccagggauacacagagaaacccugucucaaaaaacgaaggaagcaagcaaucaagagcuugccaagaugcucauuaggcacaagccuuuuacccuagcacacgggaggcagaggcagguggaucuacauggcaagaggcaggcugcacagacugguuaggagggcagcagaucuggacacuggagcaggcagcguccuuaccaggcuacagcucgucaugguccccaucacugggugcuucugguggcggcucugggcaggcugcuggugucaucagcuccaugagguacucacagcgacugggcuccguggugcuggucaccacagucucuuugccacacagcaggcgcaccuggggauuggagcggagcaggaggugggcugggcugucaggccuggauccccacggccccgccuuggguaggcacucacugugguggaucgguuggggcccugccaacagcccgugcccugcucguacuucaucgcacugaacuugucaugaucagggccagcccaggagccccaugugcuagggagagagcaggggugcucaguggcggccagagggugggagggggcaggagaagugcagcaaaucucaagccacucaccccaggcuggucggggagcccccauguuuggguuucugggagaccaguuugaaggggcaaagccgguagacguaccuaagggcagagaggacaggggugagugcccggucaagagccucauagcccuucucugccucccuaauauccaggcucaugggcaccccuggacuuugccugugucccguuuuugagacaggguuucauguagccuacgcuagcuucacauaugcugaaguuggccuugaacuuaucccccuccuugcacccacucauguaugcaccacugugcccaggcuaaagaggagcuggggauggagccccccugccucugcccuucagugaugagagcgcagauacaagcuguagguucuugucugcccagugcccuccccaucuuccucccugcccccgcugcacccccacccucuccagugccaggauguacucauugguggugagcucguagcauuggcuguagagauaugcaaacucuccagagggaccgaaaucaaaggagaucucuuguuccaaacuccuggaaaagcagguugagugguaaaggggggcauggugagcagagccagacuggcgccuccccgagggagucgguggugacugugacggggcagagacagccuuggugcccauaccugauggacucuuccaucucuuucaaggaccguucgacuuccucaaacuuacuccgggccuccugugcagcugagggaaaggagaucaaagcgggccccaguucagagaaugucacagcugccucuuacacucuaggucuguccccaacaaggacgggccccuaggccugcuacaaacaagugcagcccaugaggaagguggaguccuggggaugggaacccaccauugcaggggacgggagcacagacagaggugcucagaggugacagaggucaggagggacugacugcugacugggaggcuggaucacuuccagccagcuccucacucaccaucgaugauggccugggucuccucaucauagggcggcaucuucucauccucuguggggcugggaggcugugggggcugcagugggggcggagccuccuggggguggggcggggcaaggccaaucagcaagcagucccacuuagccaucugcccaucauucucccaacacacaccuugggcugcucccccugcaccuccuccucuuccucuuccuccuccucuucuucuggcuccuccuccuccucuuccuccuccucuguggguggcaacacugguggcuuuuccucuuugggcucagucuccuccggaacagguaugucagugggcgggaccuagcagacccaggagugugaagaccaacgaugaggauuuagagagcaagcucauuucauggcuggggauacuaguucacgcaucuggaagagguggccuccacaggggacugggugccagcacaggaggugguauuuuugugggggugggggcagggccacuuccccuccucucaccacagaccucagagcgguacuugucccugauggcagcccagacacggucauagaaggagguggugucagucugugugucuccacugagaagggccuguauauguugggguggggucagggucagggccuccacacacccauacacucugccccaggcacucacaaggaggggccaggccacagcagaggggccagguacucugaccaggaaggagagcacagcccucaagaaaggaggcacugggggcugggaaguaaggggacauuagaacaagauacaggcauacagagacacugugcaagagugcccuaaguacccuaaggcaaggucacagaagcgguagggaggauccaguuuauggcagggaggaagagggggcagagcuugggacagcacauauaggacucccacuuugaggcaucacacagaagggcagagggguggccaugcacaggagcaggcuccacacugcccgguacugguccagggucccacccgugcguggccagcaucaucugucucucacugacauggagagccacaguucaggcuagcagcagcucuugaucacagcuggcccgcccuggccccacucacccucaauucauucuaagcuaauggucucuacaagucccaagacaaggacaggcuggguaccugggccuccuccucagacagcgcuccaucuccaucuguguccagcuccgggugagucuguaacucagccagcgagacccugaguacagacaaggaaaugugaggcuccucugggaccucuacaagugagagugggggcugggcugagagaggcaggaggacucaaucauucuccauucuuccuuagaagagaccuauggccuuggaagacaucuaaacccucaauuccugccccacccacuuucaccuuugucaacaccucaaaaucacucagugcugacugacaguguccucacuugcagaggcugaggccagguugguuggcccaaggagcccccaugggcagcgcagucccacuuacaucccauccauguugucgucaaguuccuggaaggcacuggcugcccgcuccuguucccgccgggccuuggcagcagcuugcugcucuguguguggaggggacacucuugucacuaugugucacagugagccagaucuaccaucuccaaacccuguucuggauuaacaaagguuggagcccucugcgagggaggguggacuuaaggacaagguaaauagcuaaggggccacugaaaugguucagcaggcacagaagcuugcugcuaagccccacgaccugaguucagacccugagccccacaugguggaaggcgggcacugacuccugcaggucguccugacuucuccaugugcacuacagcacacaccuuuccauccuuacacacccacagacagacagacagaugucaagcgaggaguggguaaagccugggaggugagcaguuaugagaaggccuggucugggcaagcuggggcagccaacagauguguccccagcugccagcaacagcaacagugacacacaccuggaagagcuccgcacagcugauagaacagcagcguguuuagccucacaguggccagaggccaucagggacaucugaaccaguacagccacucacugcucagagccugccaggccaugagugauuugucccagcaggagccugcccucacuuucccuucucagcaucccucaccuugguaccugaucuuuuccaacuugauucagggucuaauguacccuaggcuaguguagcagaggcuggccaugaagucugucuuccuuccuuccuuucuuccuuccuuucuuucuaauuuuccuguuuuucauagggucucacuauauagcucuggcuguccugaaacucacucuguagaccaggcuggccucgaacucacagagcugagugcugagguuaaagaugugggccacuaugcccagcugacucugaauucugguuuuguuuuuuguuuuguuuuuuuuuuuuuuugagacaggauuucucuuuauagcccugcuguccuggaacucacuuuguagagacucugaauucuuaguccaucacauaaggcuggagcaguaguaguucccaaggccuggcucucccuauguuguuagagauagggucucgauauguaggucaaguuggucugauaucuauaauccuccaggggcuaggaugacaggugcugugccugcuggggucagcagaaccaaaaucaaaguuaaggugggggcaccaacaggagcgcuuccaacaccucaggagcauggccucccucagagaggcuagagcagagaaaacaugcauauaucugugcauccucugugcaggcugaaggcuuaguacagugguagagccccuacccagaaucccucagugaggggugggugacgugaguggcaaggccccgggcuggccaagcaucuguagggcacuagauucauucccuggauacugccugaggucagaaucucaaacccucaacuugggcuuagcaucccuggaggagaagguccucagcaccagacaggggaaauaaucucuagaaaaggcccucccaccacggccgcaucccuaugguuuccacgucugaugaccaacacaaagauaaccaggcacauagagaugagccaucaugacaguuuaaaaaaaaaaaaaccuaaccaaucaagaaaccagaaacauccugcaggaccagguucaagguucguggauauacacugaaggccagccugggcuacacauacccugccucaagaagcagaaugggauacgagggcaccuggcuaaggacaggcccgugucaggggcagcucuucaggacaccaaguccccagcccugagccuccccacagcauaccuucccacagcuuccggugcugguccuuggccuccuucucuggccucucugcuucuucuuucgcugcccgcaguguuucuaccuggucuuccagagacuucuuuccagccugaagcucaagaagcuuacucugcagaaaaaguggcaggguggcgggugagaggcaggcucuaccucagcuuugucaugucuuccagccccaagaucuuccccacacacccacaucccagggugagacugguucccgguggcucucugaagagccuagagcuugaugcaggcaggccacgaugcccugugugaucaggcccaccugucccaccccaucauuuaaacuucacuuucuccacaagucacuuuuccugcccugaaacucaaggacaacauucaggacccccaccccccuuguuuucaguucuuucgaucuggaauacuuuccauggcugacuuaaauuacccuaccaauuuuaguuaagauagccccuccuccaggaaauuuucauuuccugccuccgagaugggugaggguagccaugcaagaaagcucuagauacccugagcuucccucuccaucagcaugcugugacuucuaguacucccgaggcaggcacaggucugguucuaaccugcacaacacccaguacagccugggugucuauuuauguucugagaagcaacagggcuggguuucagaacggggcagagcaggccuagagccccagaguacagacugggguguggcucagugggagaccccaaccuagaauuccccagugggggcugggaguguggcucagugguacaacucucuuguugucucaggcaggcugggguuguuacuuacuaccagaaugucugccuagcuuguacaaagcccuggguuccaucuuuaagacaaaaauaaaagaaauugauauguacacacggugcugaaagcauucaaucccagaacucaggaggcagaggugggugaagcucugugaguuugugggcagccagagccacacacugagacuaugccucaaaauaaauaaauuuaaaggggggauggggagaaagugacaacaaaaaguagcccaggcaagcucugggagccaggccuuagcugccucagcccuugugugaugcuuuccugccaggguuaggaccaggaccugcuccucuccccucagguaacacagaaguuacacagagcuaaccucaucaacuuggcuccccagaugcccaggauuugaaagggcaaucacugcccacugaacuuagcaggggccugccagccuccucaacucaaagauauuuuccaaucccaugagugggagagaagagccugcaaucucucuuggacagacagaguuggagucccguuuuugcacacugggcuugcuuaccacacugagucaauauagcauucucuauuaaaauuaagcuugagagcuuuccccagaacuaggguauugauaaccacuagcccagguuacagacaguggggcuggggguacaaagagaucuuucugucucuaggaguuaacacuucugucuuauuagcugaaagcuucacacuugggaaaugcucagccaaccacuccacaugaacuaaggcagacaagagcucaucacagcccaacauucaauguucacucuaccgcauuugccugcccgucacucagagaccccaggcccaagagguuguacccacacaucucucuggucccucaccugcuuuucuucccgggcugucuuccacuccucaaugagaaucuucuucaggcggaacccuucacgggugacuuccgccagcugcugcagggacucuuuuuccuugcgacccuucucucugggguugacacacacaaguaccacuaaagacacucaggccccagcagguuuuccuuuuccagaaggcugggugaccugccaacuccagccacauccuccccaugaacgauggugagaaagggaagucacagaaaggaccccccucagccugccccuccaggugcuucugaccaaaaaggccucggaucugucccuaagaagacagagagcacacaaagcuugccuguccuuaggacuacaggacugucuaggaaguggugaggaacagguuuggagguuagaccccaaagugaccaagagguggaagaauaaaacccagagacucaggcuggucacccacaggcucaggcuggucauacaggcgcacaccuuuaaccccagcacuuggaagacagaucucugugaguuugaggccagccuggucuaugugguaagcaccaagccagccaaggccucagaguaagacccugucucauaacaaaacaaaaaggcaaaaccaaaaccaagagccagagaucugucaggugugcugacaauuacaucugucauucuugcacucagaauagacaagcaagaagaacagcaauucacgguuauaacggccagccaagcaagccugaggcuagucugggcuccaugagccccccaaaauaaaucaaagcccaauagggcagcauauagcuguguucccaguaacuggaggaggggcagaagggucaucuacaaguuccaggccacccaagaggagccugacaccauucucaaaaagcaaagcaggcugggcagauggcuuggugaguaagaaagcaugguauauaagcuugagggccugaguucaaauccccagcacccaccacaaaaagcuaguuguggccauacagcuagaaccccaggcuuaggugggguggagacaggggauugcuagagcuugcuggcaaccagccuagcuuaagaguuaguguaagacugucucgaggaauaaagagggaaagagagcaagaaacccaacauguccugucagcauccacaugcacacgucuguacacgugugcuuacuuuacacuuauacauguaccacacaaacauucaaaaaaagagacugaaaaaaaaaaaacaaguacugagacuuuaaccuaacuagagcucagcuucaaucacgagucaucugucuuccugcacuuacugugucguuucguccaggguuuuuguuugucugucuguuuugagacagguucucuggcaagccaggcuucagacucacuaugugagccaagggugcucuugagcugugauuacaagccuucacccccaucucccauuuauaaacagguaaacaaucucaacuaccucagaccuagagggaacgcugguaaugugggaucccaaggggcauggccauuggagucacaaaagaauggaaggagccgugggggcgcacgcuuauaggagguuaaggaaggaggcgcugacugggcccccagaggaagagccuguaucucuaaagaaacuagggaggagcuggagagacuucacuagcugaucuuccuuccagaggaccugagucuggacucuaacuccagcuccagggggucacacgcccuccccugaccucagcagaugcuaccccucucacacgcacauaacauaaaaguaaaccugccucccuagugcugggccugcagaccugugccgccacacucaguaagugacaaucuuaaaaggcaaaggcgaggugaaaaaguaagcggacagggaagcagccugacuuccagguaggggccccacccaccugcagguguucucgcagaccgugccgcuguuguacucgucugugccaucacagcagucugaagcaaagguaagggccaagagcagagugggugaggucucccccuggcuggcccgaccuuccccagauccugggaggacccgcacugcacuuaccacauaccccaucauugacccggcuggagaggauguacaagggcuuguacccaguguuggugcagugaaagcugccauugggacaagcagcugugccuacaggaaaaaaaaaaaguuugaugcguguuccccacgccacauuuguuuguggggggcuccagcaaaguaaguguaacucgggugugguggugcacgucuguaaucccagcacucugguggugaucacaggauaacccgugguccaggucauucucagcuacacugugugcucaaggccaggcugggccaccagagacugugucuccagaacaaaaauaaacuaaagcacaaccaagaagaaacuguaucuucaggggccagcaacacaauccuccaguauuccccagcuucuccggaggcccuucaaaaaggccaggcaacuccccuccacuccucuuugccuucaucaaucccuagaaggccauucaguuucccuccuccucccacuucugagagggucuucuguuggcucuuccugacucgaaaccucaccuccuccugaaugccauucaugguuccugcaaugacauuugcugacuuggucauacaccuggacauuuguuccuuugauagggaauggaaaccaggacuggcaccuacaaacacugccccucagcuaauccaagccaacagggaucuuguuucugugccugcuucugcucacugagcaggaagcaacaggagagugagauccaaguucuuuggggcaucugcgcuuagcaggcucauuuaaugggcgaugggcaaaugcaaacgcucaccaggcucaucugaaccguccuuacagucgcaguagucgucguucaccugaucgaaugggaugguggcugugccguccaaacaggugaaagguuuagauucuucauagaagugauggucuggugagggaaacaagaagcucugcucagaucuuaaauaaauauuaccucugucccacucacucaccagcugaaaugcuacgggaaacggaggaaaaaggcugaaacgccccucccgaugcacaaagaagagacucacugcugagggaaacgccccggggucucuuaacuucuacagcccaacagagggguaguaguaguagcagcagcagcagcaucccguccgggccgagaccggaaguguguuaugcggcaggaagauacgcgauggccucucacuguaggaaagaaugaagaagcaucuaaucauugggagaaggcagcuuacccaagaccggccucaccacugcuuccggaaaaggagggcacaaucggaguuggaagugcaagggcaaggggcgucucuccgccccgagccaguggaagagucucaaagugaacucaaaaccauaggucucucgguaaagaggugaaaugggcaacucccgccaaagguucaaaggauuuacgaucccuccacaccacccacccugcugcaaccuauaagaaacuagggugccuuccucccaucgcuacuucaucaccuacgcgagguagaggcaaaggucaauagccaccacaccagguuagcucagcagccacgguuccugcaguagaauaagagaacggaacgcuccggauacgucacuuccguuuugcucaucccucuuggcgaacggcaacuccgggacgccauguuaggaguggcaagagugcgugugcgggcgcugaggcggccaucuugaguaggaacaugaagaccuaaccuuagaacagaucggaaguguagcgcuuaauggcggcguaacgugccuccaucuugggaguggcgg

SEQ ID NO: 4964 - RNA, 70955 nt, Mus musculus
ucgacucguaaccggaagcuccguggcucaacaugacagcguccagcggucccacagagccggcucgggucugcggcuggccacgugaguaggugggucgcgcgugggagguuuaugggacugucugggauucggggcguccacuuccaggccugguagagccggggaggaugaccuucaacucggccucagagucgggacacugugaccuuuuggggugcaggcuugggaacgugccuggaaagguugcugggcaccucuugcugcaggcgguccguuucacagaugggaccgcggacuugggccacacaucuugucugugacgcaggcauuggaaccuuccaaugagaccucuuagagacccggaaucgugccagcccacacgcauacacacacgcgaccuggcuguucagauuucucucuguuuuguagaaacuugcuuaguuccacuccguuggucgguguugggcaguuaccauguaccaugcacuggcccagcuaguggagacacaaccagauuuuaaacagaaaucagaugagaaaaacagauuuuaaaaaguauuuccuaauugagcaaaccacaaacauaacagauaauucaaaacagugauuguugcaagcaauguguuuuucccugcgacaagauucuuuauguaccccaaguuggccuugaauucaucaugaacauccuccugcuccagccuucugagugcuggauuacaggcauauaccaagacaguaaguaguaggcagaggguaaaagaaucguggugguacacgccuuuaaucccagcacucgggaggcagaggcaggcggauuucugaguucgaggccagccuggucuacagagugaguuccaggacagccagagaaacccugucucaaaaaccaaaaaaaaaaaaaaaaaaaaaaaaguucaaagcccgugccugaggugcaucagaccaaaacaguguggcuggaguuaugagagagaggggagguacagcagguggacuccauccgauguguauuuacuuugaaguuuuuauuuuagccaugguauggagguggggcacaugugcacuggugcaugguggaggucagaggacagcucuggaguuuuauccauacaccuuauguugguuccaggguuuaaacucaggucauuagguuugcuuuguuuguuccaacagcaaguuccuuucucagcuaaauuuccucuccccacucuuauuuauuuaaauuuuagacaggaccuuacuguagcucagacugacaugggacuuacuaauuaucaccagcugguuugauucuggaggccaucuuccugccuauguaguccuggcuggucuggaacuugcuaugccuauauagaucgucucaccucaaacucagaggucugccagccggggucucccaagugcugagauuacagguaugugcuaucccacccagcaaucuuauguguucauauguggguacagggauguauguuaguauguguucacguguacaaaggacaaaugucaaccuuggauguugucccucaggagcuguccaccgugugcucugagacagaucuuucagugggacauguagcucacugacuaggcuggcuagcagcgagcucggggaccugcccuuuuuugcuuccuccgacugcucagauugcaagccgcuuuguauguagggcucaagcccugguccucauacuuucagggcaagcauuuuuaccaauggagccacauuucaagcucaccuagcuccuguuguuaaaagcuuuccuuugcaauggaaggaaguaacugggagggcagaagagagagggcaaaaacguaugcaggagaguagaccacggacugcuguggugaccugcaagagggauagauuuggaagccaucuucagaacucggauggauugaauagggacacagugaaugcuggaugguuccuacguuguggcuggaguaagcacuggugcuacuggcuaccuccagagaagcacuguaaacaaaagugcugucaguugguguucccugaauggaguuugggguggcugcuuuguaccagaguugugcuucuguaggaggcaaacgcaucagggaaccaugagcaugaauacucacgacacugauacaaguuggagccaccuaugggcauuacaaugcagauucucaugcaguuagagccaauauuuuacagguccuggaacacaauuugcaaagcaagguuuuagauucuuuucaucuaacuauaccaagcaaguacauaccaugagccacacccucagccucuaacuggggcauucuaggcaggggcucuacuacugagccacacuccuagcccccuagcagaggcucacgggggccagcagcucacuggaggagucuaggccaggucuguauuaccgagucacagccugaguccgguccaauugcauauccucagaccagcagcuguugcuaucaccugaaaguugcagaagggcggacauauuuccacuaagccugaaucugcaggcuuugugcucccagggcauuugucugcauccucagcuuugcagacacuguggacacugaaagccaucucaugauuggcugagaaauaggcauggaugcuaggaagaaacccaagauguuaacaagggcugaggggaaggggacuucacuaucuaauacuugggagaaaguugacaucuugaagucauuggcuuccucaaagaguugcgcacaccaacucacuggacaggcauuacuagggcagccaucagguugcugaggaaggagccagugcguagacauggcuaagguguagcuuuaaugauaagaaagcagggagcugagcggagauuuugggccaaaaugggagacacuagaaaagggguuguuguuuuuuuccuuaaauaaguucucauauguaagaacuuggcacucacaaaggucuggcugucuuuacauccugaaugcugggauuaaagguguguguuaccaugucuggcucaacuagagaaaguuguuuguuuguuuguuuguuuucacuuauuuacucugcgucugugugcccgugccugucaugccacuggaggaguggaggucagaggacgacuuguggggucgguucuccccuuccacccuggauugauugcagggauggaauucugguugucaggauggcagcaacugccuuuaucugcaaagccauugugucaucccaaagguguuuuguuguguuguuuucuuuuccuguauuuuuuuuuuuuguuguuguuguuuuucaagacaggguuucucuguguucccuuggcuguccuggaacucacucuguagaccaggcuggccuugaacucagaaauccgccugccucugccucccaagugcugggauuaaaggcaugcaccaccccugcccagcucuuuuccuguuuuugagacagguuugcauguaguccaggcuggcuucauacuuuucauauugcuguguaucuaaggcugacccaaggcuuccaccccagugcugggauuuacagguguaugccacagcacccacuucugcaaaguuuuagugguggcaagaacgauccaaacucuuccuaacauguucucuguggccuagauaccccaauaccaaaaccaaacagguauaccaagaaaacuguacacaucucuuaagcucucuccuuucuuacgcucaucucuagcccuccuucucucccacucuucucccucucuccacguggccauggccagccccucucuuucuuuaaccaucucucuuucucucugcccuucuacaauaaagcucuaaaaccauaaaaaagaaagaaagaaagaaagaaagaaagaaagaaagaaagaaagaaagagagaaaacugcacacuagugccucuugaauaugacuauaaaauucucucgcaaugggcuugcaaacaugcaaaaagaauucuacaucauccuaagagaauuuaucuucaaaaugcaagguuaguuuaauaucugaacauuuauguauauaucaauagaaaaaaaacccuaaaacuacaugauuauuucaggcaaugcagaaaaauauuugagaaaauccaacacuugcucuauuuauuuguuagaaacaacaucucucuguguagaacacacuggcugcgcugucccugcaagugucauacccagcacugaguccagauaagguuaagaaggaaacuuggagccgggcagugguggugcacgccuuuaaucccaguacuugggaggcagaggcagguggauuucugaguucaaggccagccuggucuacagagugaguuccaggauagccagggcuacucagagaaacccugucuuggaaaaaacaaacaaacaaagaaggaaacuugggucagcagaacuuagcugguccugguuccaaacuucuggagucuaaugcugagugacuuauuucuugcacauuuaagcaguaaaaguuuggggauaaguguacacgagacaguuaucacaacaaagcuuuaggcauggcugcauugaaaaucccuagcaaagcaccugccccacaagaguggcuuuuguuggcugagaacagugaucaggacaagggcccauggaagaauaagcagaauagcaaucucuuuugcagaauacaagggcccucuuuccugaaaaugggcucuacugacugagacaaagcucucaggauccuggggugcuguggggcuggcuuuauagaggaacaaagucugccaaguauuaacacguccaucuccagccuucuggauggaaaaugggagucaguuucuucuucuuuagugcugucuguaagcucugcucuaucuacagcuggccucgaacucacagauaccugccugccucugccuccugagugcugggauuaaagcuaugagccaccaugcccagugaaagaauagauucuuuugccaggcaaggcugugcacucuggccacuugucaguguugcaccaagugucugguuguagcacucaggcaggaaaaggaccuagagcugccauggagacagugcagauagguaagugcuuccugcaggagccugaccaccugagcucuaucucagguacccagggucaaaaggagaugggacggguaagauggcuuacaggguaaaagugcuugcugccaagccuaaggaccugaguucaauccccagcacccacaugguggcucccaaccaucugaaccuugaguugcagaggcuccaaagcccuaugcugaugucuucaggcaccaggcacucaugugaugcaccuacauaauggaaaaauauucauacauguggcaaaagaaauuuuuuuuuaguuaaacaaaucagccaguuggcgguggcacaugcccagcauuuaggaggcagaggccggcagaucucugugaguucgaggccugcccaagcuacggaaugaguuccuggacagcuaaagcuacacagagaaacccuuucuggaaaaaccaaagaaaagagggagauaguuugggauaaaggugcuugcuacuaaucacgaggaccugaauuccaucccgaggacccacguggugggagagagaacucgauuuugcaaguuguccucugugcuggugccuggcacauuuguauauacucucaggaaugcacacauaaaguuuuauaaaaauaacaauaauaauuuuguuugcagccacacuuguugucaggugacuccuacuuccuucugagcccacucucucuucuuaagagauuuuauuuauuuuauguaugugagcauacuguagcugucuucagacaccccagaaaagggcauaggaucccauuacagaugguugugagccaccaugugguugcugggaauggaacucaggaccucugggagagcagucagugcucuucuuaaccucugcaucaucucucuagccccugagccccuucucuuaacccuugugcccaaccaagccugccuucuuuuccuuuuaaagauggaggaggcagagaaagggaauccuuggggcccacuggucagccagucuagcuuaacugguaagcuccagaucagugacagcugucucaggaaacauggugcaugcuguuagucccaguacgcaagaggcagagguuggggaucucugugauguuugaggccagccuagucugcauagcaacuuuuaaaccagccugggcuaguaggacccugucucaaaaagaaggcuggagccagguguggugguggcgcacgccuuuaaccccagcacuugggaggcagaggcaggcggauuucggaguucgaggccagucuggucuacaaaguaaguuccaggacagccagggcuacacagagaaacccugucucaaaaaacaaaaaacaaacaaacaaaaagcuagaugucauggcauuccuaaagugagggagaagacuacugaaaaguuguccucuggccugcacaaaaguauuguagcaugugaaccugaguauacacacaaaauaaacaggcaagucuuucaaaaaaaaaaaaaaaaugaagaggcuggagagauggcucaguggguaagaacacugagugcucuucugaagguccugaguucaaaccucagcaaccacaugguggcucauaaccauccauaacgagaucugacuuccucuucuggagagucugaagauagcuacaguguacuuacauauaauaauaaauagaucuuuaaaaaaaaaugaagaagaaaaacucccagguaugaggcaguggaaugauuacuguaugaaggugcuugcugaagccuagaaaccaagcucuaugcugagacccacauggaagagagaaccaguucuccaagcuauccucagaccuccacacaagggcacgcacacgcauacaugcaugugcaugcacacaugugcacgcucacacacacacacacaugcacacuaaaucaguaaauauaguggaaagauucccaagcaugauagcucacaccuguagucucagcacuggggaaacagaggcaggaggaucaggagcuuaaggccacccuuggcuaccugggcaauaugauauucuauuuuugaaaauaacaaaaucagacagaaguaacccuuggagcuugguggacuaggcucuucugucugaacugugcucuuugucauagugacgcccugucucauggaagguaugcugcaggcuaaugcugucucaaucccucucaacuaggugugguugaaucuacagagacaugagcugggugcaggucaacuugcuggugcgaagccucucuaggggcuggggaggccucugcaggccugcccuuucaggaacucccuuugcucagguaaccacaggcugggcauuuguggguggagagggaacggccuggcuuuacucucacccucucaggaucaggccacagaaacugaagguggcccuuguccugccuguccuaguugugguccuguguuagcuugccaucgcaguacuaaaguacuaugaccauggccaaaagcaauuuacauuagaaagagugucuugguuuacaguuccaaggguagagucccuuauggcuguuuguggccagaguagaaacuggagaucacaucucaagcauguaggaaggagaacaaccuguaaaugagaagccgguauaaaccugaagguucuguacccucccugugcacugccaccagcugggccaaguauucaaauacgagagccuuugagggacauuucucacucagaccaugacaaucugccucucuccuggccacauagacuccugacacuaucaugaugcaaaaugcauuucauccaauuucuaauguuccuauggucugucacagugucaauaccauuuaaaaguccaaagucuauucugagacucgugcaaucucgcaacugugacauucuacguagaaguaaaucacacucuuccaucagggaaugacacauuccauccuuccauuccaaaagggaggaaugaagccaaaaugaagaaauacugaaccccaaacaagacugaaaacccagcagugcaaacaggaagcccuguagcuccaaugugcucagacagccccacuccucuagcucagcugcccuaagccauaccccaccccagacuggcuccagucccugugcggcuguccuuggcagacaucucauagcucugacaucaccaacaucuugaggucugcucagcagcccaagcuucacucucacagauugaugcagugguauccugggaccuccuaccuucucaggauucuugcuuccuuccugccuucaaagccaguaccauacaacacugccagauuagcucaugguacuucaucacaguaacagggaagcacuaguacagaaguugguguccacaaauagggugguugcuauaaagacccugacuguguuauuuugggaagguggaagacuuuggaaauuuggucuaaccaagcaagugaaugcuguaagcagaguuugacaggucuguggggaaaauucucauucaaaccacaacaaugugguccuggcaaugcuucuugauguuuucuucgcguguguguaugcguguguaugcaccauauguaaucucauauggccuuagaacauguauguguggcucaagcaaguauugagcucucaauucuccugccuuagcuuccuugggguugggauuucagguguguacuaccauguggcauuguacuuuaauguacuauaucaugauaucuaagcuacgguuagcaguaacaguaucaaagcgccuaaaagguccuccaugauguccaggguaccucugccaagaaacagaaaacaaaaagcaggcaccauccuuucucccaggugucccuccaggcucuacgaggccuucacuguagugcagcuacacacaaggaugagccgugguugguuccucgacccccggagccccagaggaagcccaucaagguuccagcaaugcaugaagacucguucaagccaucaggaaacagggagcgggacaaggcaagcuuccugaacgcagugcgcagcuuuggggcgcacaaugugcgcaagcgcggccacguggacuucaucuaccuagcacugcgcaagaugccagaguuugguguggagcgggacuugucaguauacaaccugcugcuggauguuuuccccaaggaggucuuccggccccgcaacguuauccagcgcaucuucguccacuacccacggcagcaggaauguggggucgcaguccuggagcagauggaacgacacggugaggaaugugggcccagccuuccuucgcauccuucuccacucaccuuucucagucucccaaguccuucgccugccccuccccucuccccucccucuuccaauuauuaggcuugggcuguagaaaaguuggaggaggacuuaccugggaugucuccaggcugauccccuguaucuaaaccucgggugcuucccugucaccucagcuccuaggcagugaggggagacagggcuucaagcucauccuucacuccguaugguucuggguuuuuuuuuuuuuuuuuuuaaagaauucuuuuuuuuuuuuuuuuuuuuuuuuuaagauuuauuuauuuauuauauguaaguacacuguagcugucuucagacgcuccagaagagggcgucagaucuuguuacagaugguugugagccaccaugugguugcugggauuugaacuuuggaccuucugaagaacagucgggugcucuuacccacugagccaucucaccagcccguuucugggguuuuuuguuguugguugguugguuugguuuugguuuuuuuguuuuuaugauuuauuuuuaauuauauguaugcuauggcuggagagauggcucagcaguuaagagcacugacugcucuuccaaagguccugaguucaaauccuagcacucacauggugguucacaaccauccauaaugggaucugauguccuauucuugugugucuggagauagguacaauguacucacauaaauauaauaaaucuuuuuuagaaaaauuauauguaugcuauguguuaguggguaugugaauucuggugcccaaggaggccagaaaagggugguggaugcccuggaauucgaguuaaaaguggugcagugcauacuccuaauugcugagcuauuucuuucuccagcccucuuuccccaacacacacacuuuacauggucucauguagccuaggcugcccuugaauuugcugugcuggguagccaugucuggccuuggcagguuuuugccuacuguuccaagugcugggaucucaggcaugugcaacagugccccuuuuauauggugcugggagucaagccuuccaccguaugugccagaccagcacacuacucaacugugcccuagccucagccucagcuuccaacaaacaaacaaacaagaaaccauggaugggccagaugugguagugcacaccuuuuaacuccagcaguuggaaggcauggacaggcagauaucugugaguucugcucuauagaugacagacuuccaggccagccagggcuaccuacauagcuaguagcaagacgcugucucaaaguaagaagaaaacaaaucaugaaaaguaaaucccuuguaauucuguucuuacugacuucaaacuuguguuuaacaaguccuggaucugcccaaaacaggggucaugcccagcgcagagacagaguuccuacugauucagauauucgggcgcaaaaguuaccccaugcucaaguuccugcggaugaagcugugguucacccgauucaagaauaucaaccccuacccagugccccgagaucuuccccaggacccuuuggaccuggccaagcuaggccugcgacacauggagccugaccucagugcuaaggucacugucuaccagguaugcauuccuguauacaugucgcugcccucccuggcugggccuuacugcuucccuggguucugcuacuguccugacagugaccgugaucgucccuuuauuaccacaguuggaccugucuuagucuauuuacucauuggaagaaaagacccuauauccuccucuuguugcugaaacaaaauucuggaggcuggguacuuuauaaagaaaagagcagccaggcacaguggcuccugucuuuaauccuagcucuugggaagcagagaugccuggaucuuucugaguuaaaggucagccugggcuacauagugcuucaaacaaaacaaaaaaccacugacgggccagguguggcccguacauagggagcucuaugucagccagagcuacacaggagucucugccuuauucccuguugggauggagcuggggguauggcucagugguaggacaccugcuuuccuuguucaaggcuugugguuccauuccuagugagugacaaaagagagaaacuuggcuuuaugcuguaugcuaggcaagcacuccccagccgagucaagcucuugauaccaucugaagaacuguuacuuucugucacugccauuuuugcgcauggauaaacugagcuauguagguacagugacuuggauuagcucacugcaggcugaacuuaggcugauggcuucuggguaaacucucaguguuggcacucuggucaagcuggcuacaaagaagcagagaaaggcuacuuguaaagacguggugcagucgcccaggaagcaccccuucccucccuuugcucuuaggcuccccuguagagguuggggagucaccgcccugcucuucuuugcagaugucuuugcccagugacucgacaggcauggaagaucccacacagccucacauuguagguaaggccccagccuaucccaguuucugcuggaucccucugggcccacuaaaugagcuccugggccuuuugcugcuaaggcaccaacagguucucaucucuacaccaggaauccagaguccagaucagcaagcugcccuggcccgccacaacccauccaggccuguuuuuguugagggccccuucccucucuggcuucguaauaagugugucuacuaucacauccuaagagcugaccugccaccuccugaggaagaggugaguuacuggccaaagcauuugcugccaagccagaccaccugaguuugacccccagggcccauguagaaggagagaucucacuccuacaaguuguccucugaauuacacagggguaugcauaaauguuuacccaaaaaaaaaaaaaaaaaaaaaaaaggcaaggcaggccgagcucucugaguuuaaggccagcuuggucuacacagcaacuuccagauuagccagaacuacagauucuguguuggggguggggcuggcacuguccugaaggcucagcugagggacagguuuuguguucuggccucuaauccugccugcucucuugccugagguagaaaguagaggagaucccagaagaaugggagcuguacuacccacagaagcuggaccuggaauauucaaggagugguugggacgacuaugaguuugacguggaugaagguaaaagcaggucucaacacagcacaucugugugguggccauuuguccacgcuccacaggaugaggggucauaugccccccaggguaccucuccuuggcuacucccucuccccuuuguacuaucuuuuaaggagcauucuauacugacuagugaugugaccagaauacgcgcaagccucaggucagcagggaacagucaaguuauauguggggaguugggaggaggcacaugguagccuccaaguuagggcucaaacuuagucucuugauaguaucugagcagcggguggcauggccaagggaaauguagaacauuuauguggcacagggagcuggcugugaacucauggaggugcucagaguacgucacaguggugagacacaaacucuucuccuaacagugacagaaggcccugucuucgccaugugcauggcuggugcccaugaucaggcaacauugaucaaguggauccaaggcuugcaggagaccaacccaacccuggcacagaucccagugguauuccgccuggccagguccacgggggagcuccugacaacuucaaggcuggagggacaguccccuccccacaguccucccaaggggccugaggaagaugaugagaccauucaggcagagcagcagcaggggcaaaguugagucagauagagcuggcaugaggagaaaagacugggcugguaugaaauaauauggagaaaauaaaaaaaucaaaaccucuucccuggcccuguggcuucccuucguauguucugcaugggcucuuuuggguuuaccaccuugggacccuuuuuuaaacuugucuuuucaaaaauuccauuuauagaugggcgugguggcacacgccuuuaaucccagcacucgggaggcaggcagacagauuucugaguucgaggccagccuggucuacagagugaguuccaggacagccagggcuacacagagaaaccuugucucgaaaaaccaaaaaaaaaaaaaaaaauccauuuauauauuuaugguaugggagggauguguggaggucagaagaccauuugcuggagucuguuccgauauaugacccugugaaucucggaaauguaacucagauugucaaguaugccagccaucaccuuaccugcagagccgacuuguuggccuuuaaaaacaucuuuuaaauguauuuaccuuuauuuuaugugcauugguguucugcauguauauauguuuaugugagaaugguagaucuuggaauuacagacaguucuagcugccauguaggugcugaauuugagcgcagguccucuggaaaagcagugagugcccuuaaccagugagccauuucuccagcccuuuugaaaaaaucuuuaaucacauugccgaagaauucaauagagaggcaaggauuaccugaguuucaguacccagugccucuaccucccaaauaacugacuugucaacagaacgcacuuccauggccugggccggacggacuacgcgcaugcgcagcuauggcuaguuguccccguuuggcgccgcgggcagagaagacccugugagaaaucucccggcggcgcagacuaggcgcgccacuuccggucgaggcuccuaacaacgggggaggccgguaaccagggagggggggauggcggagcgggcuccagagcccggggcggaggcggaggcgggcgcaggcggggaggcggcggcagaggaaggcgcggcaggcagaaaggcgcggggccggccgcggcucaccgagucggaccgggcccggaggcggcucgagucccggaagaaguacgacgugcggcgcguguaccugggcgaggcgcacggccccuggguggaccugagacgccgcagcggcuggagcgacgccaaacuugccgccuaccucauuucgcuggagcguggccagcguagcggucgccacggguaagggggcgcggggccgggagagggagggagggagagaagaagccgggggagggacgaaaagggcagcggccccgcccccggagcgugaagccccacccccgggccgccuggcggcccucggucucgggcuuaggcaacccagaccccucacgcgccuccucgcggcuccgccuccgacccauugacuacccaaugcaagccugugccccaccccucugcccgccuucggaagcuccgacuggcccgucugaagagucgacccgccuccacuggccuggccuggggcuggcucucagguguaaaccuccaaaggugcugggcacucugauuuucugcguaugagugccuugccuucguggauauauguguaccacgugcaugaacuaccugcagaggucagaaaagggugucggauccccagaaaccaccauugugaaccaccauguagguugugggaaccaaacccggauccucaacaagaaagcagccuuaacccagccaccuguuucaacaaccuugucaggguuacuugugugcauccugagugcugggacuaaaggcaugugccaggcuuggugugagggcacuuuuauucuuguguaugugugcgugugugguguauguaggcccacauaaggaggugggaagacagcuuugcagagcuaguccucuucuaccacgugcccucuagggaucagacuaagaccaugaaugguucaccacgcuguaguugucagaccuauugguaaacugucaugugcagcuugccacacugagaagcaggcucugaaaguguagauggccucuccuguuugagacucaagcaugucucucucaguguccuccaggaagagacaaggacagcagaagugcccaagaguaaaaaccccaugcccuuaagaacagcuagaagguggagcauuuccaauagagguuacuccugcugucucacagugcagguguccacagugggaagacaagcuggaugcuaagccauggagggaaagcucacccugggacuccagcuguugccccagcuuccccagccaguagcugcauggugugaacacuggauuggauauuaucugucugguuugcacagacaguuccagccagccagggcugcauaacgauacucuaucucaaauaaaauacaaaaugaaaauagagagcauagaaaggguuuggcccauaguaaggguucagguguagcguguucugcucuugucugcacucaucuguaugaaugauucuuuaagaguugauucuaggcccugaagagguuggaucaguaguuaagagcauuuguugcucuuucagagggccuggguuugguuccagucaccagcauugugguucacaaccaucuguaacuccaguuccaagggauuccaugcccucuucugaccuccaagggcaucaggcaggugcagagacaugaaugcaaguaaaaacuuaugcacaugaaauaguaaaaucauuuuuaagaaguuauccaggcauaguggcacaugccuguaauuccagcauuuuggaggcagaugcaacuagagcuuuuugaguuugagcccagcugggucuauauguugaguuccaggauagccagggcuacacagagagacagaggucucaaaacaaaaacaaaaaacaaaaauacauugauucuuaggggcaauaaccagcuaggagcaagggguauaacucagugguggagugucucaugugugagaagcucugggcgcacgcucucacacacacacacacacacacacacacacacaacccuacuaguugggcauauggcuccaucaguagcuugcccauccuucaugaagcucuagauucuuugcauauuuguaaucccagcacuucagaggaaaguguuugacacaugguaguggaaggacgcuccucccucagguuauccucugcccuccauacacaagcacuauggcacauuccuuacccuguaaauaaaugaguuaacacguucuuuuuaaaccaggaaaccuggacacagaagcaugagugguaaggguaggcccugggcagccagggaggaggaaccugcaguuguccuccugcucuccugccugagugcugggcuuacaggcgggagcuaccacauagguuugugugguucaggaaaaggaaaccugggcauugugcacucuaaguaugugcuccaauauuuugccuuuuuaaauuuuuuuuuuuuuuuaaagauuuauuuauuuauuuauuuauuauauguaaguacacuguagcugucuucagacacaccagaagagggcgucagaucucauuacagaugguugugagccaccaugugguugcugggauuugaacuucggaccuucggaagagcagucgggugcucuuacccacugagccaucucuccagccccuacuuugccuuuuugaaacaaggcuuuccuauauaaccuaagcuguccuuuucuugauauaguccagacuagucucaauucaagauccccacaccucugccuucugagugcuggggagacaggcgugcaccaccucuccugcaucuguaacguuucuaaugauugacacaaaggcugacuacauccgggguaugugucccccaggguaggcaugguccccucucagcauuccuuccacugucccacaucccaucuaccagggaccucugagugccaguguucucugagcuaaggaauggugagaccuccauucagagcuggaaagggagcaggacgacagaccuucagguggcacccagagcacauaaacugcuguuguuuucuaucaggccaggacuuggcugccugggccccuuguucacccucaccaccucucuguguuacaggaagccuugggagcaaguccccaaaaagccaaagcggaagaaaaguaaguggagcccagcauggggaggggugggagcaugcagaacagagcaugcuggaaguggccaguagccauucucgucccuuugcuacacugucagaagggagacugggaagccagucugguagcugcucgaggcaguaugcugugaaucuaaaauagccccacuaaguaugaccucagugccuugccaaauccuuggguuuugggucuacaucaugcccaucauggugguucaagagagaaccaccugguggcagugagcccugcucugccucuuuuuugaugcauuagccucaaacucauccuauggcagaggcugccuguaucccacgauacuuggcugacagguguguaccaccugcaucucacguggugcuagcgauggaacccagggcuuugugcauaguaaguaggagcucuccagcuccccaucuuaaaaauuguuuuuacaugcauuuauccuuuuuuguguguguacaucacaggugugggaaucagagaacaacuugcggggguuggucuuugcuuucuaccacguggguucugaguaccuaagcugggugggccaggcuugagagcaagcacccuuacucacucacucagccgucuugacugccugcuuguuuuuucuggcugguuuugcuguguaaccaaggcuggccucaaaacuuaaaauggcccugugucagggucacaggcaugccuaaacauuccccuucccagugucggcacacaagugagcuguagguuucccucuguagccccagggggcuagggagugccgagcuggcaguggagcaucuguggagguccaugucgcugacaugagucucacuagaguggagacccugggcucacucccgcagcccaggugcuucuuuuggcucucucucccuuccaguccuacagguggaggacagucccaacaucaucuuacuaucauaggcuucagccuuccucagggccuuccuggcuucuuugcucccuccugcucccuggcagaugcagaauuuggguuugccccuggccaggaguugccuagccagauuguggcaaagccaggaucuaaaugcaggcaucugguucugccaugcccacccuccaguuccuuacccugucuggaagcucuugccccaaggaagcaaagcugaucuauguuucugccccuguggggcagauacucuacuggagaagacagacaagaggcaucuaagugggugccacaggcagccucuuugugcuguuauaaacaaaccagaguugacuagccggacacugguaagggugccugcugagaagaguguccaugggggagguuucuaaaugaaggcacugacaaggaaccugugcaaaggccggggcagggucauaucuagcauguuugaaugauagcuaggaggccguguggcuagaaggagguagaagggagggcaugggaccuggcggugccauauggccuugcuagccaccauggcacuugcuccuuucucuccaucccccuugaaaagcugagaaaggauaugcccugcucuccuggcacccccugguggcuguagauggcagugggaaggcaccaggaagaccuuccaggauugugugggaugaagauuuugguuugguuugggguuguuuuuucuuuguuucuuguuuuuugagacaggguuucucuguguagucuaggcuguccuggaacuagcucuauagaccaggcuggccucaaacucacagagaucugccugccucugccuuucgagugcuggaauuaaaggcgagugcaccacugcccagugguggcaggaugaagauuuuuauuuagaaacagcucagugugguggugcaugucuucaaucccagagaaacagcuaaaggcugagcgugguacacuuuacucccagcaccggugagacaaaguaggcagaucucugugaguucaaaagcuaucuucagcuacauaauaagguccuauuagaaaaaagaaagaaacacagccaacaauuuuugugcccucgccugugccaggcuccacuacuguaugacuucucucagccaaagacaguuucuggcuaucuccagguccuaguuaucucuaggcuguguuaccuccccaaaccucaguuuccucucugcaaaaugagagugggauucaagaggcugucucaaacugggaauuguuggccccagggggaguggagcacuuguccucacaucugccuggggcccuguguccacagggcggcggcgcaaugugaacugccugaagaacguggucaucugguaugaggaccacaaacaccgcugcccguaugagccacaccuggcugagcuugacccaaccuuuggccuuuacacaacggcuguguggcagugcgaggcuggacaccgcuacuuccaggaucuacacuccccgcucaagccccucagugacucagagccugacagugacaaaggugggucugcagggcaagggcacugcguagcaggcacaggggccucugcacacuucccuugugggucaggcaggacuguggcacugguggcuuuaggacaguagcuuggacaagcccuuuucaggacuugcagccuaagucccugccaaguugagcagaauuuuguccucguguguacuagcaaccuuuuuaaguucccuccggccuuucagcucucuccugcucacucucuuucccacccuuucucaucuugcuccccuccauucucaucagcuggguuacucacuggcuuccuuguaagaguuuaugcuuugugguuuugugguguuuguuuguuuuccauuugcuuuggggacagggucccauuauauagcucuggcuggccugauuugguauuuuagacaugcugacuugagacuuacacuagucugccugucucugccuccugagcgcuggagguaaggugugcaccaccacacucagcccuguuuuguggguguuuguuuguuuguuuuuuaagauuuauuucuuuauuauacauaaguacacuguagcuaucuucagacacgccagaagagggccucagaucccauuacagaugguugugagccaccaugugguugcugggaacugaacucugguccucuggaagagcagucaauguucuuaaccucugagcaggcucucuagccccuucagccuuuuuacuuuugagcuauggucucacugagucacccacacuggcuguuaacucucuagcucaagugaaccucaaguuugaacuugaaauccuccugccucagcauccuaagcaacuaggauuacaggccugggcugaacucaggcuucuuuccuguccuugaucuucuguuucucacuguggucccuuuuucuccgcuacuacccccugccucuugagucugucacacuuuucaucccucccucccucaguuccacacaagucacacuaggcuagcugcccacagaggcugagagggacucccaggaaggcccaaguacauccuggugugggcagugaggaugcuaccucaggaccuggcauggcugacaaggccuauagggagggccaguugccaagugcuauggcagcuugaggguggagcuagucugugcuggcaggcaucaccaagcagguggcaucccagcuggcugaggagaagcuggggugagaaauacuccugauggguccacacccacagccacccugcugggccucggccagucuccagagggaagguguccugugcuuuugguuagcacccugcccuccucggccugccacuccucaguauguccuacuggaggcccugucccgggccaucugacuccuccucauaacucugucaucuguccugccauacagcucuugaggaagcccaggaagauugagacuugucuaucuuguaccuuccuaggcugcgauggugucaccccagaccaauacugaucuccauaauugggcuuuggggaaugagcccugugauccauuagccaugucugcccaggcaggaguaaggaaaugucuuugcuccuauccuggccucuuccccaagcaccucucccuacaucuggggugguaaugccagagucagcccgagaaccuucuacuggagccgugaaggaaauccagaagcacacagauguuuucuugguuggugccugggaccaaaagcuuuacccugcuaggcaagcugucuaccuuugagcuauuuggaagcuggauauggggcaccaaguuguccaugcuggcuuugaacuagcuaucuuucggccucagucuuuugaguagcugagguuucagacuggcaccccccaggcccauugugaucacauauccuucaggaaguugcuaggaacugagaaguuauaggugucgggaaggccuguuccucuucguaaccauucuguggcccugaaucagguggugucuccaugccuaugugagucaccugucacuauaaugagugccugagaccgucaacuuaggaagaaaaaggcuugucuaggcuucagaggcucuggagauguuggaaccugguacucagggauagauagcaacagaggaagugccugcagaaaagagccacucgccacagccuccaccauagaaagcuagagcaggcagagguacugcaguuuccuucagggcacacuugugacccgggaccucaggaucagccugccugauaaagguucuaccaucuucuaauggugccaucucggggacugugucuuuaaagcaggagccuuggugaacacuuagccaagccauagccaugaagcaaaaaaaaaaaaaaaccaaacagaaugucagaaccccaucuacucguuaggucugucuucuuaguaaauggcuccagugucaguuaggcugauagcaaaaugauucugggaccuagaguggugcugugaaggcaggccaugcacaugacugcaaguaaguaccagcccaggcucuggagccauagaacucaggguaccagacagcaugcuucaguuguguugugggcauagucaaagucacagucacucguggcucccucagucucuuugugaauuuuaguauuuuagaagcaaaugccuaauugacaugucagggccccuuggcuuacugguggccuucugggaaugggagggguggguaggugggugucugugugucuguguguagaggcaucagauucccuggaucuagagguauagguggugagcuuucugacauggguguugagacugaacucagaccuucugcaauagcaguacaugcucuuaacuacuucucuggcccagucaguaaacaaaauaaucaguacagcaucaaauacuuuaggagaggugcuguuggaggcaggugaucaggguaccucccugggaaacugaguaagcugccugacagccccaaccaaugccagagagaagguucuggcaggcagcugggguugcaggugcaaagacccugaggccagaacuuguguaaugucccuggagugagagaccuagagaggaaaugaaggcaggaggcagggagaugacuugggacacauagcaugggcugcagguguacacugagugccuucagaauacuuacuaaagaagaccuggccucacagugacacacauuaggacuuuuuuacuuuuguguuuugguuuugguuuuucgaggcagaguuucucuguguagcccuaguuguccuggaacuaggucuauagagcaggcuagccuugaacugagagauuugcccaccucugccucuugagugcuaaaaucaaagguguguaccuccauacucagaaguuuuauacuuuuuaagacauugugugugugaguguagguauguggcugaccauggcauaacauguauguagaggucagaggacaauuugcaggagucacuucuuuuuuuuuuuuuauuaauuaauuuauuuuuuauauguaaguacacaguagcugucuucagacacuccagaagagggcaucagauuuuguuacagacgguugugagccaccaugugguugcugggauuugaacucaggaccuucggaagaacagucggcauucuuaaucacugagccaucucaccagcucccaggagucacuucugucauguaacauguaguuuuuccuggauagacucagcuugucauuuacccuuagagccgucccccuggcuacaucacaguuacuauugcaugaagcucuuguuucucacaaaccugacaacccuaauguacuuguucccaguaccuggggacucagggacuuuucauccugugacucuagcuuccuccugggccuaccuggcuagaugguagggacagggagguagacgcuugacccaagggaaacuguaucugcugcucuauuggcuggaaccagugcugggugguaucuacuuguugcagggcaugggagauggcugaacagcagaauggacaggaaaaagcuggguuugagaauauccagcuuguuucuugugagaagcaauaagcagauucccaggagcuaggggaccaagcugcuccuguugcaggaaugcugaggcuuugaccagcaucuguagagauugagaagagacaguugggcuguggguggauggacuuuggauccagucccaacagguuuugcugacagauuggaagugggugugagagagaaagucaaggaaagcccuaggacguuggcuugagccacaggaaggacaggacugccacccugugagacagggccaccugugagcagagcugcacaggcucugucggaagaaugucuugugaagaggaucccaguguugcugaguggauucugagaaggggcagcagaaagugugguaccaagaacuugaggcucaauagggagacccagcuccucaugaaagcauagagucaccaggacauugauacagucuauguugucauaagaauagauacaguucaggagcuagggacaugucugagaugguaaggcgcuugcuaugcaagcgugagaacaugauuucaguucccacagcuccuguaaccccagcagugggaggauggagacaggagaucccugaggcucacugaccaaccgggcuaaucaccaaaauggugagcucuguugaaagagagacugucuacaaaaaugaguuggaacuagacaugaugucagauaucuuuaauguggcacuggagaggcagacgcaggugaaucucugugaguucaaggccaucuuugucuacaaaguaaguugugggccagccaggacuacauacugaaacccugauucaaaaauaaaauaaaaauaaauaaaauagguagagaguuauugaggaaaguacucaauacuuguugguuucugaccuccuuauguaucuguacauaugugcauacaaaugcagauacauaaacauaugcaugcaaaauggaugcagccuguacucugcacccagaggcuccaaaugcacugcuucugucugcaugcagauucagccauccaagaacuggagggcgugagagugagaggcagcaugcacacccucggcccacacacaguguagugugggccucuuuucuuauugguuccuuuuucuuccugguuccuuucuuucuuucuuucuuucuuucucucucucucucucucucucucucucucucucucucuuucuuucuuucuuucuuucuuucuuucuuuuugguuuuuuuuuuuugguuuuuugagacaggguuucucuguguagcccugacuguccugcacucuguagaccaggcuggccuagaacucagaaaucugccugcuucuugcuuccggagugcugggauuaaaggcgugcgacaccacugccuggcuucuuuucgguuucuugagaugcuuaauccuuacuuuguucuguuugcuuuuguuuauuugcuucugaaacaauacaguauugaaagaguaauuuguauuguaucaggcauuauaagugauuuaaggcaaaugggggaguguauauaaguucuaugaagguuuacaacuuauuuaauuuuuauuacauuuauuuguugggggaguguggguggcauagcagcacuguuguggaugucaguauaucagaggacaauuuaauggguguuggugauugacauuccacucuggguccugggaaucaaacucagauccuuacucugagacacaucucaguguagcccugauuggccuggaacucacucuguacaccaggcuggccucaaauucacagagaucugccugccucuccucccauguaccaccaugccaagcuucccugcuuauuuuuugagacagguucucauguauuccaggcuggccuugaacucauuauauagccaagaauaauugugaacuccugguccuccagucucauuaccacagugcuggaggaacagcaccacuccaguuuacgcaguacuggagauggaacccagaaccucacgugugcacggcaagcacucuaccaccugagcugcggauacagccuugcaaaugcuacauuuacaaaaauuacauagguugggcauagugaugcgcaccuuugaucccugcacuuggcaggcagauacagguggaucucugcaaguucgaggucaaccuagucuauggagagacuucagaaaagcugcgacuaucuagaaaaaccuugucuaaauauguguguguguguguguguguguguguguguguguguuugccugcauacauaugugcaccauacacauauccuguaaaggccaaaagaaugucucugauccccuggaacuggaguuauagccaauuaugagcugccaugugggugcugggaaccgcacucugguccucugcaagaacagccagugcucucaaccacugagacaccucuuuaccccaaaauugaucaaagauuuuggaugucagcuuggaauucaagaaccaauccccucugcaaaaacuucuaaaauccuuagaauuucaugaguguaaauguuguuuuuuuguaaauuagucacacaaugaguaguuccuugauuuauuuuuacuuuaucuguauguauauguguaugccuguauuguguauacaugcauuuucguguuucuguguauguacaugcacauggguauuuguguguauguaugugaguacauguauguauuugucuucucugugucuuuuuguguauauguguguguacauguguauguaugagagagagaagaagagagagagagagagagagagggacaaugagguuguguaaccucaaauccugccccuacugacauacuuccugcagcaaggcuguaugacuuaaacuucuccaaacagugacaccagcuagggaccaaguguucaagugccucagccuaugggaacauuuaccacucagaucaccacaucuggguuccaggaaccaacucagguagcaagacgugcauggcaaaugccuuuagccaucucacuaguugauacacagaaauuuaaagauuuguuuuuauuuuaugagugauuagucuuuguacguaaguauaucacaugugugcaguacucauagaggcuagaaaaggcugucaucagauccccuucaacuagaguuacagacuagauugagccaccauaugagugcugggaacugaacccgggucaucaccagugagcagucuuucuaguccccgugcaugguauucucacaugggcucugggaguggaccccagguccuuguauauauaaacaaacacuuuaagcugagccaccuccccagcuaguaacugucuccuuucuucucccugcagugggcaguggccugguggcuggcagcucugacucauccagcucgggcuccagcucugacucggaggagccuccugagacccagccagccaaagccucagcugcugcugcagcucucaccccugccagccccacgggcagcagugggcuuaucacucaggaaggaguucauauccccuuugacguccaccauguggagagccuggcugagcagggcaccccucugugccaaaacccugcaggcagcgggccugaggcccuggagacgguggugugugugccaguucccaugcaagugggcacuggccccggcacccucuuugagaacaugccccaggaggcacugggugaggugguggccagcugcccggugucaggcauggugcccggcucccaggugaucaucauugcugguccuggcuaugacgcucucacagccgagggcauccgccucaauguagcugcuggcggcggcacucccagcagcagccugggugaggaggugcccugugccaugauggaggguguggcagccuacacacagacggagcccgagggcacucagcacagcaccauggauaccaccucuauagccagcauugagaccaagaaaggucugggggugccacuguggccuuuggcagggguugggaaggguggcagagggaaaggaguagcccucgaagugagcuccuugacagccuuauccccacagacaccaccccgugucaccccguagagaaggaggaccuguauaugcucaaggaggagaaagaggauucaguggccccagagcuggcagagcuggcagccacggugccugagaaugcagaggcagaggcagaaguggauggagaagaauuggacagcagugaaaugucagccaucaucuaugagauucccaaggagcccgagaagugggugcuaggguggaugggugggaccaagggcaaggggcagcugcagguuauagcccacuggggacuggcacccugaugccacaggccccuucucuccaggagacggcggagcaagcggucacgugugauggaugcugauggccugcuggagauguuccacuguccauacgagggcugcagccagguguauguggcucucagcagcuuccaggugaggccaccccccaggcaggccuguuguuggguccagcuggccugggccauguggcugcaguagagggcucuaccaggugucagugguguagggccugccuccaugagcccauuucuucacagcuggccuugcuugacuucugacuuccucgaccccaugucugcagacauagguauagccaaccugaucuggccagcaucucccaggucacgcucuugaucuuggccucaggcacuagccaugggagcgccagauucuucuauaauuagaacuuuccccauagcucaccuucuauaguguggauaguauacccuagggagaggcagagugguguuuccucaucacuucacacaaaaggccgcaccaguaagccuuugaacuugcugagaauguuuuaagcaccuaggcuguucucauggguuaaagaaagaaaaagaaaaaagagagaagagacucaaaucucccaggggcaguccagcacuugagaggcaucagccaacuuugugcucuggagccucgguuuccucccaaguacugggcaggagccuaccgagguuaacuggaacugggccaggacuggaaaaacugcuuuuugaccccaguacuccuguccaagcuggacacuaggaugccucuuucacuuccuggucuaggccagcuauggcuuauguccuggcuaccugcaugucuccccacuuuaacagccccuucccccguggacccauggcacccacuccugccccucucaccccuagaaccacgucaaccuugugcaccgaaaagggaagaccaaaguguguccucacccuggcuguggcaagaaguuuuauuuauccaaccaccugcgacgccacaugaucauccauucaggucaggcccugccagcuagaacccauaggccagguguagugcacauguguaaauuccagcguucaggaagccuaggcuguacccgugaacucccacauuuauaccuauacccggcacugguuuuuaugugcaguuguccugagucccgacacgagucauaugcaagcucauuuuagcuuggcaguugacaccuugugucagaagcccucuuccuaccugcugucacuccaguggauguuggugcccggguggggguggggagagcuugcuccuuguagccaccucuacugggcgggguccugaggccgcugccaccugcaggcguccgcgaguucaccugugagaccugcggcaagucuuucaagaggaagaaccaucuggaggugcaccggcgcacgcacacuggggagacgccccugcagugaguguccagcgcuagggagggaggugaccugagcggguugcaggggaggcucagcccgcggugaacugccuuugggcccccucuccugcuacgcaggugcgagauaugcggguaccagugucggcagcgugcuucgcucaauuggcacaugaagaagcacacagccgaggugcaguacaacuucacgugcgaucgcugcgggaagcgcuucgagaagcuggacagugucaaguuccacacgcucaaaagccacccggaccacaaaccuaccugacgugcccaugcccauggaccucagccucuauuuauuuguacucuuggacauuauguccagacgaucagagcccuagauagccagccacaggggcugccccaaccgcaggccggaaggaggcauucccacucuucccugggcaggugccccacccugccccaucacaucccacccauggagcuggcacaugggauugcacugcugaacugugucaagagcacagaaugagauuaaagugaaaaaagaguugcccuuccccuaagccuggauaauugugggcacugggcaucccuuugugaccaauuaaccugcucucuuccugacccaggcuaaguugggaguggcuaccuuuggauaacacacgaggaucuuuccuguuagccucugcucccacggguaggggaugggggcuagaauccugaugcccacaccuuccaucccuuacagaauguuuguuccuggcccagagaauugugggaggagcuaagcuguugaacaaacauuuggaaacuccaauguagacagcaucaggcaaaaaauggagugauugguuggguuaggaaccuucccugaggagguggcuuuugcucuuaaacuugagugacagagaauccaucccuguaugggaggacucaguguguuccuggaacaggacaccguggcauaacaauugccuuggacccacugcgugcggggagacucaugaagaaguaggugccaccaccagguggugcgcgagccguuugucuauucggacgaaauaguagcugacacgugacccaggggagcacagccgcgagcucuggcacgugcccuugggagccuugcggcgccacgcgcagauuggucccgagggaguggcaacaagacccaauucccucuugggacucggggguacaucagccuggugcagaauuaacggggcuggucuaagcucuccaagagccaguucucuuacucaggcagugggagcaggcaguuuccaugggaaccacggugggaccuuugccccuggaguaaccuggcugcagagacugacugccagccaaggggaacguggggucaggggugagcuaucauuugggggagguccugcuuccgcagccgaguugcccuacaaacccggaggagccugcuuugccaucgccccuacuguguggaucacugugauuagcccgcccucuccagcgcgugcgcccucucauuggcucaaucuccagagcuucuuacaauugggucucucgagagccauuucugauugguuaaaucagguugauucgcacucuagacaaaccggauccugaaagggcauacaagaauaagaauaggggccgggcaggggaggcagaggcaggcggauuucuggguucgaggccagccugguuuacaaagugaguuccaggacagccagaacuauacagagaaaucaaaaaaaaaaaaaaaaaaaaaagaauaggacugcugagacagcucauggguaaaggcgucuaccuucacccccuucccccaagauuggcugaguucgauuccagggcgcuacaucuuggaagaagagaccaaaauccugaaaauugcccucugacccacacccaugcaccaugacacacgugcauguucucucucucucucucucucucucucucucucucucucucucucucucucucucucucucucucucucucucucucucgcacacacacacacacacacacacacacacacacaauguuaauucaaaacaaaacaaaaaguuugagguuaggcuaggucuugugauucuggcugcucccagcagcgcuuucccacuuucccacccugucagaccgcugucuguggugcugaagccuugcgugagccaccccccucccccaaucccgcuccagcaaauguucuaaacacuaaaggagguguugccacuccaaccuccuuuaaaaaauuaaaaaaauaauaauaaaaaaauaaaaagcgugcuuucacaggacaaccaaauacaugcccaaaaagccaaacaaucaguacgacucucaagucuugcuuauccaaguuuggauaccuauuuaugaccucuuaagcuguaugagucuaauggggaucuaucauaccgaaccuuuagcacaaaccucuucaccugcuucggagcagugugaugucccccugacagaaaaggugcuagcgcccacauucugaggucuagaguacuuggcacacuuaaaaccaacacaauguguguccuuccaaggaugauaaagaccacccuaaacgcucaaucauuucccucgccaccacuuuuccuuucuuucuuuuuucuguugcuguucuucuuuguuuuuuguucauuuugcuacaaggucuauguagccuaggcuggccuggaauucacuacauaacugacccugacuuuaagauucugacccuuuugccucagcacccccaguguugugauuccaggcuuguuuauguggugcuagggaucggaucugggguuucaugggcuaguaacugaaccaauccucaacccauuuuuuuuuaauuuauuacuauuagugugugugcaugugcguguguguguguguguguguguguguguguguguguguguguguaccauguagaguugauucucucuuucuuucuuuacauggguucaggggaucacacuucaggucgcuaccuagcaugguggcaaauaucuuucauuccaacaccugggagaggcagauggauaccugagcuggaggccacucugaccuaucaaggacguuccaggacagucagugcuacaccgaggaacccugucucaaaaaacaaacaaacaaacaucagauuuccaggccuguauggcaagaaccuuuucuugcugagcuaucuuuccagcuuccugcagccuucuguuuuguuuuauuuuauuuuauuuauuuuugagaaccggucuuauguaacccaggcuggcuuugaacucuugaucacucugacuaucuucuaaaguuagccuuacaucgugcucaccuuacuuuuguuuuauguuugguugguugguugguuugguuuggguuuuuuuguuguuguuguuguuuguuuguuuagauuuucuuuucuuuguucuuuaauuaaaaaaaaaaaaacccagggucuccuaagcagcacgcaacagccugaaguuugcuauguagcccagaucagcauaaagugcuguguagcccaugcuagacucaaacuaccuuccuggcucaccacaccuaguauucuaauaucaccagaggccauguggaaacaaaaacuguucacuucggaucuagcagaacgggucugggucugaguguuugcccuuucccagcccucccagacaucacccaugcaccccugguuguguuugggucaccaaaggcuguuuuuuaccccuucagaguuagaugcuggacugaagaggggaacccaauuugucggcaaagcuaaaguaauacucgagaguggugucaagacuagagucagaguccgcaggcaagaaagagccaagaucugaugccucauccuauucucuuuuggcacgcagagucuaggcccgcacucgcuuccaccugccgcgccgucgggagccgggaggaggcggagacccaccgucucagccaaugagcgacgccggcgcuggcagcugccucuauaaagggcugggggcggcggcagugcgacccagagcgcggagcgcgcagcgcgggccggugggagggagggagggcgggcgagaggagaggacccaucacccggcacgggacaggccgaacugagggcccgccgcagaaggcagagcugccgagaucucagucacagaaagagcgacuucuucaggcccggcggggccgcgcuccgggcacccuccacugcgugcccgcucccuccauccaccugccgcugggggucuggccgucgaagcgcgcauccccaggcucgggucaguucccggccuucgaaggcgccgccgccuccaucuccuccucugcagcggccgcagacgcagacgcccgggcgggaccccggcgugagcaccaggcgccccccuaggagugcacgacccccggagccgcccucgauacggaccgcgcccgccgggcacacaagaauggucacuguagguacucccuugucgccgcgagacgaacacgggagggaggggcggaggcuggcuccacggaaacgcggggaguggggggguaggaccaggccuagcuaggccuaggggagggggggggguaguaccgcgccucgggccugagaguggccagagcugcauccggaguuuuggggaguggagccugguucgagaggcuuuggaaagccaggcuguguacagggugcccucagccacccggugguccuuguggcuccucacuggaaggcugugggggaggggccgcggcggcggaggaugcuuccagcaucccaggcccagacccgcaggccgcccaggaggacaagggccacgaucucccacuguugguccggguaaugccacucggccuucucugagagcuuuuugggggggaggggagauggagaggcggguggcgucggaucgcgcugcucuaagcccgagccgcacccgaaaggcgggcaucuucguccucgaaccccgucgaccuugcggcaagcggggaggggaagaggagggggcgcccugaggccucgcggcggccgccgugaucccuuuguuucuccgccgggccguagccucgcgcggggccuuggggcugcggggggggggguagugcgggaggggggcuccccguuccccggccgcugccuccgggugagggcguccggggcugcagcaguacuccauagggccugcugcacgcgcccuccccggucagggcuccgggccgcagggugaccuugaacgcgcccgcaaaucgggccgccuggccggcgcacgguugcuuucagcagccucggagcuggucagcucccgaacucacggccccgcccgacaugccacgcccugucgugccacgcccauccaggccccgccccuaggcccccuggaccuggccucaagcgagcccuaggaccuccaccccgcagcccgggcgugucccggggcggggcuggccagugcucaccgcacccuggcuccacccccgccucccugagcgacuagcuccccgcgccgccaagcguccuuugucugguccccgcgcccagccuaccuuuuccgcucuuuggagaucucuuccugugugucucugaacaccaaguguuguucccggccuccuuuucgagucguggugugcacggugggggucgggaagcucaguaguccaucuugagucuccucucuccugggcccuggcacuaggccaccuggcuuuaagaaagaaccaccuccuccccaugccuucccaagggcucagcuugcugugugaccucaggcuauuuucuuaccaucucugggccucaaggugcucauccaggucugagaacaggaauguagccuccuggagacucucagaaacccuacaauauaccuccaagacuucccucaucuguuguucuguuugaaaagagaagaggguguggucagagguuacagcagggccuggagacccuuggaggccuggaauuaccacugguggugguggggacacucaagaagggaugccuugaggauagaccaggaggaagugaggggaugccggauucaguggggccccucguagauuagaaguagaaggaaaagggcucagaaauacaagguucggucuguaccacgugguggcccugacuugcugugcuuagauagccacucaaagcccuauugucaccaguauccaggcaucugucacugugacuggaggccagaggcccagcuggaggccaagggggucugaggagcaaguagcuuuagguguguugcugacaaauuccuucuucagcugugugugauugggaguaagggcaguuacaaagagggagucugggggugggggaaaagagaaagagugagggggcuguuuaagccuagagugggaaacaggcccacaggaagagcggaagggagggagauaagguccccaucagucaaccuugccucuccuguccccccuccuuucuguccuggaccagggcagcccggguguggcuucugccaaucccauccccauuaucggcuuaggcggcucaguugguucagcugugaaaugaacacccggcccugcccagcuaagcuggugcacggcaaggcgagagaaguagugaaagaagcgcaggcugggcagugaaccccucggaacuaacacagccugguaucccccaguugugggcaggauggcugccagguaacuccauagacgcuggggucgagucaggugucaugcugacucaaggcuggcaauauggcucagcaggggcuugcgaccaacuggaccaacuugaguugcaucgcuggaacacacagauggaaggaaagaaccaacacccaaaguuguccuuccaucuccacacgggugcaggagcacacacacgcgcgcacacacacacacaggccugcguaggcuccagagcaaacacuaaauuccucacuaagaaauggaacaaaugcuuuccacuuuucuauauagcacugaaagucuaaaaacauguagcuggguguggugacacauugccuuugaucccagcacuugggaggcagaggccaguggaugucuaccacuucaaguccagccuggugagguccaggacagccagggcuacauaacgagacccugucucgaaauaaaacaaaaauccaaacuccauaugcucagugccugucacccaguaaggcuucacuugugacagugaagacacagagcgccuagugugcacagcgucuuauguucaguccccacucucguccccacaaacagcaaagcucagagcccagugaccagcaggcacacagggaugcuuugcucuccugggacguuugcuuaucuuuugauuccguuuuguuguuuggaagacagguauuguucugcaucagguuccaagguuccgggaauuacaggcaugggcuacagucuuggcuugcuaguuuuguuuuguuuugcuuugcuuugugguguuuuucguuuugguuugguuuuguacugcuggggcucaaacccagguguucugcucugccacaguuaugcugucguggcugcuguuacuauuauuggccuuucguccuuugauccugggcuuuauuuuuaacuuuuauuacacuuuuaaauuaguuuauuucugugugaagaucagaggacaacuugcaggauuuggcucucuccuguguggauuccaggugucaaacucaaguucucgguggcaagcuacuuuaucugaugagcccuggguuugagugucugcucugccuuuucacccggugcaaucccuguguucggaggagaaaagacacucauaauguuucguguugggaggauuucuagaaguuucucaugaaaaaaaaaaaaacuguguagagggcucggugguagagugccugucuaguaugagugaggccccaaguucaauuccugguacuaaaagacaaaacaaccaaacaagagcaggagaggagcaggcucucagaacacagcuaugcuauugauauaguaacacuaucagggaaccugacugcagaccuugcaguguucacugucugacagcuaugcccauggcagacauuacuaauacgccugggauuuaaucaaugcagaacauguuccuuuagagacuagauguggcuuuguauuacucugagaggaucacaguaggcagucacuuucagcugacuuagaggucagaguugacucucucugauuccuguuccuucacccuauuauacccgaaugcccagggcuuugcacaugugagacaagagcucccaccacugaacuacacccagccugugucaaccuuucuagaagacagaaaggcaguuaugcccaauggcacacaacugucucaacaguuacauacgagguugacccuuuuaaaauuuacucauuuauuuguuuacaucccaagcgcugcccccgcccccagguccagacauuuuaaaccaagaacucaggagccaccacaagggcaggaucugugauuuggcugggcgacugacugcuucucggcauaccacaaagccuggaauggacucccagcucacucaaacuaggcaugccuggaaaucccagccugugcaggguggagaugggaggcuuggacauucaaggucagggaccaggagagaggaggcucagcagguaaagacacuugccaccgagccugaccaccugaauucaggaccgaggcauagcagagagaaagcccuugugaguuguacugggaucugugcucaccgaggcagagcguucuaauaacacuaugcugagcaaggcagaggcuaagaaccuuagaaauuuacagagcccauagcagacacugcugacuggacccagugcuuccccaggcugcugcacgcugucaucugagcuucagcaguguggacgagagggucucagaaacuuuaggcagcauaucugaggaugcacaucuggauaguucgagcuaaugccaguccugcaugguuggcaaggaugcucagcucccucauccaccacauucaagaaaauuauuuuauuagugugcaugugaaugugugugugugugugugugugugugugugugugugugugugugugagagagagagagagagagagagagagagagagaaggucagaggaugcuggccuguucucuccauccaccuuuacauaaugccaaggugagacucugguccuaagacugcaugaaugccuuuacccacugagccaccuuacugccccaucaagcauuuguuuuuaaagaucuauaguguguguauguauguguguguguguguguguguguguguguguguauugacuguaugcauguuuauguacacguaugugccuggugauaguacagagaccagaaaaaggcaaugaaaacacugaccuggagaucaguuauaggcugucugguggaagcaaaccaagaacuauuagcugcccuccagcccuucagccaccacuuuccugcugcaugauaugggcuuuguuuuuugaaacaugguuucauuuuguaguuuugccuggaaugugacauguggaccagccuggccuuaaauucuccgagauuugccugcuucugccugccuaggucuggaguuaaaggugugugccaccaccgugcccagcauuuuuuuuuuuuuuuuuuuuuuggagugguagggccuugaugugucuaccaugcuggcuuugaggcaaacuucccauacuccugccucagcuucucaagugcuaggauugugugugagcuacuaugcauagauagcuugggcaaacauuucauuucuauuuuuauuuguugacugugaggggaguuggggagugcuugcaugcacaccuugguaccugccacaguauguaugcaggauucagagaacuugaagcacugggucuuccucuaugugggccccaggaacagaauucaggucuucaggcuccauguagaugcccugaccucaaauaaaaaaggaauucccgaguuuccucuauaaccugaccacgcugaguugggccucugaguugcgaguauagaugccaccaagggacuggaucacugcagauuugcacgcccaucugggaacggccuaaacccugaugccauuucacaggacccauggggaucgaugcucuaagguaucuuguuggucccguuuuuauuuuuguuugccuagaacuuucuauguagaccagguuauccucuaacucacagagaucugccugccucugccaaccagguacugggauuaaagguacaugccaccacauccaguucauuuuauuuauuuauuuauuuauuuugaaacacacucucuuguaguccaggcuggccuugaacuugugaucauccuguguucagcugccuagugcuguguuaagaggcauaagauaccaaccuccacugguuuuugaugcacagcucacuguaacccacacuggucuugagcuguaguggcgaucuuccugaagaucaccuaaggcgacaggaauuagaggcauuaaccaaaacaccaggauauuauuacaaaagucccucuccugcuuuccaguccuaggcccuaaaaccacugccucacaugcugggaaagcacugugcccuguguaucuccacucaaacuuuggugauuuuuaaacccauacucucucuaucgagagccagguuaauucacgcaguuaguauaacaaaaguuguauuucauaugcugagggucaucacauaagguucacacucuaaauuccuaacuauaguccuaggccuaucuccccaaggcuccucaucugucggcccugucuuagcugaaggucagguccagccucuaacagaaaucucggauucaagggucaggauccuggggagacucuccacccacagggcaggucaaggaggugucuccccagaugugcagagcagaguauugauugcuguuggucucugcugauccauguccaguagugucuggguuauccugagugaggaugucccuggguucuggguaugaagugcagccuugguguagcugggcuccuaaagcuacuuuuaccugucuaaaaggcauuuuuuauuaugcucauuacccucuccuuuccuuuauuuauuuacauguaucuagcauggguguacauuaguaugagcguggaggucagaggacagcuuccaggagucaguucuuucuuaucuuaugggcccugggggucgaacucaggucauuaaguuuggcaacaagcaccuuugccugccgaaccggaaccaucuugcagccuccucucuauccaccacagcccagaagagcuggaggcaguacugguuacuuuagggcauggcagacacuaccaauagagaucccagcacucuuuccagccaaacugagaccuaguuucccaaggcccauaacacagcccacccuucagagucacuaccaaccgcuuuggguuguuuuguuuuguuuuccguuuuuaaguguaagggugauuguaucaucuaagugcagugccuggggccggaaggugucugauccccaggacugauuggagcuacagauggucaugagccaccaugugacugcugggaaucaaacccugguccguccuaugggaaaacagcugagacaucucuccagcugucuugauuuugcuauaagguacaacagagccucaagaauuuaagggaugcguucaaagacaucaacugagugucaaagccaagccagccuuagugacugucaucucucagagagaauacuaacuuauucuccagugcagagagaccagugcauuugagcucuagugccagcugaugcugugugacucaguagguuccuugccaucucugagccugaguucucaccugucuuaacagaauuagcaccuguuucuaggugggguagccauaggagcuucaaagcugacccagcacaaaaccauuacccugcuaaacacagauucugccugacauucggacacacacaauuaaucccaggauucuggaggccaaggcaggugaaucucuguggucaagggcaacucagucuucacuuugagguccugccuccaaauaaacaugauauuuugaggggcacauuuuguaaaugauugugugguuuuacagugugaacuuuauagagagcaacaucguguucuagugucaagccuggacacaccuguuaaguaucaagcugaguuauauagugaauauaaacuuaagaagugcugagucgcugggcggugguggcgcaugccuuuaaucccagcacuuggaaggcagaggcaggcagauuucugaguucgaggccagccugaucuacagagugaguuccaggacagacagccagggcuauacagagaaacccugucucaaaaaacuaaaugaaugaaugaaugaaugaaugaaagaaagugcugcauggaggggguggggcugaguggaaggggcgggucucacacuugccugguagugugaggcucuagguucaauucccagaucccaguaaacagauaaaaaccaccaaacuacauuaagcaaugcaaaaaauacaguuacaauaugcaugaccaggucagagcaauggcucaacaagugcuugcugccaagccugcugaccugaguucaauccucaggacccacaugguagacggagagagccaauuccaaguugucuucugaccaucacauaaauuagggugugugugcaccuacacaaauauucuuauuacaagugaguaaauaaaauaauaaaaauuaaaaaucaauaaauaaaaugugguuagaagaauauuugagguagggcauuacuauugacccuggcuggccuggaacucccagagauccguguaccucugcuccugaaugcugggaugaaacauguuugccaacauccucacuccaaacuuuaauaaaauaaauguuuagaagcauccaugagcagcuuuguuuuccuaggguacaugguuugaugcuugaaaaucaauuaacauaauucauagcacuacccuauuaaacauaaauaucauuuaauagacuagguguggugguccaggcuuagaaucacagcucugggggacugaaccaggaagaucacaaguucaaggccaguggaguuguuaucccagcauccggagauggggcugcaguaucaggaguucaaggucauccuuggcuguauacugagcuccaggucagucuucuguacuugaaauccugccucaaaacagggggaaaaaaucuaaguguggcuacccauaacuuuuguuugguugguuuugguuuuucaagacaaaauuucucuguguaacccuggcuguccuggaauucacucuguagaccaggcugcccucaaacucaggguuucuggugccucugccucaugagugcugggguuaaagacauaccaagccuggcuugucacacaccuucaaucccacugcuugggagcagaggcaggugaauuucugugaguuacaggccagucuggucuagagagaguuacaaacugaucacagagaaacccugucuggaagagacagaccagcauggcacagagagagaggugaggugccugacugguggcuuaggaguuaaaagcacuuacagcucuuacagggaacccaaguuccagcacccaugucucacaccugccucugacuccagcuccaggagauuucugaccucagcuggcaucugcacucacacacccacacacaaacacauaauuuaaaagaauaaaaauaaaucuaaacagaauaaaaauaaauguguuagcuccaugccuucuagggcuacaaagcaaagcccugucucaaaaaagccaccuuuaccccaaaaaacuucaauagcuacagaaaaugagucaauaaaauucaauaugauucuucaaagccguggcaggacaggcauugugaagcaugguuuugauccuagcuacuugggaguuugggaauuugcaagauuaaggacacccagacagcuuaacaagguccaugucagagccuaagcgaaggcugggacacagcucuguugauagagugcuugccuagugugcuguggugguaucugccccaaaucccagcacucagguucaggaguucaaggucaccaugggcuacuuuggaguauaagagacauuggcucaacaagaaaacaaaauggcuagagaaauaaggcaguguggugcacucaccuggcauguaugagaacucaggcucaagcccugcugaaaggggaaaucuaggggggaaaucuccuuuguuuuuaacugcugggagucaaucagagccuggcucacacuggacaggcacacuauuccugagcuacagccccagcagaaaauauucuggguucuucuuuucuuucuuuaaaauguacuauuaucucuguguguguguguguguguguguguguguguguauguguguguuagagaguggaagagggucguaggauaacuucagaacuugauucuugccuuccagugugggaccugagccuggggaucaaacucagggugucagguuuuugaggcaagugccaaugagacauccugcuggcucauuucaucccuacccccaccuuuuuaggugggaccucauguagcuuaggcuggccuugaacucucauuuaggggaggauuaugcugaaucucuggccugggcuccucaagugauuuggggcugugugugccgucaccacacccacacccaccuccaacuuccacacuaaacaaccuuaacugagugaagcuuguauagaaaaaaauuucucaacugcaguguaaaauuguuuaguauuuauuuauuguaugugagcgugugugugugugagcaugugugugugugccaugguucguguguggugguaagaagacgauugcgggacuggagagauggcucagcaauuaagagcaccgacugcucuucuagagguccaaguucaaaucccagcaaccacaugguggcucacaaacaucuguaaugggauuaaugcucuauucuggugugacugaagagagcaaugguguacucauauacauaaaguaaauaaauaaauccuaaaaaaaaaaaaagaagacaauuugcaagaauggguucucuuuccaccacguggguccaggggcucgaacucaagcugccaggcuuaaugaaaagcacauuuaucugcugagccaucuugccaucccgaggggcagaauaucuguagcuaaacugauuaugggccugugaacuauuugaaacauuuauuugucucuuuguuuggggcuuuuaaaaauauuuauguauuuuguaguuauguguaugugugugcuugugugaguuuaugugcacccaaaugugugggagcccauagacgccaaaagagggcaucaggcuccuuggagcugcgguugcaaaugacugggagugggugcugggaauuaaaccccggucucugcagagcaaccaccgcucucaaccccugagccauccaucccuccagcucccugugcugggcuuucugauacauggucugacuguguagcuccaguuggccuugaauacauggauccuccugccuuguccccuacauguuggaaucacacacaacauacggaaaugccauccugcccagugcucuccucuuuuccuuuuggagccaaagucucaccaugcaucccuagcaugcacaauggcauugaacucacagagauccaucaccucugccuuccuagugcugagauuaaaggaguacaccaccgagacagguggugaucugaggccagccuggucuacagagugaguuucaggccagccaggcuacacagagaaacccugucucaaaaaaacaaaacaaaacaaacaaaaacugugcaccacuacaccccagauagcuuuuuaaguauuuuuuuuccauuuuuaaaaaaagauuuauuuaagccgggcagugguggcacacgccuuuaaucucagcacuugggaggcagaggcaggcagauuucugaguucgaggccagccuggucuacagagugaguuccaggacagccagggcuacacagagaaacccugucuugaaaaaacaacaacaaaaagauguauuuauuacuauaaauaaguacacucuagcugucaucagacacaccagaaaagggcauuggaucccacuacagaugguugugagucgccauguaguugugggauuugaacucaggaccucuuccagucaguguucuuagccgcugagcagccucuccagccuuguguguugcuuucacagcagggguaagaacccucgcaaugagcuucucaucuccacaaaaggugacagauacagucuagaaaugaaggaacaaagcugguauucuuugcagauguuuuuuuguuuuacaaaaaaaaaaaaaaaaaaagagaagaagaagaagaaaagaaauucaaaucaaaaucauggagaaauugugggagcaacaguuaauaggaaaauuaugcaguaaggaaauaauauugacacacucaagaugggaauugcuucuagugagaaaagaaaaauaaauuacauuagagaagggauuggcuuuggcuuuaacacuacugaaauuguuacaugucaagggguuuguuuguuuguuuguuuguuuguuuguuuguuuugacaggguuucucuguauagcccuggcuguccuggaacucacuuuguagcccaggcuggccucgaacucagaaauccaccugccucugccucccaagugcggggauuaaaggcgugugccaccauacccgguuacauaucgaguuuuuugucugauguugguuucuuuuuucuucucucacccucuucaauacagggucucacuguauagcucuggcuaaucuggaaguugauauauagaccaggccaaccucccaagugcuggcauuaaaaaugugcccugccagacaggcuaugacuacuuuauaugaagagaaguguucuguuauuauucugaaaauaauaggcugauuuuaggaacuugcuugcuuauaugaacagcugccuacuuucucuugcuauaacacaauacuugaaucugaauacuuauuaagaaaagaggggccggguaugguggcgcacaccuuuaaucccagcacucgagaggcagaggcagguggauuucugaguucgaggccagccuggucuacaaagugaguuccaggacagccagggcuauacagagaaacucagucuuaaaaaaagagagagaaagaaagaaagaaagaaagaaagaaagaaagaaagaaagaaagaaagaaagaaagagggagggaggaaggaaggagggaggccagcugguggugggcauaucuuuaaucccaguacuggggaggcagaggcaggaggaucuuugcagggguccugccucgcuuccccaggguaggauuauagacacgugcuacugcgucagcaacauacagguacuacugcaacaaagcagacucucuuggcuuuagagguugaaaguccaaaagcaggugagccuaucuggucauccucuggaaggccuucugacuaggucacagaguggcagagaagugggaaaggagaaacuggaggguuucucucccaauccaggaggccaacgggccaucccugggagccugugcuaacccccuacucugaaggguaggaaagcaaagaaggagaagaaacugcugaguucaaaagggacaggcacaugggaugcucuuucugcacaaaaccuaaaggggcuugcagcuuagacacccuccuguuccagcuaggccuggguuucacccagcacucuucucugaaaaaaccuagucucagucucccccccuucucuucuccccuucuccccuucucuccauucucccucucccucuuucuaagauuguuuuuauuuauguaugcacauaugaguguaguaccucuggaggccagaagaagacaucagauugcccugaaggcagaguuaggugacugaggugccugacagagucugguccuucacaauaacucaaacucucugaaccgcugagcuuuguucuucacccucaaacaacccgcccucgcccucgcccucgcccucgcccucgagagaacuggccagggucccuggagagcaccagucucuuccaagguaaacacucccugccaaugaccuaauuacuucccacuaggucucauuucuuaaagguucuacgacuucccaacccagccacacuaggaccaagacccagcacacacacuccagccaagguggaccgaagcucacgauaucuguggacuaggggucagacucuggugcucacccaucuuaggcaauggccccaccacugagucguagccccugcccauacaccguauuaugguuagguucugagacaggcucuggggugugguggcauacuccuacaucccagcaccuggaugguagagguaggaaaauugggaguucaaaguugaccuuggcuacauaacaaguuuuaagacuagccuggguuauguaaaaccauguuccaaaaaaaaaaaaggccaaguucucacuaaacguuuagcccaggucuccugagugcugggauuauaagcauguaagacacuuauaaagcauuuauuuuuuuuugauugauucaaaaugcauuagcuuuucauuuuguuuguguauaugugugguacacuugucacagucuucuaguggagucacaggacgcuuuauguggcagucggcucugucuuacuggguuauggagacagaacucgggucuugaggcuggcaugaaaacaccuuuacugcugagcugucgcuccagcuccauaaauaauuaaaaaaaaaagaaaggagaugaaugccggguaguagugguuccaggacagccagggcuacacagagaaacccugucucagaaaaccaaaaaaaaaaaaaaagaaagaaagaaagaaagaaagaaagaaagaaagaaagaaagaaagaagaaaaaaaaagaaaggaaggaaggagaugaauauagccaggaggcaugguggugaaccuauaaucuuagaacucaggaggcagaggcagguagaucucugugagcucaagccagccugggcuacagagccagaggaccuccagucagagagaccagcaaacaaaacccaguggaaaccgugacccucuuuaucaacaaaguccauguuagacaugucuaauccaucuccaaacccaucuuuccugcucuagcccagugauggggacugggcggugagcggguacgaccuguuuucuccagcagauacugggggccauggagucucagguugggggggggccggccggcccggcccugcccaacgggccacuccuugggacaaauggagccacugacgacagcaagaccaaccucaucgucaacuaccuaccccagaacaugacacaggacgaguucaagagucucuucggcagcaucggggacauugaauccugcaaguugguucgggauaagaucacagguguggcucuuucuauguguggccccaggugggaagcagggaggaaguggccucagaaaaacaagugugaccuuggugggauaucucaagaugauuggagccaaguggcucucuggggaacacaccaccacgaggaggauaaaugagugggaagcuguccaguggcaggguuuguugggggauauuaggcagacuagggaagucacucuucugauccucccacagggcagagccugggcuauggguuugugaacuacucugaccccaaugaugcagacaaagccaucaacacccucaauggccucaaacugcagaccaagaccaucaaggugaguguccccacccucugugacgccugccccuuacugcugucccugucccuccccaucauuccuuucuguuccugaagcuuccggucuggucccuugucuuccuguugguugccuggcuuuaucucuuggggcugucuccucauucaucagugugagagauucuuauauauuuuacuauucugccugugugugugcauggucacacaugugucaauguaugaguggagauuagagcaaacuuguuggaacugguuuucuccuuucaccaugugggucccaggaaucaaaaucagauguccuccuuggcaccaggccuuuaccugcugagccacuccccuggcuggagaaugcacuaucaacaguauaucacacuuucuuuggaacauagagaaucugccagguccaggagguaggacagagugaccaggacaacauggagagacccccgcacugucuuuguccuggaaaaggggguggggcccaucugccaucuggaaucuaauuagagacuggggagggggcaagcuagaauggccccucccccaccuuuguacaaugccccaccccccauggccucccuucucagcagcugcagcugggaccaugugagccaaaguucccuugggagaaaucaccauggaaaccccccucucuaacuugccuggggguguuugggcuccucccuucaaaucugcuccaggaccccuggggaggccaggcggagggugcccaucuggcccccaauuugucaugggaacggaagcagagggaucuuuuccucuccccaaugaggagaagaggaagaugguaacccuggaugagccuuucugugggucagcuuaauccagaagccccagggacgugaggguggacccuagugccugaaagugaaucuucugguaugcgaaagaauggaccaugacucuguggugacagacgggacacaguguguaugcaagugacuauugucaggcaggucuggauaacuauacuuugaaguauagaucugggaguguggcucaaugguagagugcuuacccagccuggagaggcuccgaguuccaucuaccacacagaaauaaauaaaugaaugacuggggguggggcaugggagauagcccaauuguuuggauuguuuugaagaccugaguuugauucccagaacccuagucgacaagccagguguagguaguggcauauaaccuuaaucccaggacuuaagacucagaggcaagcagauuucugugagguggggcuacccuggucuacauagcuagcuccagggcagccagagcuguaugagacccuguccaaacaaacaaacaaccuugguguccuuugccuguaacuuaguacagaaggugacgaggcagaccccuggcauucuacccucacaggugggcagcuccuaaugacucuuaagguuaaacccuggccaacacaggcacacacccucaugcacaagaguugaggguugggguaacaguccugcaagaaacaccuaucaauccagcaugcacaaagcucuccagcaccacagugggcacagagccugggaucccagcauucuagaaauggcaaccagagcauccuaaauuggagaucaucucuggucucauagcaaguucaaagccagccugggcuacgugagacccugucucaaaagacaaacagcaacagaaaaagugacuaugugugugcagacccugauguuaaugcgacacuacacuuccuguuguggcuuccaggauacuuugggggaugugucuguuggaauaagauauuuggguggcuugguguggcugccugugucuccugugcaggguauguggcccugugugcuguaggguuggugcaggguuaacccugauugcuuucuuccuguaguucuggaggaccaauauuccaagcauggcagugacuuuuaugauacuccauagcuaguuuucucaccagaacuguguagcagcugagucuguguccagugaucauguccaucaugucuaaauugugcccuggcagauuugugccaaaauguuuccagcuacuugggcgccccaggucccauccugguguggaguuaaugaagagcguagccuauaccuccccucagacaccacaccccagaagaacaaaaacagggcaaguaauggcugagaugauguuguauggugaaacugucccuggggagaggaagcaugcgcggcuacucacccccaguagacaucccaugacagaccaaaguauagcaccaccaaaguccaacuuggggagccaugaguccuauugggguuccuuacaggaauaugggggagggguacguacaggagcaaaagugacucaaagauagcugcaucaccaaggcacaccccagcaugggugacagcucacacaagcuagggaaccuggagcacacugcuuggcuuaucagagagucuucuuugcagucuguuaugcuggucucagagggauucucagcuuuuaguacuuacucuggcaggaagaagccggugaaucuggucgguuucagggacuuccugaaacuauguugaguuauuuaccuuccugcucuaggagcuucccugcaggauggaauguuucacuguugggcagaaccccaccccuuccuccuucucuuccauucuuccugccccuuuucugcaaugaacccugagccuuggagcaggugacuacagauguccaccuguggcugaaaaguaggccaccgugccagagcagcagccccguguucucaggagcuucaccaggcguuaugaguugaggcuaaugaaggugauccauggguguaaacacacacuuagaaggcaguuugacaagaacagugguucucagacuuccuagcgcugugaccuuuuaauacguuucuucauguuguggugaccccaaaauauuguuuucuugcuacuucauaacuguaauuuugucacugagucguaguguaaauaucugauaugcagaauaucugauauucgacccccaaagaggucaccaccuacaggucgagaaccagugaucuagaaaaaaaaaccauacaaguugcuuccccguugggaccuaaaaccuccucaggcaaagguuuuuguccuggcuucuaguauccgauaggaacucucuuuuggaacggccuuagguccaauuggaaggcuauuggucucaccuaggaccggggagccacugcggcacaagcgggcacaaggaggugcuguccgcauaugaccgcaugcaggaauguugguggcagcucuucacugacagccugaacguggcuccuucaggcacuacaaaagccaggagcaggucggggugggggugggugggguuuguucccuucagucccagcuuuauuuuccugcauccuacaaucaaagcaagcacauucgcacuugcucuguccucaacaagaggguguaacuuucagguccagacauacagccaacugcaguagcaauaguuuuuaugguuuguggggccacagggggcuucccuggccagcaacucauaggaagauagcccaccccuggcacugggguuuucauucaguaaacuuacggugucuaagaguguucuuuuucacccacguagcauguuuuugguuuuuuuuucccuuucaaugaacccagcuccaguaggguuguaaacuaagugggggaaauacuacaccuaagcuguggcucugauuuuucuucuuuguuuuguuuuguuuuguuuugaggcaguguuucucuguguagcccuggcugacugucuuggaacucacucuguagaccagacuggcccugaacucacagagauccuccugccucugccugccuccugagcgcugggauuaaaagcaugcaccagcaccugacuaugauguuuuucuaaaucugcaaaacacucggagggaagcuuuaugucaucucuuuaauaaaaccuuuuuucagagacugggcaggaggacacggugacaucccgagccaccaucccauaacaaaugguggguuacagagaugacauuggggaagcucucugaaagucuguuguuaccuguccucagcaagugucaggugauaccagauguucacaacuaagaagauacuaaagucagacaugagcaagcucaggugcagcguggacgcuccauccauuuguaucaggugcuugcucuacagcucaagguuggcugcaaagcacgcaugggaggcgcucacuuaauuaguuccuguagcucccagucauccucucugagacaguauguuuccauaccaggagcucuucccuggagccucccuacauuucuccacacccgauaaacucagugagccugaucugcucagaccuacucagggacaaaaguggauguggcucuguuuucacccuggugcgccugacccgcuggcuccuugcaucagacaggcccuggguuggcauaugacuguagucucucuacucaucacaccuggaugcuuggggaguuuguggcuggacaaaccaccuccaccucugacguaacccuugguggagagaaaugaacccuccuuagucugggggagaauuacuggcccugggacaggcuugaucgucuccaccuguaucgugcuagcacaggccugggaacggcucaccaggcuccucagcacccacucuggcuucuaucaagucuccuuagcuccagcuagacacaaauccuggcgccuuugucuuggaguaacuggagcugagcuguuucucuccuuuucccuuuuacuaacuccuccuggcuggucuuuuccuuuggaugcaggucuaaguugcugggaccugccaaaacauuuccuccuuuauaaagauuuugcccaccaaaggccucagugaagccacugaaaccccacaccagccucggacugaccagauagaacuuuuccuuaguuccuccaugaacauggguaggucuauccugcucagugagcugagguucaaacacagcuuuccucucucccgucuacgucccuccguuccugauuauuuaugggaaccucagaaggagauaaccgccuacuccuagaggugcugaugaggguccaucuaggcugauugcgcucacauggccuccagucagcugccuuugucugaaggaggaaugggacguuacacuucucacuuuuccgccuccacagcagucaugaucccgucugcucccaagucccacagccacacacgccaggccggcacagucuuuuucaccacguccuccaacuucacaguguuuccuggucacucuguaaaggccccaucuauacgccaggucucagaucucccuauuucccauacuaaaggucagccuugaggggcaucuucuaucucauccucuccuucaucugacuuauuccuggauccaaggcuagcagggaaaccccggcaccuugccuuucuuguugcaguuguuccuuuacacaaacaaccugcuuggccaccaucuuaccugcggauccauuucugaucacacacacaucagccaggccaccucuacugcacaaauauuaaaagacugugaaaucucuaaacuuccaacuguuuucagggcaucuccagcuucacauggugccccccaccucaucaagcaggcaugccaccucauaccacauagacgaagacugccgugcugagauuccuccuacagacaucccucauuccgauggcucagccuugguggcaugucuaccacccauggcaagaagcacgcaacugcugucauagcagcagcggcacacuaccacacaccacguaggaaaagacagcucccaaggauuucccuccccauuugcccuucuuucucagccucagcugcacgccacacacucgcuccuccccaacucaucucuaguucugucacugaucaggagacaaauacauuauauggcaaaacuaauccuggggcgacacagcacacacaucuacuaacuccacauaggaacccacaacagcccagagugagaguacagcuuggugagccgaugccuuuuauugggguuacuuacaggaaugugcgugaggaguuacaggagcagaaaagacucagacagcugcaucaccaaagccaacuucagcacagugacagcucacaaagcugggaacgggggagcacacugcacagccuucaggcagcucaacaggguagagaguggccuuucugggggccucggguggucuaaaccucuuucaggcagcucagcugguuuuucuuccaggcagucagucuggccucacagucuucuuuacagcucuguugugccagucucagagggacacucagcuuuuucuacuuacucuggcaggaagaggcuguugaaucugcucaguuucagggacuuccugagacuuuguugaguuauuuauccuccugcucuaggagcgucccugcaggauggaauguuuccauuuuggaagaaccguauaagguucuugcugcaaaagccuuaagaccuaaguucaaaaccccaggauucaggaaaagacugggggcuguggguaucuguagucuccugcagggagacaggaaguggaaacaggagccucucuggaagucuucaggccaggugugcugcuguccacagcagcagacaagacgaagauggggaaguaggggggccgagacuguggcuguccucucucacacaugugcugugggauuguguaccuaucucuauacagacaugaggugauugauccacccugugccuuauaggaccugagaccuaagaugccaccccuaacugggugugguggcacaugcccacaauuucaucauucacggcugcagugccuuccaggcuguccaggacuacaaagugagaccaaaagucaccauuccaguccaggugugaugcacacacuucuaaucccagcacucuggagauggagcagguggaucucugaguuggauguuagucuggucuacacagugugcuccagaccccuggagguuauauagugagacccugucuuaacaacagucaaucaaaaccuacacacucccaugguggaguuagaaaccucaaauacuaggcuauaauuuuuguuuauuuuuugugugugugaaaagaauuuuuuuucuugagaugggcucuccccuggcagccuggagcaugcuguguagaccagacaagucugaaagucacauggagaugugccugccucuaccuccagagcaccaccacacucgcucaccuggggaggauggagagggcuucucucaccagcugagugacagcaccaguccuaacuagguuucugguuuaauuucauaacauuuacgcauguuuguguguggggaagccagaggacagcuuuuggagucauuucucuccuuccaccccaugagucugaaagaucaaacucaggucaccaggcuugguggcaagcccuuuaccggcugcgagccaucucagcagccccuaauuaguuacuuguaacgaagcaaugcagucccauaaugccccuccccaaacagccacccauaauaauuguuccuaucuaccccagguucagggguuugaauagaagcagcagaaagcagacuucagcagaaaggggggaggggcgcucaggacccuuccaccacacagacuggucaccccauugacacuugugggcggggccccugcaccgagucuccaggacauugauaaagacacaaugagcugggguuccacaauacucuguaaacagacuuuucuuuuccccacuucacaauacucccagugucucucucgugcugugaaugucugagcuggucgacuugugagcagcugcaggauugcugagauguggccucagcgagggcacaaauggaauggccauaucuaauguacagaucucacaagccagagaagucaccuggagauaaggucaucacugggggccagggagaggcuccaguagggugacaugcgcuugcugcccaaccuggugacuugauuugaccacauggauucccauggugcaagggcagaagugacacccugagcuguccugugacugcuacacaucaaccuuggauagcacacacauacacacaugcuagagaaucggaggggauaggaaggauguuucagauuguggacuggcaggaaaagaggaaagaguguuucuaugggguaggguagagacggggccuccgacucacucugcagaccaggcaagcauuccaucuaauccugcagaguguuaguacuacagacagcagccaucaaggcuggcacgaagagacagacuucuaagcagcaaaaacagcaagagcaaugguccugaggcuggacugccugguccauuugggguaaaagaaaggaagcaagggggugagggaugaaagcugagaggugaccuuacugcauucgaggucuguggacagaguucaaagguuggagcuguagugaauuggucagacaguuuucaagaaugcaaggggcggggugggggugcaguccucaagccacgcacaugcguaccuguggccucaagcucacagaaguccacuugccucugccuccccgguuugugcgacaccccuggcuuauccagaacugggcaugacccauaaguuacaacuggauuccugaagccaggaaucacccagugugcacagggacauuuagauuuguuucuuuuuuagauaaaaaaaaauauuagucagguauucuguuuguuuguuuuuguuguuguugucuuuuggggguggugguuuuagacaggguuucucuguguuguucuggaacucacccuguagaccaggcuggccuugaacucagaaauccaccugccucuaccucccaaguuuagucaggcauucugguacacaccuuuaauccccacauuugagaggccgaggcaggaccucuggacucaaguaaggccacccuggccuacagagugaguuucaagacagccaggacuacacagagaaacccugucgaaagagaaagaaagaaagaaagaaagaaagaaagaaagaaagaaagaaagaaagaaagaaagaaagaaaggaaaagaaaagaaaagaaaagaaaagaaaagaaaagaaaagaaaagaaaagaaaagaaaagaaaagaaaaauuucauuauuauuaauuauuggggggguaagcagucaggccuuugggagccauugucuucuccuuccaccauuaguucuggggaacaaacucaggcugucagaguuuccuguagagccaucuccccaagcuccuacuuuguucuuugagacagggugacauguggcccagggcacgcgggcacgcuugaacuuaacauacaguaaaaggugacuuuuucucuguguagcccuggcuguccuagaacucacucuguagaccaggcuggccuugaacucagaaaucagccugccucugacucucgagugcagagauuaaaggcaugugccaccacgcccggcaaaaaggugacuuuuaauuucuggucuccccuaccuccaucugccuggcacuggggugauggguguguauuagccuguuucuauggugccacucacucagccccagucccaggccaugugcuaagcaaacuaguguguguguauguggggugggggugcauuucugaggcuugucauuuucuaugacccucaccguccucugaccccgcccagguguccuaugcacgucccaguucugccucuauccgggaugccaaccuguaugucaguggccuccccaagaccaugagccagaaggagauggagcagcucuucucccaguacggccgaaucaucacuuccagaauccugcuggaccaggccacaggucagaaugcaggaagggagggugcacugagcaugggugucccagggaggggagagucaugugagaagggacagagcgccugagacuaaugcccucauaccccuggcaggugucucucggggugugggauucauccgcuuugacaagaggaucgaggcagaggaggccaucaagggacugaaugggcagaaaccacugggugcugcugagcccaucacggucaaguucgcaaacaacccaagucagaagacagggcaggcccugcucacccaccuguaccaguccucugccaggcgcuacgccggcccccugcaccaucagacacagcgcuuccggugagccagaguccccagaccccaggccaggugccucaagccugcagcucuuucugagccuguuuccugcacagaguggggacccggggacaccccaccaucaggaacauggccuaguacaucaggcaggagcucagugcaugcuggcugcaacacuuggcaacaaauugagguccaguuguggccuucugucucuuucucugucugucugucugucugucuguccgcccgucugucuuccccaccccaccccaccccaucccccaugucuugguuauggugucuauugcugugguaaagcaccauauuuaaaagcagugugaggauaaagggguuuaaguucaucuuacagcaagcagcccaccacgaggggaaaucagggcaggaagcuggagguggggcugaagcagggaucauggagcacugcuugcugaccugcugcccaugccgugcucagcccaggcucggcugcacagccacagugggcugggacaucccacaucagucaagaaaaccccucagucuugcccgcaggccaaucugauggaggcagcuucuugauugagguuucucuuccuagcugacaaaaaacaagacaguaagcaaaaagaaugaaaaaacagcccggacaccccaucucuccuguucuucuccuucuuugucuguccuguccuuucuccuccaucuuccucugcaugcgucugccuuuuuagcaucugugugucugucucuccuauugagcuacucuuuuggucuuucugucugucugucuuucugcuccaugucucugucucucucugccuguguguuucucuuucuuuccuuucucucuuuuucucucuuuucucugucucugcccacccaccaccacacauggguccagcugugccucaguuuccucguggauaaugccaccaccaaagguuuccucucauuguguccuggccaugaucuguguguuagcuggguagagcggcuugugcugggccauuuuacugagaauccuucaccccagauggagaauguacaagcccaaaauaagaccugagcucaagauccagacuagucacucucaggcacuccccagugggcgaucagugggagccccugguggaccugggauggcccaagcugcccaucccccuguagacugaggaaaaccucccugccaccuuuguaagcccuccucuuaagccagagagaucuuagccccuucauccucuggcaggacccgaggggguagccugaagugcaggacaaggacauucagccuggcgccaguagggauacugagaagcugucccaaaugagugagguuccgugccaggcaguguccagccgggcugggagcaguggcgggggcagggcccugcugaaggcuguggggguggggaggacuggcugucacaucacagggagugggucauaggccacacugacagcugcuucugccuccacaggcuggacaauuugcucaauauggccuacggagucaagagguaacagugccccgccguacugucuucaucccucauagccccuucccuuggugacccuccucuaacaccccccaccccccaccccccgcauguaccuugucucugggaccgcuggguagccauuucugccugucuaggagaugauagcucuaagacuaugagcagagccaaugucucgagggagcagcuuuggaaggaucauggagggcuggcuguugcuuuccacgguucuucuuuuuuuuuuuuuuuuuaauaguauuuuuugaggguuuuaaaaaaacuuguuuauuuuuauuucauaugcaaugauguuuuaucugcauguaugucuguguaaagugucagaaucccuggacuggaguuaaagacagaugcaaccugccauggcuugcugggaauugauccuaugcccuuuggaagagcagccgguguucuuaguggccugagccaucucccuagccccucacacaucucuuuuuauuaucucaacaaaauaggcauuugugucccuaguuccaacauuaacccucugagagccacugauaacuuauuguuuuggaugcuaggaacaggacccuggcacuucugcauacuaagccugcauugagccaugcccccagccccucacuggaggauucuaagcaggggcucgauagccauuuccugagccccaaacaucagcuaccauuguuggcuuuccucaaauuccguggaagacucccuugccucuccacaauugcugugaaccuugagcucuuccuagcuucacucacaacccugcucugugaaagguuccguguugaugugucacaagcuguugggaacauguugaauaucaaaagcuggguuugaggccaggauauagcaugguccaggcagacgagaucccucuugaacaugaauugagauagaacacagugcuuggcacauaauaaaagguggcuauaacaauccagccacugauguuccucgucucagccccaugggaaugagacguggugcucagggaagugcaggggcagcauaagggaugauggugacccaggagagaccuggaggucaccuagcagcaggaacagcuggugaaagacucagaacagggagaggcugagucccauguggucagguuaugugggguccagacuuugagagucaucuccccacgcugagugacuuaguucugacggugagggagucagugggaaugcugcuuucuauccuuuaauugauuuagacacaaccaaccaaguguuaccugacagaugagacagccaagagaacaaugucaggagcaugguggugacauggacaguuguccuccuucuccaucagggucacauccccaagacuccuuguggacaccugacagagcuugacaugggaaccuguauuggucuuauuuacuuagacuuaugcuaguuuguuuauaugauuguuuaugagacagggcuucacuguauagccugguguccuggaacucacucuguagaccaggcuggcuuggaacucacggagauccaccugccucaagagugcugugauuaaaggcaugugcauggacuuagauggugaugauggugaugaugaugaccgucaucaucauuuuguacuggagaggaugcucaaggccuuuugaauaaacacuaagagcacacagcagcccucucuaugucuccugacacagggucucauguagugcuggcaggccagcagcccugagcucagcauguccuugagccccugcucccucugccccucccuccugaacaugagguugcagguauguucaguuuaucuuuuuacuuuguauuuugagcuugugauucuccugccucagccuccuaaugacaaaccuguaccaccagaccaguuuccucuucaugacuuacaaauagauguguccuuuccuuagauauuagucaccucagcauaugaucuauuuucuauaaauggagaccuuucaccuuuuuccuuaaaggaaacauuuuaccaauuucuucuaggcaucucuaaaucaccaguauuaaccauuaacuaauuaaauaaggauuccuuagccuagaaacccugauuuuggacaaucagucugacagucaaauagcuaagugcuaaugggaaggcagcauacacugcuuggacacacugaacacaaugugaaguuucaucaugccacucaaaacagugcagucuucucuuuggcucuccugaauuauccucuuuucuuuucuucuaccuccucuuucccucuuucccucccccuccuucccuucuucuagacagucuuacuauguagcucuggcuggacuugaacucauagaaguucccaucucugccuccugaguacuaggugaaaggcaugugcuaccacacaaggccuuuugcuacugcugauucugcuuccgcuuccuccuccuccuccugccccuccuccuccuccuccugcuccuccuccuccuccugcuccugcuccuccuccuccuccuccuccugcuccuccuccuccugcuccuccuccuccugcuccuccuccugcuccuccuccuccuccuccuccuccuccuccuccuccuccuccuccuccuccuccuccuccuccuccuccuccuccuccugcuccuccuccugcuccugcuccugcuccucgugcugcuccuccuccuccuccuccuccugccuccucgucuccuccuccugcuccuccugcucuuccuccugcuccugcuccuccuccagcuccuccuccuccugcuccugcuccuccuccuccuccuccuccuccugcuccuccuccuccuccugcuccuccuccuccuccugcuccugcuccuccuccugcugccuccuccuccugcuccugcuccuccuccuccuccuccuccuccugcuccuccuccuccuccugcucccuccuccugcuccugcuccuccuccuccugcuccuccuccugcuccuccuccuccuccugcuccuccuccugcuccugcuccuccuccugcuccuccuccuccuccugcuccuccuccuguuccuccuccuccugcuccuccugcuccuccuccugcuccuccuccuguuccuccuccuccuccuguuccuccuccuccuccuguuccuccuccuccuccugcuccuccuccuccugcuccuccuccuccugcuccuccugcuccugcuccuccuccuccuccuccugcuccuccugcuccuccuccugcuccuccuccugcuccugcuccuucuccugcuccugcuccuucuccuucuccuucuucuucuucuucuucuucuucuucuucuucuucuucuucuucuucuucuucuuccucuuccucuuccucuucuucuucuucuucuucuucuucuucuucuucuucuucuucuucuucuucuucuucuucuucuguuuugagguuuguuuuaauauggaaucucagguaccccagacugacuucaacccugagguauagaugaagaugagcuugaacuccucauccuccugucucugccugccaagcacuagaacaacacacaugagccaucguccaucaccaugcuuggcuuucuaugaaguagaggcagggaugggguagucuggggcuggggagauggcucagugugauacaaguagaaggaccugggcucagaucuccagcacccguguaaaacccaggauugguagugcauaacagagacaggcagaucagagagagagaaagagagagagagagagagagagagagagagagagagagggagggagagagagaaggagagagagaaggagagagaggggagaaaggagagagagagauugagauuuaauaagaaaggcucuccugagcauggaaguguguuaaggcagggcagaucccagggucaagaauguuuguuuugugacucaucuuccaagagcugggcuuacaguccuaagccacaucaccauauugaauaugcagcuuuaagcuuauaaagguagacaggcaagauggcucagagaguaaagggcuugccgcacaaaccugaccaccugaguucaauccccagaagccacauaaagguggaaggagagacccagauccacagacuuguccucugaccugcaugugugucaugggauaugugcucccuucacacauacacacagacuuguccucugagcugcacaugugucaugggaugugugcuccccucacacacacacacacacacacacacacacacacacacacagacuuguccucugagcugcacgugugucaugggaugagugcugcccucacacacacaaauaauauuaauauuaauaauaacaauaaaauuauacuauaaaucccugauggcuguacaccuucugaucuucauaacucagaaggcagauucagaaagaucacaaguuagaggcuagccugggcuauguggugagacccaauuuaaaaaaaaaaaaaaaaaaaaaaacaugggcuggagagauggcacagaggguagcacuugcugcuacugcaaaagauucagguucaguuccccaaagccacguggugacucacaaccaucuguggacuccagucccaaggguucugucacuguccuccagcuucuguagacaucacauaugcaugugugucagauacauacaugcaggcaagcacacauagaaaacaaaaucgaucgaaauuuggcaucccacccaccuuuaauuucagugcuaggaaggaccucugaguucaaggucagccuggucuacauagugccaguacaggcagagcuacacaaaggagcauugucgggaauaaccaaaauaaacaaauaaauccaaaaaaauuuuuaaaaaagcauaaacaaucaaacaaaaccaauuuguggacuguuucuggaaauuuucacuuaauaugugcaaaccauaggcaaccaucgguaauugaaacuggagaaagaaaacuuuugcuguuuaugauggguaaagucaagauggagucagaguugucagggcagggcaagugugggcuagguuccuuccccaggaccacaccauggaggcuguggcaagaacugcaauccagcuugaggcuagcaugagguacagauagucucucucucucucucucucucucucucucucucucuuucucucucucucucucucucucucucguuucucuuugucugucuucccucugucccaccccccaccccccacccccacaccauugguuuugauggguagcucaaucggaagagugcuugccugguaugcacaaagcuuuguguuuuaccccaacacugcauaagccagguaugcagugucuuaggccaggugugcaguggcuuaggccaggugugcagugucuuaggccaggugugcaguggcuuaggccagguguuuaaugccaguuuucgagagguauugccaggagaagcacaaguucaaaaccagcaagcaggaagaaaaaacaaaaccaagaagccaucuguggcuacauggcaagcagcccuuguguguauauauagccaacugagcuauacaaaaaagcugagugaaaaggugucccuagggaagguugguucaaaggucaugagaucaggauaaagauggcacuuaggaucaugggugauugauaguuggagagcuuugaagguaaagaagguuugcaggucagggacuggucucucaguggggucacagacagguaauggagucacaaccaaguuaagaggcuacaagggucuuacauguguaacacacauuguaugaagaucucccagugggggagucggaggcaugcuggggaccagggcagagcccgcgugacccccaaaguaguccccugucgcucaucgccagguucuccccaaucgccaucgauggcaugaguggccuggcaggcgugggcuuguccggaggcgcugcaggcgcuggcuggugcaucuucguguacaaccuguccccagaagcugaugagagcgugcuguggcagcuuuucggacccuuuggggcggucaccaaugucaaggucauccgagauuucaccaccaacaagugcaaggguuucggcuucgucaccaugaccaacuacgacgaggcugccauggcuaucgccagccucaacggcuaccgccugggcgagcgcgugcugcagguguccuucaagaccagcaagcagcacaaggccugagcauuuauugcccucccuccccgggcagcagagagagagagagagagagagagagagagagagagagagagagagagagaggaaaagagagagagugugcgcaaucucgagagcaggcagacccauacaccugcauaaacaccacagggugagcauccggauggggagggucugcagggaauugagggaaggguguccccacccuguucuccuugcuuuccccaccucaggcuggggcuuguucacucucucgucuugguuugguucauggugauggcuuuuguuucuuuuuucggcuaaaaacaaaaagaagaaagcagagaggagacccccccaucccaccucgcccuccccacccugcaugggauggcuuaggggacacaauggugcccuacucaggccucccuugcccaggccuggccuauacugagagaaaggggagggaacagguuuaaaaauccccaaaacggcaaaaaaaaacaaaaaacaaaaaaacaugaaagaggggagugggcguccccaucccccgccccagucccugagcagagaacagggagcagaguuggggcagagcaggaagcagaaaaaaaaagggugggguggggugggaggggaagaaaaacucuauuuuuguaaaaagggaaaaagaccucguggagaauuuuuacuggggauucuugaacuugaaaaaaaaucacaaaaaaaaaaaagacaaaaaaaaaaaaaagaaacuauuuuggcaaguuauguuuaccaacuacuggggcagggguguagggagcagggcugagggcugagaguccauagggccagcaucacagguacacacacacacacacacacacacacgcacgcacgcacgugcacauaagcaaacauggccacaggaaaggaaggacaugcacuuggaccuuggggacacagauacacaacacauagauacagaaacauuucaggauacauucaggaugaccaaauccacaccagagaacagagacacagacagacccuuggcgcugcauaaacagagauacagacguuggcugcuuguccacaaaaccaugugaugugugaaaugcacugugacagauccauuuggauguaagucuggacgccaguccccagugagagcuggggagguagcucaguugguaggacacuuguccagcuuuccugaagccugggcucuuccccagcacugcacaagccugguguggcacacagaccucauucauucuagugcucaaaugguagagucagaucagaucaagacuagccuuggcuacauagugaguuuaaggucagcccgggcuacauaagacccugucucaaaaugcaaaaccaaauaggucaccuagaagcauacaacaccagggacaaaagcccauguccacagcauccuauaggcccagacaagguguuccuacuuaagacccuggcccaguuacuuccuccagccaggcuggucccaccacuucucccuggguccccaacaagccccacccuuggguucucuacacaaacuccuuagcccaccaggggccucccugcugcccaacacacagacguacacacauggcguccaugcauccaaacacacgauaccucguucuacuuuggcaucaccgugggcuggagggggcucucacuccccacaacacugaggccaaaggaccccccugucccugggucuggggagaggucugcaguccuccucccucaaguagggacagagugcucccuaccugcaagcaagcacccagcacacuccagcagacccagggguggauggacccaaggugucccccaccccauccacuugucgcccucuuuugauuguuggguuuuuuugucuuuuccggauugugggggaaucauggaugcagccuucgugagccccggcccggcuucggaauggauuuugcagccaugccccacacacacccugacuuuucauucuuuuaugcaaguuccaacagaagccacaggcuggagcccugggagccccaaaccuucaacccaccccacagugggcccagucacaaccaagaauggugaagccccucccccacucuacacucuagguucuaguugcuuucuuccgguguccucugcguuuggugucuggccacggccccauuugagcguccaacucucucuccccaccccuccugguguuguucuuaaccgucuguggaguuucugcugcaaggaacaaaaagaaaaaaaaauuuuaaaaaaagaccaaaaaauaaaaaaugaaaaaaaaaaagaagggaagaaaacucaaacagaagaugaaauauagcaaaaggaaagaaaagaaaaaagaaaaaaaccacaaagacgauuuaaaaaaaaaaaaaaggaaaaaaaaagauaaacugucaccaguuaacuuucuuguacuuuuuugcugaauuuagcuucauguaguuuuaacuuauugcuguguuuaacuauuuauucuccuuguuggccuguaaggaccuuuguguauauuucuguuccuucaugaguuugcagguugaagggagcuguuccuuuucuuucaguuuugcugagaugugguuaugccuaauuuauuuauacaaaggggaaguggagucauuaaaguaauaauuauuaauaacaguaaugguagcagcgugccccccgggggugccgugggcuccgagggguggggugggguccccacagcuggcggugcccggggcucucaacgggauuguuuugcuauugucuugagaaguuuuucugucuauuuagcuggugaacucuagcuugcucacgauacaccgaaccuauuuauucuggugguuucuaagucugcccuuccacuccccacucccucccagcaggacagggacuccucaccuccaggaggguccagccccuucuuccccugcuguuucuggggucuccccugcccuccgcacaugcaggaggcauccgagcaauaagggcuggguuugucccccacccuggggggaggaugggcucugaagagggggcaccuccccccacccccucccaccaaggccuaggucccugcugccuccaagacugggaggggggacuuuuuuucuaggacacaaagcuuagcccagccagguccccucccuggaggccagucccccaagagggccaggccaggggcucccagggagaggggcccuugggucuuccaaagucccugggggguuggggcagggccagugggaagagggcucagcccucuaacccuuccuucauccuguugauugggaaaguuucaaacaugacagucuauguuggaggugauauaaaagaacuguagaaaaaaaaaaaaaaaccauaaaacaaaaaccaaaccucaacccgaacccaagaacacuucaaguugcguuagacauuucuuaccgagccccaggccuggccgcgguaacugacuuuuacaugggauucuuuaacuauuuguacuuuucaugccagaaaauaaaaaguucagaaucuuaagucucaggugcucugugugccacuguggcgggguggccuuugcgcugcaacaccggggaaggauggcaucugucccugggccagggucucuaaugauggccuccacucagcaacagaaguugaccgaagccuacuaucuaccuaucaguaggugccgggcauccucacuguuggcuagccugugguccugcaggaucugaacaugguugcuucccaaauguuaacguuguagaugugacagaagagaugugggccugacgcaguucaagauuccagucuaccgggcagugguggcacacacuuuuaaucccagcacucgggaggcagaggcaggcaaaguucugaguucgaggccagccuggucuacaacaccgggugaguucccaggacagccagggcuacacagagaaacccucuugaaaaacuagggaaaaaaaaaaaguccaguccaucuggcaggagccugaggccacagugcaccugcagucaggaagcagcgauagcuaucggguuagagug

SEQ ID NO: 4965 - RNA, 15132 nt, Mus musculus
ugaauucaaacuucaaacauuuuuauuaaagggcguuaaaagugcucgcagccaagccugaugacccagguuucauccccaguacccacauggaaagaacaucccccaagcugcccucugacucccacacgaacaugcucacauagacuuacacacauaacacacaguaaaaauaaacacagcuugacauucuguuaaagcuguuggcaguguugcccagcugagguuccagcuauucgggaggcugaaccccgaggaucucuugaauccaggguuuugagaacaggcugagcaccacugcaagacccugacucaaacaacucaaccaaccaaacugaaaaaaccucuuuaguaaaaaaaugcauuccgggacuggggcugcggcuuaguugacagcaguagagugcuugcuuagcacgcaagccgcccugggcuccgaaccggauguggugcuuccaguccguaacaauaauaauaauuuaccacaccgcggagaaaguuggaccggacggacgccggggaacccgcuccagcgccuccguacugguauccaaagucuccaggcuucuggagcucagugaggggcagggccugcuccugaggagaaaccagcgucuccccccuuccuauugguggaucucuuccugagggcgggaccuaucgucacaggcucuucugauuugcugucaccuucgacucguaaccggaagcuccguggcucaacaugacagcguccagcggucccacagagccggcucgggucugcggcuggccacgugaguaggugggucgcgcgugggagguuuaugggacugucugggauucggggcguccacuuccaggccugguagagccggggaggaugaccuucaacucggccucagagucgggacacugugaccuuuuggggugcaggcuugggaacgugccuggaaagguugcugggcaccucuugcugcaggcgguccguuucacagaugggaccgcggacuugggccacacaucuugucugugacgcaggcauuggaaccuuccaaugagaccucuuagagacccggaaucgugccagcccacacgcauacacacacgcgaccuggcuguucagauuucucucuguuuuguagaaacuugcuuaguuccacuccguuggucgguguugggcaguuaccauguaccaugcacuggcccagcuaguggagacacaaccagauuuuaaacagaaaucagaugagaaaaacagauuuuaaaaaguauuuccuaauugagcaaaccacaaacauaacagauaauucaaaacagugauuguugcaagcaauguguuuuucccugcgacaagauucuuuauguaccccaaguuggccuugaauucaucaugaacauccuccugcuccagccuucugagugcuggauuacaggcauauaccaagacaguaaguaguaggcagaggguaaaagaaucguggugguacacgccuuuaaucccagcacucgggaggcagaggcaggcggauuucugaguucgaggccagccuggucuacagagugaguuccaggacagccagagaaacccugucucaaaaaccaaaaaaaaaaaaaaaaaaaaaaaaguucaaagcccgugccugaggugcaucagaccaaaacaguguggcuggaguuaugagagagaggggagguacagcagguggacuccauccgauguguauuuacuuugaaguuuuuauuuuagccaugguauggagguggggcacaugugcacuggugcaugguggaggucagaggacagcucuggaguuuuauccauacaccuuauguugguuccaggguuuaaacucaggucauuagguuugcuuuguuuguuccaacagcaaguuccuuucucagcuaaauuuccucuccccacucuuauuuauuuaaauuuuagacaggaccuuacuguagcucagacugacaugggacuuacuaauuaucaccagcugguuugauucuggaggccaucuuccugccuauguaguccuggcuggucuggaacuugcuaugccuauauagaucgucucaccucaaacucagaggucugccagccggggucucccaagugcugagauuacagguaugugcuaucccacccagcaaucuuauguguucauauguggguacagggauguauguuaguauguguucacguguacaaaggacaaaugucaaccuuggauguugucccucaggagcuguccaccgugugcucugagacagaucuuucagugggacauguagcucacugacuaggcuggcuagcagcgagcucggggaccugcccuuuuuugcuuccuccgacugcucagauugcaagccgcuuuguauguagggcucaagcccugguccucauacuuucagggcaagcauuuuuaccaauggagccacauuucaagcucaccuagcuccuguuguuaaaagcuuuccuuugcaauggaaggaaguaacugggagggcagaagagagagggcaaaaacguaugcaggagaguagaccacggacugcuguggugaccugcaagagggauagauuuggaagccaucuucagaacucggauggauugaauagggacacagugaaugcuggaugguuccuacguuguggcuggaguaagcacuggugcuacuggcuaccuccagagaagcacuguaaacaaaagugcugucaguugguguucccugaauggaguuugggguggcugcuuuguaccagaguugugcuucuguaggaggcaaacgcaucagggaaccaugagcaugaauacucacgacacugauacaaguuggagccaccuaugggcauuacaaugcagauucucaugcaguuagagccaauauuuuacagguccuggaacacaauuugcaaagcaagguuuuagauucuuuucaucuaacuauaccaagcaaguacauaccaugagccacacccucagccucuaacuggggcauucuaggcaggggcucuacuacugagccacacuccuagcccccuagcagaggcucacgggggccagcagcucacuggaggagucuaggccaggucuguauuaccgagucacagccugaguccgguccaauugcauauccucagaccagcagcuguugcuaucaccugaaaguugcagaagggcggacauauuuccacuaagccugaaucugcaggcuuugugcucccagggcauuugucugcauccucagcuuugcagacacuguggacacugaaagccaucucaugauuggcugagaaauaggcauggaugcuaggaagaaacccaagauguuaacaagggcugaggggaaggggacuucacuaucuaauacuugggagaaaguugacaucuugaagucauuggcuuccucaaagaguugcgcacaccaacucacuggacaggcauuacuagggcagccaucagguugcugaggaaggagccagugcguagacauggcuaagguguagcuuuaaugauaagaaagcagggagcugagcggagauuuugggccaaaaugggagacacuagaaaagggguuguuguuuuuuuccuuaaauaaguucucauauguaagaacuuggcacucacaaaggucuggcugucuuuacauccugaaugcugggauuaaagguguguguuaccaugucuggcucaacuagagaaaguuguuuguuuguuuguuuguuuucacuuauuuacucugcgucugugugcccgugccugucaugccacuggaggaguggaggucagaggacgacuuguggggucgguucuccccuuccacccuggauugauugcagggauggaauucugguugucaggauggcagcaacugccuuuaucugcaaagccauugugucaucccaaagguguuuuguuguguuguuuucuuuuccuguauuuuuuuuuuuuguuguuguuguuuuucaagacaggguuucucuguguucccuuggcuguccuggaacucacucuguagaccaggcuggccuugaacucagaaauccgccugccucugccucccaagugcugggauuaaaggcaugcaccaccccugcccagcucuuuuccuguuuuugagacagguuugcauguaguccaggcuggcuucauacuuuucauauugcuguguaucuaaggcugacccaaggcuuccaccccagugcugggauuuacagguguaugccacagcacccacuucugcaaaguuuuagugguggcaagaacgauccaaacucuuccuaacauguucucuguggccuagauaccccaauaccaaaaccaaacagguauaccaagaaaacuguacacaucucuuaagcucucuccuuucuuacgcucaucucuagcccuccuucucucccacucuucucccucucuccacguggccauggccagccccucucuuucuuuaaccaucucucuuucucucugcccuucuacaauaaagcucuaaaaccauaaaaaagaaagaaagaaagaaagaaagaaagaaagaaagaaagaaagaaagagagaaaacugcacacuagugccucuugaauaugacuauaaaauucucucgcaaugggcuugcaaacaugcaaaaagaauucuacaucauccuaagagaauuuaucuucaaaaugcaagguuaguuuaauaucugaacauuuauguauauaucaauagaaaaaaaacccuaaaacuacaugauuauuucaggcaaugcagaaaaauauuugagaaaauccaacacuugcucuauuuauuuguuagaaacaacaucucucuguguagaacacacuggcugcgcugucccugcaagugucauacccagcacugaguccagauaagguuaagaaggaaacuuggagccgggcagugguggugcacgccuuuaaucccaguacuugggaggcagaggcagguggauuucugaguucaaggccagccuggucuacagagugaguuccaggauagccagggcuacucagagaaacccugucuuggaaaaaacaaacaaacaaagaaggaaacuugggucagcagaacuuagcugguccugguuccaaacuucuggagucuaaugcugagugacuuauuucuugcacauuuaagcaguaaaaguuuggggauaaguguacacgagacaguuaucacaacaaagcuuuaggcauggcugcauugaaaaucccuagcaaagcaccugccccacaagaguggcuuuuguuggcugagaacagugaucaggacaagggcccauggaagaauaagcagaauagcaaucucuuuugcagaauacaagggcccucuuuccugaaaaugggcucuacugacugagacaaagcucucaggauccuggggugcuguggggcuggcuuuauagaggaacaaagucugccaaguauuaacacguccaucuccagccuucuggauggaaaaugggagucaguuucuucuucuuuagugcugucuguaagcucugcucuaucuacagcuggccucgaacucacagauaccugccugccucugccuccugagugcugggauuaaagcuaugagccaccaugcccagugaaagaauagauucuuuugccaggcaaggcugugcacucuggccacuugucaguguugcaccaagugucugguuguagcacucaggcaggaaaaggaccuagagcugccauggagacagugcagauagguaagugcuuccugcaggagccugaccaccugagcucuaucucagguacccagggucaaaaggagaugggacggguaagauggcuuacaggguaaaagugcuugcugccaagccuaaggaccugaguucaauccccagcacccacaugguggcucccaaccaucugaaccuugaguugcagaggcuccaaagcccuaugcugaugucuucaggcaccaggcacucaugugaugcaccuacauaauggaaaaauauucauacauguggcaaaagaaauuuuuuuuuaguuaaacaaaucagccaguuggcgguggcacaugcccagcauuuaggaggcagaggccggcagaucucugugaguucgaggccugcccaagcuacggaaugaguuccuggacagcuaaagcuacacagagaaacccuuucuggaaaaaccaaagaaaagagggagauaguuugggauaaaggugcuugcuacuaaucacgaggaccugaauuccaucccgaggacccacguggugggagagagaacucgauuuugcaaguuguccucugugcuggugccuggcacauuuguauauacucucaggaaugcacacauaaaguuuuauaaaaauaacaauaauaauuuuguuugcagccacacuuguugucaggugacuccuacuuccuucugagcccacucucucuucuuaagagauuuuauuuauuuuauguaugugagcauacuguagcugucuucagacaccccagaaaagggcauaggaucccauuacagaugguugugagccaccaugugguugcugggaauggaacucaggaccucugggagagcagucagugcucuucuuaaccucugcaucaucucucuagccccugagccccuucucuuaacccuugugcccaaccaagccugccuucuuuuccuuuuaaagauggaggaggcagagaaagggaauccuuggggcccacuggucagccagucuagcuuaacugguaagcuccagaucagugacagcugucucaggaaacauggugcaugcuguuagucccaguacgcaagaggcagagguuggggaucucugugauguuugaggccagccuagucugcauagcaacuuuuaaaccagccugggcuaguaggacccugucucaaaaagaaggcuggagccagguguggugguggcgcacgccuuuaaccccagcacuugggaggcagaggcaggcggauuucggaguucgaggccagucuggucuacaaaguaaguuccaggacagccagggcuacacagagaaacccugucucaaaaaacaaaaaacaaacaaacaaaaagcuagaugucauggcauuccuaaagugagggagaagacuacugaaaaguuguccucuggccugcacaaaaguauuguagcaugugaaccugaguauacacacaaaauaaacaggcaagucuuucaaaaaaaaaaaaaaaaugaagaggcuggagagauggcucaguggguaagaacacugagugcucuucugaagguccugaguucaaaccucagcaaccacaugguggcucauaaccauccauaacgagaucugacuuccucuucuggagagucugaagauagcuacaguguacuuacauauaauaauaaauagaucuuuaaaaaaaaaugaagaagaaaaacucccagguaugaggcaguggaaugauuacuguaugaaggugcuugcugaagccuagaaaccaagcucuaugcugagacccacauggaagagagaaccaguucuccaagcuauccucagaccuccacacaagggcacgcacacgcauacaugcaugugcaugcacacaugugcacgcucacacacacacacacaugcacacuaaaucaguaaauauaguggaaagauucccaagcaugauagcucacaccuguagucucagcacuggggaaacagaggcaggaggaucaggagcuuaaggccacccuuggcuaccugggcaauaugauauucuauuuuugaaaauaacaaaaucagacagaaguaacccuuggagcuugguggacuaggcucuucugucugaacugugcucuuugucauagugacgcccugucucauggaagguaugcugcaggcuaaugcugucucaaucccucucaacuaggugugguugaaucuacagagacaugagcugggugcaggucaacuugcuggugcgaagccucucuaggggcuggggaggccucugcaggccugcccuuucaggaacucccuuugcucagguaaccacaggcugggcauuuguggguggagagggaacggccuggcuuuacucucacccucucaggaucaggccacagaaacugaagguggcccuuguccugccuguccuaguugugguccuguguuagcuugccaucgcaguacuaaaguacuaugaccauggccaaaagcaauuuacauuagaaagagugucuugguuuacaguuccaaggguagagucccuuauggcuguuuguggccagaguagaaacuggagaucacaucucaagcauguaggaaggagaacaaccuguaaaugagaagccgguauaaaccugaagguucuguacccucccugugcacugccaccagcugggccaaguauucaaauacgagagccuuugagggacauuucucacucagaccaugacaaucugccucucuccuggccacauagacuccugacacuaucaugaugcaaaaugcauuucauccaauuucuaauguuccuauggucugucacagugucaauaccauuuaaaaguccaaagucuauucugagacucgugcaaucucgcaacugugacauucuacguagaaguaaaucacacucuuccaucagggaaugacacauuccauccuuccauuccaaaagggaggaaugaagccaaaaugaagaaauacugaaccccaaacaagacugaaaacccagcagugcaaacaggaagcccuguagcuccaaugugcucagacagccccacuccucuagcucagcugcccuaagccauaccccaccccagacuggcuccagucccugugcggcuguccuuggcagacaucucauagcucugacaucaccaacaucuugaggucugcucagcagcccaagcuucacucucacagauugaugcagugguauccugggaccuccuaccuucucaggauucuugcuuccuuccugccuucaaagccaguaccauacaacacugccagauuagcucaugguacuucaucacaguaacagggaagcacuaguacagaaguugguguccacaaauagggugguugcuauaaagacccugacuguguuauuuugggaagguggaagacuuuggaaauuuggucuaaccaagcaagugaaugcuguaagcagaguuugacaggucuguggggaaaauucucauucaaaccacaacaaugugguccuggcaaugcuucuugauguuuucuucgcguguguguaugcguguguaugcaccauauguaaucucauauggccuuagaacauguauguguggcucaagcaaguauugagcucucaauucuccugccuuagcuuccuugggguugggauuucagguguguacuaccauguggcauuguacuuuaauguacuauaucaugauaucuaagcuacgguuagcaguaacaguaucaaagcgccuaaaagguccuccaugauguccaggguaccucugccaagaaacagaaaacaaaaagcaggcaccauccuuucucccaggugucccuccaggcucuacgaggccuucacuguagugcagcuacacacaaggaugagccgugguugguuccucgacccccggagccccagaggaagcccaucaagguuccagcaaugcaugaagacucguucaagccaucaggaaacagggagcgggacaaggcaagcuuccugaacgcagugcgcagcuuuggggcgcacaaugugcgcaagcgcggccacguggacuucaucuaccuagcacugcgcaagaugccagaguuugguguggagcgggacuugucaguauacaaccugcugcuggauguuuuccccaaggaggucuuccggccccgcaacguuauccagcgcaucuucguccacuacccacggcagcaggaauguggggucgcaguccuggagcagauggaacgacacggugaggaaugugggcccagccuuccuucgcauccuucuccacucaccuuucucagucucccaaguccuucgccugccccuccccucuccccucccucuuccaauuauuaggcuugggcuguagaaaaguuggaggaggacuuaccugggaugucuccaggcugauccccuguaucuaaaccucgggugcuucccugucaccucagcuccuaggcagugaggggagacagggcuucaagcucauccuucacuccguaugguucuggguuuuuuuuuuuuuuuuuuuaaagaauucuuuuuuuuuuuuuuuuuuuuuuuuuaagauuuauuuauuuauuauauguaaguacacuguagcugucuucagacgcuccagaagagggcgucagaucuuguuacagaugguugugagccaccaugugguugcugggauuugaacuuuggaccuucugaagaacagucgggugcucuuacccacugagccaucucaccagcccguuucugggguuuuuuguuguugguugguugguuugguuuugguuuuuuuguuuuuaugauuuauuuuuaauuauauguaugcuauggcuggagagauggcucagcaguuaagagcacugacugcucuuccaaagguccugaguucaaauccuagcacucacauggugguucacaaccauccauaaugggaucugauguccuauucuugugugucuggagauagguacaauguacucacauaaauauaauaaaucuuuuuuagaaaaauuauauguaugcuauguguuaguggguaugugaauucuggugcccaaggaggccagaaaagggugguggaugcccuggaauucgaguuaaaaguggugcagugcauacuccuaauugcugagcuauuucuuucuccagcccucuuuccccaacacacacacuuuacauggucucauguagccuaggcugcccuugaauuugcugugcuggguagccaugucuggccuuggcagguuuuugccuacuguuccaagugcugggaucucaggcaugugcaacagugccccuuuuauauggugcugggagucaagccuuccaccguaugugccagaccagcacacuacucaacugugcccuagccucagccucagcuuccaacaaacaaacaaacaagaaaccauggaugggccagaugugguagugcacaccuuuuaacuccagcaguuggaaggcauggacaggcagauaucugugaguucugcucuauagaugacagacuuccaggccagccagggcuaccuacauagcuaguagcaagacgcugucucaaaguaagaagaaaacaaaucaugaaaaguaaaucccuuguaauucuguucuuacugacuucaaacuuguguuuaacaaguccuggaucugcccaaaacaggggucaugcccagcgcagagacagaguuccuacugauucagauauucgggcgcaaaaguuaccccaugcucaaguuccugcggaugaagcugugguucacccgauucaagaauaucaaccccuacccagugccccgagaucuuccccaggacccuuuggaccuggccaagcuaggccugcgacacauggagccugaccucagugcuaaggucacugucuaccagguaugcauuccuguauacaugucgcugcccucccuggcugggccuuacugcuucccuggguucugcuacuguccugacagugaccgugaucgucccuuuauuaccacaguuggaccugucuuagucuauuuacucauuggaagaaaagacccuauauccuccucuuguugcugaaacaaaauucuggaggcuggguacuuuauaaagaaaagagcagccaggcacaguggcuccugucuuuaauccuagcucuugggaagcagagaugccuggaucuuucugaguuaaaggucagccugggcuacauagugcuucaaacaaaacaaaaaaccacugacgggccagguguggcccguacauagggagcucuaugucagccagagcuacacaggagucucugccuuauucccuguugggauggagcuggggguauggcucagugguaggacaccugcuuuccuuguucaaggcuugugguuccauuccuagugagugacaaaagagagaaacuuggcuuuaugcuguaugcuaggcaagcacuccccagccgagucaagcucuugauaccaucugaagaacuguuacuuucugucacugccauuuuugcgcauggauaaacugagcuauguagguacagugacuuggauuagcucacugcaggcugaacuuaggcugauggcuucuggguaaacucucaguguuggcacucuggucaagcuggcuacaaagaagcagagaaaggcuacuuguaaagacguggugcagucgcccaggaagcaccccuucccucccuuugcucuuaggcuccccuguagagguuggggagucaccgcccugcucuucuuugcagaugucuuugcccagugacucgacaggcauggaagaucccacacagccucacauuguagguaaggccccagccuaucccaguuucugcuggaucccucugggcccacuaaaugagcuccugggccuuuugcugcuaaggcaccaacagguucucaucucuacaccaggaauccagaguccagaucagcaagcugcccuggcccgccacaacccauccaggccuguuuuuguugagggccccuucccucucuggcuucguaauaagugugucuacuaucacauccuaagagcugaccugccaccuccugaggaagaggugaguuacuggccaaagcauuugcugccaagccagaccaccugaguuugacccccagggcccauguagaaggagagaucucacuccuacaaguuguccucugaauuacacagggguaugcauaaauguuuacccaaaaaaaaaaaaaaaaaaaaaaaaggcaaggcaggccgagcucucugaguuuaaggccagcuuggucuacacagcaacuuccagauuagccagaacuacagauucuguguuggggguggggcuggcacuguccugaaggcucagcugagggacagguuuuguguucuggccucuaauccugccugcucucuugccugagguagaaaguagaggagaucccagaagaaugggagcuguacuacccacagaagcuggaccuggaauauucaaggagugguugggacgacuaugaguuugacguggaugaagguaaaagcaggucucaacacagcacaucugugugguggccauuuguccacgcuccacaggaugaggggucauaugccccccaggguaccucuccuuggcuacucccucuccccuuuguacuaucuuuuaaggagcauucuauacugacuagugaugugaccagaauacgcgcaagccucaggucagcagggaacagucaaguuauauguggggaguugggaggaggcacaugguagccuccaaguuagggcucaaacuuagucucuugauaguaucugagcagcggguggcauggccaagggaaauguagaacauuuauguggcacagggagcuggcugugaacucauggaggugcucagaguacgucacaguggugagacacaaacucuucuccuaacagugacagaaggcccugucuucgccaugugcauggcuggugcccaugaucaggcaacauugaucaaguggauccaaggcuugcaggagaccaacccaacccuggcacagaucccagugguauuccgccuggccagguccacgggggagcuccugacaacuucaaggcuggagggacaguccccuccccacaguccucccaaggggccugaggaagaugaugagaccauucaggcagagcagcagcaggggcaaaguugagucagauagagcuggcaugaggagaaaagacugggcugguaugaaauaauauggagaaaauaaaaaaaucaaaaccucuucccuggcccuguggcuucccuucguauguucugcaugggcucuuuuggguuuaccaccuugggacccuuuuuuaaacuugucuuuucaaaaauuccauuuauagaugggcgugguggcacacgccuuuaaucccagcacucgggaggcaggcagacagauuucugaguucgaggccagccuggucuacagagugaguuccaggacagccagggcuacacagagaaaccuugucucgaaaaaccaaaaaaaaaaaaaaaaauccauuuauauauuuaugguaugggagggauguguggaggucagaagaccauuugcuggagucuguuccgauauaugacccugugaaucucggaaauguaacucagauugucaaguaugccagccaucaccuuaccugcagagccgacuuguuggccuuuaaaaacaucuuuuaaauguauuuaccuuuauuuuaugugcauugguguucugcauguauauauguuuaugugagaaugguagaucuuggaauuacagacaguucuagcugccauguaggugcugaauuugagcgcagguccucuggaaaagcagugagugcccuuaaccagugagccauuucuccagcccuuuugaaaaaaucuuuaaucacauugccgaagaauucaauagagaggcaaggauuaccugaguuucaguacccagugccucuaccucccaaauaacugacuugucaacagaacgcacuuccauggccugggccggacggacuacgcgcaugcgcagcuauggcuaguuguccccguuuggcgccgcgggcagagaagacccugugagaaaucucccggcggcgcagacuaggcgcgccacuuccggucgaggcuccuaacaacgggggaggccgguaaccagggagggggggauggcggagcgggcuccagagcccggggcggaggcggaggcgggcgcaggcggggaggcggcggcagaggaaggcgcggcaggcagaaaggcgcggggccggccgcggcucaccgagucggaccgggcccggaggcggcucgagucccggaagaaguacgacgugcggcgcguguaccugggcgaggcgcacggccccuggguggaccugagacgccgcagcggcuggagcgacgccaaacuugccgccuaccucauuucgcuggagcguggccagcguagcggucgccacggguaagggggcgcggggccgggagagggagggagggagagaagaagccg

SEQ ID NO: 4966 - RNA, 447 nt, Mus musculus
cacuucaagauggcguugcucgugccauugaaggagaagaagcucaugggagucagacuuggagagcuucugagcuggauaaugaugcgggauuucacccccaguggcauugcaggagccuuucggagaggguaugaccgguauuacaaguacaucaacguuugaaaggcagcaucucagggauuagcaugguccuggcagccuacgugguuuucagcuacugcauuucuuacaaggaacucaaacaugagcggcgacgcaaauaccacugaagaggggucacuggagggcauugcauggccgagcauaacugccugccccacuccgaccuaggaagaauucaacuggcugaaccuucauacccugacugagaacuagugcccaauaaaaggugacugauucacaaaaaaaaaaaaaaaaaaaaaaaaaaaaaaaaaaaaugcuugc

SEQ ID NO: 4967 - RNA, 10417 nt, Mus musculus
caggcuuggaagagcccagggcuggcuucuggagcuucaaaaacgugugaggagggaagagggugcagacggaggcucggcugccuguugcgcuugucugugucaucugcaccucugcuuugccagagcccccuggccagcaugucuucugcacauuuuaaccgagguccugccuacggcuugucugcugaaguaaagaacaagguaaggcuggaaggacugacaaacaccccgccgggacagagcccuguuccccaaaaucccuccuaccugugucacguguccuaagaccugagaaguuaacgguaggggcuguuuuucuguccuuucaacaccccagagcccucaguugcuucaggggugaagugaggggaccccaugaucuauacauagaaauaaucagagugcugcaaagcuuccgcaccugcucagacuccuuggucaaucuucuuguuccugggagggauguaaggagaagggacagaucccuagcuuuaaaaaaaaaaaccaaaaaacaaaacaaaacucugccggucugcagagcuaaaagauauugagagauagcaucuuccugucauggauggguaaacugaggcuuagaaaggagaaacaaggaucuagggcgccagguaaggcaagugcaaagcuuuaaaccgucuccacaacuaggugggcaagccucucaggacaggggacugcacggagggagagagacagucccauuugacagaagggaacacugaggcacuuucuuuccagggcgaggagcagggauugggaccuggauccgguuaggguauccuaggggcuggaguucagggagugugggggcgggugcucugccagagacugauggcagcgccgcccccuccccccagcgccggccccagagucgcagaggagccgccgcgccuuauaaggcggccuugggcagcccgggcccgcgcuauauaagggccgguuugcuuuauaaagccgggcuggugaggaggggggcagcagggcuggggccagguaaggggcugcaucccuccucuccccaugcagaagugaagcaucccucuaucucaccgccaccagggucugggaggcuagcaugcagaaggauugcagaaaggacuugaagcagucuuggagacuggagacaggagacaggagagcaagccaggagggagauaagagcuaagagguugagaaagagugugcagaaucccaccccuacccgggaagaugggauaagagcugaagcuaaaaaaaaaaaaaagccaugggucccacaguucuucagacaugggacccucaagacugagugaaagauaauauagagaguuggaaaacaacgagagaccaagugggacugaggacagaccuaaagaaacauagacagucaaggguuuggagggugacaagaugcucucauuucuaacuagagauuguaugcacaaugaccugggagaacauggagggauugagcaacgcgguggggaggggggggcuucuucuuaggguuccuccccacccccaguguaaggcauuuccccuuccaacaggagaguggggagggcugggucaggggaagcuaagacccaaguuuggcuuggaggggaaaccaaggagccaagcgccgccucacccccaccccccagcuucaaggaucuggcuuuccagcccccucuugucuauucauuggugccaaaccucagaaugcccggaauggcccccugggcaggugccaccucaacccuggcccucagccuccccccaacaccccuccccuacuguggacacuaagacaggauugccuuaguugggaugagguaggagauccgaccuauccgggcagggcuggccaggcucggggaaagccagagccacucuauugccuggguccucaucaccugcucugugugccugucuccuccucagcuggcccagaaauacgaccaucagcgggagcaggagcugagagaguggauugagggggugacaggccggcgcaucgggaacaacuucauggauggccucaaagacgggaucauucuuugcgagugagugauguucuuagggugcaggaccugcccccuagcccagcagccccucuccagaaaaccccucagcauccccuggugacccccagccuggagcuggaguuacacacugauauuugaugccacccccauuccuugaaaggccaaagagacucuucccgugccugcaucacaggcagagaugacaagagucagucagguaaccccagagcccucagguguugcaagggcauuauucagcgagcacacucuacagagcaggccugccuguggauuccagcaucauagcuaaauggcagugggcaacaguggcuguuuaucaccagcuuaaaugacaugaggguggagucauaggaauuuauguagaccauggcuucccacucuccucaucgcuggggaagauggaaauccuuacuguggccuggcauacgccugugcccccauugcuggcaaagcugagguaggguucagaauucuaugucagccuaggcugcauaauaagaacaugucuucuaaaacgaggaaggcugggguggggaggguggagcgcucccccagcaugcaggaggcacugcguucaucuggcacaguauaaagccagguauggugguguaggccuguaaccccagacacauuagagguggagguaucagaaagucgaugucaccggugucuccacacugaguuugggaccauaggcuacaggaaagccugcuuugcaaaacaaaacaaaacaaaacaaaacaaaacaaaacaaaacaacauaacaccaacacuaggcccagggagauggcucagucaggaaggccucgcuguguaggucugaggacuugguugcuaaaacagaaggcaggcuggagagauggcuuagcgauggauagcacuuguucuaugaucagaagaacagaguuggggcccgaacauccauauagcgagugaaacaucccugcaaaugcuggcaacccuggcucggaggguuaggaagacacgaagaacauugaggcuugauggcuuccaacccaguugaggaaaagugagccccagguucagagagagacccugccucaaaagcaugagcagagagcaauagaggaggacacccagugucauucuguggccucuacacacgugagcagagguacacacaauguacacgcacacacgcauacacauuuuuaucauauguguuuacuuguuugcuagggcucacacauauauguguuguagcaugaguguggaggcuggagaauagcucccagauucagaucuccccuugugcuauguggguccugggggucagacacagguguucaggcuuggcggcaagcaagcagagcccagggguucauugucuguccagucuagccuauuugguaagcuccaggccuugucucaaaaaaacaagguagaggcuagagagaccucucacuggguacaggcgcugcugugcaggccuggcagucugagcuccauugcugacccauggaaagauggaggagagggagggcagaauccacacagcuguccucugacuucuacuuaggcacuccaucucauacgccuccccccaacaccaaggugaaugguaccugaggggucacaggggagacuggccucugaccucuacacacauaugcugcacacaugcaaacaugcacacauaagcacauagcaauaguaaaagagacucuugccaguccuagcaccugguacaaguucuucuuuguucauguauuugugagugugaaauggggugcacauauuguguaugugcauauagaggucagagggcaaacugugggaguugguucucuccucuuacccaggauuugagcucaagucaucaggcuggguagcaaauggacugacccgcugagccaccuugcuugcccucuucuauguaaaacaaaacaaccaaagccacuuuugcuuauacauguggguguuuggcagcauguacgucuucccccggacgaucagccagugcucuuuaccacugagccauccuucuagcucccucuuucauuuugugguagacaggguuucuuguagcagaggcuggucuuaaaauccucauccugcugccuccaccuucuggaugcugagguuucaggcuagcaugaccacaccuagacaucccacuucccccuaacacugggcaagguccugagcccagcgggccugucugcuucugagucugacaccaugaguuacagcucacccugggaaaacuccucaaagguguagcacauacagcucagcuuccccaaggcccagaugcucagagguggggcugucuaccuuguuccacuccuaucuaccagaaacaaggaucccggacaugcuggaguccugacuuacagagagcuggcucaggcuugagcagagagccaggauugagguccuacaguguaggacauaggccuaagcaaggcugccugaaucccaucccccacacuuauacagcuagugggacaaccagucauuuccuuagucagucauguacuaagcacguauagagcuucugguauaugcaggccuuugcucuaggcaugugcacagugaaccagacuccguguggacccuacagagggagcuuugguacuguaagugggcaaaaucuuggugacuccauacccagcaauagugucacaaggguaagaaaagauuaucaaccaaccaaccacauaaucacacucaugcccauagcaagagagcacaacgaagaccacucaacggacugacgauuggcucaguggguccaggcacuugccaccaacacugcuggccugaguucaauucccaggacccacauguuggaaggaaaggacagacuccuaaaaguggcccaucgauuuucacacacguguggcugacaugaggauuuccugacuggcaacugggucuagcuacccauaguugcguccaccauaagcacgugcuagguacaaaaguauccccuuccagcuguggacucuuccacccagccuggauccugaagcaacugggacucagccgcuccaucucugcuucucuuuguuagauuuaucaacaagcugcagccggguucugugaagaaggucaaugagucaacucagaacuggcaccaggugaguccagacacaauguacuagcuuguuuccuauuuuaguaaugaagcuugaacccaaagccgccagcgugugcuaggcuggagcuccacugccuagccaugccucagccucucucugggagacuccaggcagggucuuagaaccacacuaaagcccagaucuccaugguugguaccgucaaagcccccccucacggucagaugacuacucuggucuugguccucuccuacuuguuugagacaaggucuucaacucuucauuguuuuccucugggaccaggcuggcagucuccugaacuaaggauucuuucugucccugcuucuggucucaccuauaggaguccuaggauuucagacauucaugccauguaucgggcuuuuacuugguuucuggagauucgaacucugauccugacacuuguacagaaaguguuugcuuguuuggaacucacucuguagaccaggcuggccucgaacucagaaauccaccugccucugccucccgagugcuaggauuaaaggcgugcgccaccaugcccggcuuuguuuguauuucuuaccagaaucaccuucauggcuccuacuuuuuauucugagacaacgucucauuaaguuacccaggcaacccuugaauuugcagcugcagcugccucagccuccucagggggauuccuuuuuauguauuuguguguguguguguguguguguguuugugugagggugaguggguaugugugugugugagggugugugugugugugugugugugugugugugugugugugagggugaguggggguagggggugugagggugugugugugugagggugaguguguguguguguguguguguggguggguggguggguggggacgugccacagaggccugggagaggcacuggaucccuuggaacuggcguuacaggaguuucagucaaucccuuguccccuagccccucagcccuccacccucccaucucuuccccuacagcuggagaacauagguaauuucaucaaagccauuaccaaguauggggugaaaccccacgacaucuuugaggccaacgaccuguuugaaaacaccaaccauacacaaguucaguccacucuccuggcucuggccagcauggugagugugggggaagagugggccuggggccggggccagggcuggggccgggcugaggucugauauccacggggacacuuagacccuugagccucacugaggugagccacugagggacagugaggccugcuggaggcuuauguccuccuuuccuccauucaggccaagacaaaaggaaacaaagucaaugugggagucaaguaugcagagaaacaagagcggagauuugagccggagaaguugagagaaggcaggaacaucauuggacugcagguauggccccuucuccaccaggcugcucugugcugaggggaagguagcccagacccuggaggcuuugcagcucagaauauuaguacggacuggguggggcacuggacagcauuagugccuccuaguuacuaacuugcucccucugcccacaguccuaaguaguuccugauuuuacagacccuuaagauauuuuauuuauuuuuaccuguaugaguguuuugccugcauguauaccuaugaaccacauguguaccuaguacacaccaaggccagaagagggcaucggauccccuggaccauuguuggcagccacgugggcgcuggaaaacaaacccagguccucuguaagagcagccagugcucugaaaugcugagccuucucuuuggccucuagauaguuuucuuuuucuuuucuuuucuuuuuauuuuuuaaacauuauuuuuauuauuugccugccuccauguauguaugugcaccaugguguggacacagagacaacaagaggauguugugucuccuagggauggaguugauugcugugcaggcugggaauagaaccuggauccucuggaagagcagucaguguucuuaaccauugaguaucucuccauccuuuauacaggcaggggaguuugcagaaggaagcacacuacucucuuccuccuccucuuccucuuccuccuccuccuccuccucuaccuccuccuccaguauuggggauugagucuaggcaaacacgcugccuuaguuacaucuccagcccuguucacuuuuauguugugugucugcgucuguggaugugugugcaucaaggucagaagucucagccacugucacuccucaggagccauccauguccauuuguuuuuguuuuguuuugagacaggguuucucuuuguagcccuggcugucguaggacuugcuauguggaccccaagcuggccucaaaaacagagauccaccugcaucugcuucccaagagcuggggucaaaggugugcgccuccacaucuggccaucuugcuuuuugagacagagucucucacuggguuuucuagcuuacauugugauguaauaaaacacugaccgaaguaauugacacgaggaaggguuauuuggcuuccauaucacaguauguacagggcagaagucaggcaaggaguuccagcaggaacccggaggcaggaacugaagcagagaucauggagaaacauuacuuaccgguagcauugcuucugaggcuugcucaauuuucuuauauaacucaggaccaccugccuagggauagcacugcccugugggcuggguccuaggcaagcacuugaggcagggucuccuagagcccagguuggcccugaauucacuauucaaagcuagccuugagcuugucuuuugaucccccuucuaccuccccaguacaguuuuuacccugacacagggucuugcuaaguugcucaugcugguggccgucugcuggaggcaaggcaggccuuuaccuugccguccucucuccucgggcuccccauugaguagcuaggacuacggaccugugcuggcagccccagccuaaucugccucccuuuuucuuuucauuuguuuuauuguuugagacaaguucucacuguguggcccaggcuggccuggaacucaccauguaaaccaggcugguuucaaacucacugagauccacuugccucugccuucucagguucuuuuacuaugugggucccauggguccaacucagagggaucagguuuggaggcaagacccuuuacccacugagccaucugucccucagggccugaccuuaaaugucuuauccucuugggauuacagcuguacuucccuccggccaggauuccaguugacaggaugugggccacacguugaaucuuguuauauaauauccccucuguuucuggccucccgcucuugugucuccuuauugauuaguuaaucucuuuccuagaugggcaccaacaaguuugccagucagcagggcaugacggccuacgguacacggcgucaccucuaugaucccaaacuggguacagaucagccucuggaccaggcgaccaucagccugcagaugggcaccaacaagggugccagccaggucuguguagucagugggacaccuggugagauguggugggggagaggggcugcuaccccuguggcuugacggcuguuccauccucuaggcuggcaugacugcaccaggcaccaagcggcagaucuuugagccaggucugggcauggaacacugcgacacacucaacgucagcuugcagaugggcagcaacaagggggccucccagaggggcaugacaguguaugggcuuccucgccagguguacgaucccaaguacugccugaacccggaguacccagagcugagugagcccacccacaaucaccacccgcacaacuacuacaacucugccuaggggcccccaaggggcuggcugcugcucuuggcuggacccagcuggcccagccaaccccaucuccugcauggcguccucccagcccccuggcaccugccuauaggguuacgguuuggggagaugaggccgaggggggcaaugggaagaagggggccccucaucccuggagcuuucgcagggcccaacauagaacuggguguccccaacagugcccgaaggaagcacugaguugagcuguuucagcugccccccuuuauucccucacaaguaaguaccucccagaaccagaaacccuuccagcgaagcccccagaacccaggcuuggccugaccccugccccauuccugcgacgggagcagaugcaugccuggaaacgcaguggacacacgcauuuugguuuugcagugacugguguuuguggaugugacagcagcguuuguaacucgaacacauucuuuucuauuucacuggagcacaauaaauggcugugacaucauuggagucuuggggccaguuguuuaggagcauggcuuagauaaucuccauccucccauauauguaggagguauacauacccuccuauacacacuaggaucagugagauggcucagagcuaguaaaugcacuugacaccaaucaagugccuuuacuuaugacuugaguucaauccuugagacccacauggccagaaagaauagguuucugcaguacccacugaccuccacacacaggccaugugauacauacccuuccuuaaauauguauuuaaaaaaauuaaauaaaccuagaccuuacaccacuacacaaggugagcacauagcaaaugccacauauauuuuaacaaaaugaucaggagugucuuggggugggaggggaggggcggcaucccagauugugugcaugcggugugcacugguucuacugggccagguaauguaccuaauauuggcagagcaguugaguagcuaacuuugggacauggcuuucucuauaugccugccuuguucucagaggucucucucuuuuuucuccuuaaaacugaaucccaugggcuggugagaugucacagcuguaaagguguguuguguguaauuaagauacacacaacaaaguuguuugcugccaagucugacaacuuuguguucaaaccccaguuccuacaugaugaaggaccaacuccauuaaacugccuuccaccucuugccacagcaugcaugcacccauccacacuuuuauuuuuuuuuggcuuuuugaggcaggauuugugauguguuuaauccuggauggccuagaacuugcucuuuugaccaggcuggccuugaacuaacgaagaucugccuaccucuguuuccugagugccgggacuaccaucauccacuaauaaaugucuuuggaaaaca

SEQ ID NO: 4968 - RNA, 4220 nt, Mus musculus
caaagcgauauuuccguuuccguuaggggccggaaguuagcgucuccugggugaagcggccuuggcugagaggcagggcugguacaaguaaguguagggucucgcgggcgggcguugggccgggcggaccggcgcucuucucuagaucacccgcagggcguagagcugaggccggggcauggcuuugaggacggccucguggggagccugaccccuggaucccugcagcugggcgagcgggcggcgccaccgaaaccugggugaggcggacgccgucgcucugcccagaucccuucccgccgucccggucgccucgggacaccauggcucguucgcaggcugcgguuugccggugggauucuggggccccacagagacagauuccgggcaauucacugauuuguucaacaaguaguuauuaagugccuaagguauaccaagcacugugcguccuggggauacagcagugaccaagugaaauccuuccucagagauugaugggcaggguggcagacgccggaggagcuuugaggaguuuuaaggugaucgugaguuuguuuuggaugcugugugugugugcgcgcgcgggagagagagagagagagagagagagagaggcagccaacaacuucaccugccaagccaucucccuugcccuauuuugaaaguguuagaaaucuuuuguccuacauuuuucccuauauguguaguagaauguguacagaaguuaauggacaacuugggaaauacauccucgcuuuccaccuuuacguggguuaggguuccaaauucagcuuuucuggcuuggcagcagugcccauagcagcugagacaggaucgacuaagaugccccgccugccccgccugcgauuccguuguagcuagcugguugccagggccagaugggaggggaugcaaacacauccaccuagacaguugacagcugggcucggcaccaggcaacgcuucaccgugaggguuuggccuuuccuuuugugugucucacacuuuugucuccguugcuccgggagcuucagccauucguucugaaguaaaacgacgagaaaacccuucaucuggcucagacucuuccuggcugucuugucaucaaagcugccuuuugucaucuggaaugacuccagaagagaaggucuuuccugaucucuuucacccaaaguagccccagcucagagauuuguauuucgcucuaauagccucguagaaauaggauucauccaguuacaaguuuucucaggagccugucaucuguaacuauuaguacagauauauuaaagauuuauuuauuuuuaucuuuugugucugccauaucuggauccaggguaucugauaugugaccucaaaacccacagauugaggaccccugcccuagagccuuauccaugcuuggcuacuaucagcugaauucauccaguuaagcguguuccuguugccagguggugguggcacacgccuuuaaucccagcccaggagagacaggggcagguggaugauaaacuuggaucucugaguucaaggcuagccuggucuacauagugaguuccaggacagccagggcuacacagagaaacccuguugaguuuucauguuaagagcuguaaaccugcugggcggugguggcacacgccuuuaaucccagcacucgggaggcagaggcaggcggauuucugaguucgaggccagccuggucuacaaagugaguuccaggacagccagggcuacacagagaaacccugucuugaaaaaaacaaaacaacuguaaaccuuuauuuuauuuuauuuuuuaaagauuuauuuauuguuaaauguaaguacauuguagcugucuucagacgcaccagaagagggcuucagaucucauuacagaugguugugagccaccauaugguugcugggauuugaacucaggaccuuuggaagagcagucagugcucuuaaccgcugagccaucuccagccccuguaaaccuuuauuaacauggguuuuuuaauuuauuuuuaucauauauauagagauagacgcuuugccugcauauaugucuguguacuuccuuuguuuugucuuguuuuagacaguagauuuaaauugguuuuguugccuacacuggccuccagcuuucaguaaccugaagugcugggaguugcagagugggcugggcuagcucagacuagacuccaacugagaugaguuuuccacccuccucccugagccuccuggguucuagaacuucuggcacaugcuaacaugcuggcguuuuccaguucucucuuuuuagugcaaaagccaagugugauggcacaugugugccuuuaaucccaggcagagacugccaggucucugaguuugaggcgagcccguucugcauaguuaauucuaggucaaucagaguuauacagugagaccauguuucaauaaauaaauagcugaguguggugcugcauuccuuuagucuccauauguggacagcagaggcaggucuacaaggugaguuccagaucagcccuggacuauagugagacuguuucguggggggguggggcaguaauugaaagucuguauuugguuaggggaggcacauguccuaugucaugcauguggacgucagagaacagaauuuggggagucuguccucaucuuucaucuuguuucuggcccaucuccauguaguccaggcuaacugguuagccaguggguucccagacaauccuuccugucucugccucccaccuccaugugagaaugccaggguuucagauuugagccacugugcugggccuuguauagguuucuggaauugaacuaggguggcuguguugucaugguuuguacuaagcuaucuuucugcccuugacgucaucuauagucacucuugggacuuaauucccucaccccugaacagcaugcaucauuaugucagcaccccccucucugucccugguuucucuccagccagcugcccacccuaccauccugagauccugagcacaggucguaagugaccuacuuaaugaugaacaggaaguuggaaaccaagguuaaaggcuguucuugguccuguugcccaggguguacacagggacuguugugccucggcccaggagccugggugacgacagaguauaccucuuccccucucugaggaccacugcugguugccucuggccugcuucuagaggauagagguagagaguggccagcugcugccagccucugaccccuguccucugcaccacagguuuuauucccucugcaguuaugggacgaagaaaguccaaacggaagccgcccccaaaaaagaagaugacaggcacccuggagacccaguucaccugcccuuucugcaaccacgagaagucuugugaugugaaaaugugaguggguguucagggugggcauccaggcuccccacuugcuuccccugggccuuccuacugaaggggucaucuccagaggcucagggcucgcuucucaugcauaccuacaccuugucucacugcagggaccgugcucgaaacacuggagucaucuccuguacugugugccuagaggaauuccagacacccaucacauaccugucagaaccaguggauguguacagcgacuggauagaugccugcgaggcagccaaucaguagcaaagucagggaccugcuccuccacagcccccaucuggcuaccaauccagagacauuccagggcuaggacagcccgcccucugcagaugggauggaugugagugaguagauuucguggcugcagaugugacuguagggauggaggcgagcgacacugggucucaccaagcagcccaggguggccucauggaacccugagccucaggugacucuacaagccuuugaguugcucccaucuucagcccccacccugcccccacacuucaggcuccugucuucucuggugacgguuccugacauccaggcaaggaauagcugugggaccuccugucuccucagccaccucaccagcaccuugcccuugggaccuagacuuucuguccuucccagucuccuagugcuuguggucgaggcuacuggccacccagguccccuggcugggcucggcuggggaacaccauuuucuugguuugccuuuguagacaagguaggggcuaguugggguacagcugucauucauucaugagcccaucaauaaaacagccaguguguauccccgccgcugua

SEQ ID NO: 4969 - RNA, 20432 nt, Mus musculus
ugugcaaagaccuuuuauaaugggacugcuuaauugcuucugagauaacagcagacuucuaaaacuuagggcgcauuccaaggguuugcagacaucuucaacugaagguaauaaagaagauaugcaucacagggcccuaggugcaaaaacaggagauaagauauaggcuggguuugucuaaacacaacuuuaaggaccgcuuaguuacagucuuaaacuuuuucgugacccugcaagccaauaacaaagggugaaagugaagucagaccguugcuccuagugcauaggcacgcaggcauucucuguuacagccucuuagucaacuuaggacugaauuuaagugcugacucacaggagguuuauuaccgugugaacggcacgcucccagagucggucaaggccugagaacaaaaggcagagaagccaguccgcugccucaaccuagccucccgcugugucgcuuugaggugcugccccgaggcuucagaagccggccuuaagugacgcagucuggugggucagcugcagaacugcaggcgcagugcaccuuucacccagaauagagagcaaauggcccacggccuaguuucuaagugcagauaaaaugggauacgaaaaaugaacccuucaagucaaccugaugggaacuggaccaagaugugacuccucugaacgaaccugugcuuucaggaaggguuaucagaggggagcgggggugggguggggguggggggauacccuucucucaccuggauggguggugccucccugcugguggcccagauauggaaagcugcccgccugcccucccaccugccuggccucccucccgccugccucuccuucuuuugacugccuauugccgcugcugucacugccauauuuguccuucacuaacacuggaacccaacuuccuccaccuuccauaggccagcggcugccggcugcccaggaauucaccaccaggcugggacuucugaggcauucaguucccugcacugaagcagcuaccugguucucacccuccccggagugagacagccacuguugucauagcaagcccccaucaugugagccacccagucugguuuggguguuuuuauuguacuuuuuaagauuuauuuucuguaggugaguguuuggcugcauguauguauguauguauguauguguacuguguguaagcuugaugaugccuguggaggucagaagagggcaucagauccccuggaacuggaguuuccaccauaaacucagccuucuggaagagcagccaguguucuuaaucucugagccaucucuucagcuaugaaauccccuuacacacacacacacacacacacacacacacacacacacacacacacauacacacacacacacacacacacacuucacuucugcucccacagaguaccuuugugaagaaggaguuaagggagaccaguaaguaggcugcauauucagacuugauggaggauggagagaacagaauguucaaaaggcuucgccucauccugugcacucaugauugauagaugcuagaggcacagccagagaugccacauccugugcacucaugauagaugcuagaggcacagccagagaugacacagagagagaauggaaugcugucauucuuaccgcuauaaucacagccaggaggaccagaagacaagcauccuuagcgacacaaaguuccaggcuacccuggucuaugugaaacccuguuucaaaugcaaaaacaacaacaacaacaaaaacaaaaacacucaaagaaacaaagaaacaaaccucacaagcagaaaagguuaucaugagacagccaagcagguggagagaaaggaaaaagaagauaaauacacaagacacuggccaggcauugauaaugugcuacagaaaaagcuaaggcaagaugauaagccuggacacuuggguguggcucagugguagaucaagagccccuagguccacagcuagcacucgggugugggcggcggcggaggggagggagaaaaagagagaaagucaagggaguggcagggcaggaacucuggagcaccaggggaagaaggaagagccuucaaguaaguggaacauugaggacaaaggcccugaggucagaggucagcagcucccuagaagguaagucagagaagccagguugggaggacagugggaagagaacaggcaggaggaggaaggggcagauauagcagagaggagcucugaggcugacggugcaggguuggguggaguagauggggacccugcaugguugcucuuccuugcuccuggcacuagggagguggaggcaggaagaucaggaguucaaggccagccucugcuaucuagugaguuuaaaucaaauucaggucauuaaaguuaaaaacaaaaagacaauuaugaaaugguagcccguuuuucucugaaggcaaauuaaagcacagaaaagugacuagaccuugagcccgcuggggcacggugguacaugccugccagcuggggcacagugguacucgccugccagcuggggcacggugcuaacaugccuguugucucugcuccuuggaagggugaagcaggaggauggcuugaggccaggaguuucagggcaaccuggacuaaccacaaauccuaaucucaaaaaacuacaauaagcagagcacagcauggggagcacgccucuggucccagcacuugagagcgcaagccagccucuggauauuugaggccagccaggucuaccuagcgaguuccugugacacugccuaaaaacaaacaaacaaacaaacaaacgagcaggcuuugugacacugauccucagugcucugcaagcccaggaguucaaagucauccccaacuccccgggggaugaggccagccuggucccuaaaaugucuguagauuuuaccagcuuuccaccaguguccuccugguggccuggaauucccaccauacucaggcuccaccgcuggcucuuuggucuccucagacuccaaccuguuuguuuguuuguuuaugcagccucuggcucugaggcugaaguucaugguccucugacuucugccuucccagugcugggaucccaggcguggccaccuugcccggcugugucugcgcccauuugcuuaacuucaucagcguguguauggcauauguagguauguguguacaggacuuggaggcccgguccaucuguccuucccucaucuuugucaacaagcacuuuuacacacugagcccucucaccauaccuagcucaucagugccagcuaugcaguucagggagaggcacacaggaagugggggggggggaggugguuaggggauggggaaugagggguaggaggggugggggagcucacacauuagcucaaagcuacaugacaucauugagacaucagaugaagauuucccucuguguguguguguguguguguguguguguguguguguguguggugugcaccuacccucuucuacuucaggauuuaaaauuuuuaauauuuaugugcaugauauaugugugggcucacauggaugcuauggaaagacuguggaggucagccaggcacaguggccucuacucccagcacucuagacgcagaggcagacauagcucugugaguucaagggcagccugaucuaccuauccaauuccagaacagcuagagcuacacagcgagacacugucuuaaaaaaacaaaacagggggcuggagagauggcucagugguuaagagcauugacugcucuuccgaagguccugaguucgaaucucagcaaccacaugguggcucacaaccauccuuaacaagugucugaagacaguuacaguguacuuacauuaaauaaauaaauaaaucuuuaaaaacaaagcaaaacaaacaaacaaaccaaaacuguagcgaucagaagagaacuuugugcagauguuucucucccuccgcuuugacaugggcuccagggacaaucucaggcuccccugcaaaggucuucccaauccucucugcuuccauggcguugugugauuguguagugauugugaacaugugugugugugugugugugugugugcaugcaugcacgcaugugcgcacugugugugugugugugugugugcgugcaugcaugcacgcaugugcgcacugugugcgugugugugugugugugugugugugcgcgugcaugcacgcaugugcgcacugugugugugugugugcgcgugaguuuccuaaggcuugcuuacaggagcaugggaaucucaccacugaagaaacugccucuccauccuucgguaccuguuaacuaccggcaggucucuaggaguguguagauuuauuuauucuuuucacuugugcaggugccugugugagucuauaugcacacaagugcaggugccuucggaggccugcagaggcaucaguugaccuggagcugaaguuacaggcaguugugagccuccccgcauguguccugggaaccaaaccugguccucugcaagagcaguguacaguuaugagugcacugggcuaugugagagauaaccacuggagcaguguacaguuaugagugcacugggcaugugaaagauagcaaccccugggauuauguucuuuuucucaggaauucauuuuuuggggaaguguauuuuuuagacaggaucucacacuuuagcccaggcugacccaguccucccuauuuagcccaguugucucaaacucacuccaauccuccugccauuaacagacaugaucuaccacaccaggacucuuuaaaucuuuauuacauuuauuuacuuacuuauuauugguagggcaacaacccggauguggaggucagaggacaacuuuugggagccggugcucuccuuccggaaaccugauggaacucaggcucucaagucuugccagaaagugccgcucugagccaucucgaaggcccaucgccagacuuuauucuuugggauuccuuuguuguucuguuuagguuuuguuuugguuuuagagacaggguuucucuguguagcuguggauauccuggaacuugcuauauagaucaggccgccuuuuaacucagagaucugcuuccgccucucgagugaugggauuaaagaagugagucccauucuggcccagcuuuauuuuguggaauucuaaggacaaccuauuuauuuaugaaugagacagucucaggucuugaacuugcuauggagcugagauuuaucaugaacucuugacccucugaccuccacggcccaggguuacacugcgcaccugguguauaccggccugcgucugugaccuagggcuucguacguguuggcacgcacucuaccaacugagucacaccccagccucccugcaaaccggcaaaauuucuuguuugaaauaacaggaaagaccugcagugugcggaagaggauggcuuugcuccgccccucugggucccucucugccuaaauuccuucucucccgaucaaucuugaaggccuguuuuacagguggcuguuaucuggcacagauagcucagucaaauccccuccuccgcccccccgcgcgccccaaacccacugcugggauggaacccgagccgcucuggggccaagcaagcccuccaccgcugaccugccaccagccugguaucuucucacccauuuuaaagaccgggagaccgagccuggcucaguccggggcuggaccuccccugcgcggccaccagaggcugugagcaccccaaaagucgaaggcaggugguauugaaaucaggucccgggucucccuuaacuccugggacucugaaccuuggaggcgaggcgccagguaauggcugaggcaggauuggggcggggaaaccgaggcacccgcccucugcaacucuggacucuguagggcaggcagggagccgugggcgaaggcuggcccgcgccgccucuucccaacucgugcagcccggagcgacccgccgcgaauccgcagcucaguuggguagcacagcuuguccuggacccaccgccaaggugagacucgcccgccaggcccuugcucugccucccacgggggagggggucucugucuguuggggccaccccacuuccuuccuguucgccucuacugagaggugcgaguggggaaugcaaggcaaacucuucgcugggugaccuggggugagucgcugacccucucugagccuuuaugcaaagcacggaacgagagauuccagaauccgagcuugcagggaccggagggguugguggugaguguucaaggaaggagucuggaaagauugggcggcuugugaaguuaaggagggaggggaggaggugggaagcuggccacacccaccacagcgcugggcucugcggucgaaacagccugcagcugacugcuguaggugccaaggucaaaaggcuacagccagccacguggugugugccuucuggaaguuccuuaggcuggaaaccgggugugggaaaggccauggaagaguguggacagaacuuccuggaaaaggcaguuauugcugcuguuuaugauggcgagggggaacucggagacagucccacacuuagaugacuccagauacacaauuugcacuaggacuuacaaaacacagaggagacagggggcuguuacaugggcgccacagaggaauuauuuaggccuguaauuccaacacuuggaaguggcucaucuuuggcuacccagggaggaaguuagggauagccugggcuucuugagacacugucucaaaacaaaaacaaaaaaaaaaaaauaauuggaguguaugucacaggcaagccacugagguucccaugcuagagucgagacacccacccagaaaaagugacagcgaguuacagacagccaagggugugaaaacacagacguucagccuagaacagccucagugcagugaacagucaaacucgggaccuacagaugcccaguacacauuaccaucagacccuggcugacugugcuggcuucgagaaacuuuucacggcucagucuggccugggugcccccgccccagccccauuuccaguucuggggaaguccagugcucacaugacccaaggggagggcuucuggacaauccucggagaaaaugcaucaucuuucccaaugaugcacuucugccccagagaauaaagacucggugaucaccgcuuuugguccaggagcuuaacugccucuugcagccucucugaccaccugugcuuccuccaggguaagugucagaggagcgagguggaagaggccugugggggccaccuucccagcuccucagcuccuugcaggcccaauugcuacuggugugucuguggaacugacggcuguagauggcuagggugugugugugugugugugugugugugugugugugucuuaagaccggucuuaugucuuuaucucagacuuucuguuuccauuuuucaaacuucccaauguagcugaggcuggccuugaacuucugguccaguugcuccaccuccaugguagugccugaguuuauaggcaugcaccgugagaccaggcucagcgggcuagucuuucuuugcuuggaccagggucucgcucucuguccucaccagagacucugaacucccucucuuccucacagauggauucauggguggugcugcugggccuacaaaucauauggcucccacuccugacccacgguacagcccccacucccacccugagauuuguggcugugggcgacuggggagggguccccaaugccccauuccacacagcccgggaaauggccaaugccaaagagaucgccagaaccgugcagacgaugggcgcugacuucaucaugucucugggggacaauuucuacuucacuggagugcacgaugccagcgacaagagguuccagguaugugcucaacagcagggucagaggugacagcggugaggucacuucacacugggaccuuccucuggggagagcagaaggcagaaggaugccuuuggguaccucgggcuuccauugguucccuugcccuugauuucugauucgguggaagcugcagaguggcuguugacuccagaggagggaugcccuuacugucugccacaggagaccuuugaggacguguucucugaccgugcccuucgcaacauccccugguaugugcuggcuggaaaccaugaucaccuuggcaacgucucugcacagauugcauacucuaagaucuccaagcgcuggugagccuucccucuuucccugaagagacugucacucagagacaaagaguuccuuuggcuuuugguuugugugugucuguguguaugucucugugugugugugugucuguguguguguguguguuuuauuuauugggggcacagcccaugugugcaggccagaggacagauuaugggaucaguuuucuccuccuguguagcugcagggauggaguuuaggucaucaggcagcgggcgcuuuucucacuggaccauggcacugcccucagaaggucuggguuugguuuuguuaaaacaggguauuguguagcccaggcuggccuugaacuggcuauguagccaaggauaucuugaacugacccuccaacucccaaguggcaggauuucacacaaacaucccuacauucagcugcucauuuuugagaugggaucuuguuauguggucuuagcuggucucaaaaauuuaagauucucuugccucagccuccaaaguauugagguggcagauacaugccacagugccuagucaaagaagccuuuugaggcagagcagcucagucaggaaagcgcuugguaagcaaacacaaggaccugaggucaguccacagccugugugaaaagcagcguggcagcccaugccugagucagugcugggggcagcguggcagcacaugccugagucagugcugggggcgggaggcagggacagagcauccugagguucagccgccagccagccuagccaaauccucgagccccacagcucagugagaugccccaucucagaaagcaagauugagggauaagcgagccaagucgcucaguggauacaaaagcauuugccuuguaaaccuaaggacccaaguucaauccucggaacccaccaugaaaagaaaacccauuaccaaaaguuguccucugacccuuacccacgcauccuaauaauaaaaaauggaaacaaacaaacaaacaaacaaaaaagucgguggggugguaggggagacaggaggaugaaggggcuuuccgguuuccaggcuagucuggggaugggauacacggcagggucaacaagagacccugaacaguucaccuggucagugaacaugguagaaagugacagaggacacuaagcccccuguguggcuuccauggauguaugaguguguccaccacaccacacauagagaaauacaccagaaaacucaagaugagugggucuugaggaacaacagccauuguuccugaccggacccugauugcacaugugcaaugugaauauaugugaauacacacacacacacacacacacacacacacacacacacuauaaaaagagguccuuugccucuggcuuuaauuccuagcacccauaugguagcucacaacuaaaaagaaauguuuuuaagauuuuucuaaaaaaaaaauaaaaacgggagguccuuuggccagaaccaacuuuagugugucucugcuuaaaauguguugcccacgacuucuguucccuccacaggaacuuccccagcccuuacuaccguuugcgcuucaaaauuccacguacaaacauaacuguggccaucuuuaugcuggacacagugaugcuguguggcaacucagaugacuuugccagucagcagcccaaaaugccucgagaccugggaguggcccgcacucagcuguccuggcucaaaaagcaguuggcagcagccaaggaggacuacguuuugguggccggccacuaccccaucugguccaucgccgagcacggacccacgcgcugccuugucaagaacuugcgaccauuguuagccacauacggggucacugccuaccuguguggacaugaccacaaccugcaggugaggacucuguggauggggaaucgggcaaggaauucuuaacuauacugcaaggcgucacauggcugcccuuuuguucagaggggcucugcagaauacuggauuagaauuccccagugaggggcugggggcguggcucaguggcagagccccugccuagaaucccccagugagggccugagacuaggacucagaaauagagugcuugccuaccaagcaggaagccauguucaaucucaacaccaccaaaaccaaaagguucccuaaaugcuuaaaguaacucccagucaugccuuugaaguaggcuccacuucagcagaccagggaaacugaagcaaagagaggcuauccacucagcucuguagccagggcuagaccuauuccggaccaaccuuguauccuuugcccccaguaucuucaggacgagaacggugugggcuaugugcugaguggggccggcaacuucauggaucccucugugcgacaucaacgaaagguccccaacggcuacuugcgguuucacuauggaucugaggacucccugggcggcuucacacauguggagauaagccccaaagaaaugaccaucauauauguggaagccucuggaaaaucacucuuuaagaccagccucccaaggagacccagacccugaacaccacgagaguccugcuuguccgcuaacgggugugagggaggaggcgucugcaggcguggugggugggcccugugaggaccucacucacggcagcuucucugcccugguacucuggcagagagggaaggggaaccaaggggcuuacuuacaggaaagaaguaugcccacaccaacugaucccacagccaggcucaccccuuuuaggguagagcuuucuugggaacgggcuuuccuuucagucaagucuuacugucacugcuauucaauaaaacaaugcuuugucuccagaaugggugugucaucaagguuaaaaugccugucuguguaugcauauaggcagcugcagcccuguugggcuguggaaguuaaaagucaccuuguggugggggugugggggucugcucucuccuuccaccaugugggacccagggaucacacauaacagguuccacuugauggcaagugccauuaccugcuaagccaucucuccagcccucccuucagucucuuaguccaauacauagccaacuaacuuuuuuuuuuuuuucgagacaggguuucucuguauagcccuggcuguccuagaacucacuuuguagcccaggcuaacuucauuagcccuccuuccucagcugugagccugagaauccaggagcuguggaguccaggccuccugugugcuauacaaucaaucgcucugccauugagcuacauucuuaaccuuugguuugguuugguuugguuuuuuugaagccaggucucauguagcacaggcuggccuugaacugagauccuccugucucuguuccauacacccaccucccgccacugagauuauaagcaacuaccaucaugccuggcugcagaugugauuuucccaggcacacaggagagugaaacaggagggccagccuggcagcuuagcaagguccugcugaacaugaacagcuggcuugguguugcaugccuuuaauucuauccaugagaagauagagacaggcuuaucucugugagcucuggaccauggucugucuacacaugaagguuccggcccgcucaugcuacauggugagacccugucucaaaaaccgaaugaauguaucagucagucaguuaccauuagaaggaaggacauagugagccuuccaaguuccugucuguggccguccucguccccucucagucagagcccgccccuccacguccucacuucccuguucucuuugcuuguuugagacaaggacucauaaaguuugugugcucagacuugcuauauagcagaaaugaccuuggcuccccuacuucagucccugagggcuggaguuagagguuuuccacagcacacugguuucugugaugcugaggcaagaaccuggggccucacaaauguuaggccagcaccugaccaacaagggugcauuucuaaccuaauuuuuaauuuuuuuuauuauuguuaaauguuauuuuuaaugauguaggugugugugcgcacgcgugcgucugcucaucuauguguacuguguacuugaaguuuccgacaaaggccagaagagggcguuggguccccccagggcuggaaucgcaagcaguuuccagccaacaaguaguucacuaaguagccaagggugaguuugaauuccugacuguccucccuccaucucacgagggccagaacagcagauacaccaccacagaaggcuccaaguuauagggacuuuggagaauuaaacugagggcuuugagacucuaagcauacagcuuaccacagagcacuggguuccucucacacugaguguggaauccagacauuuugacaccuuuuugaaggccuuaccacuaagcuacaccccggggcacucuguuuucccugucuucuuuguuaucacauucuucacagguauggagccccgagaacacggcucuauucaaggucccucuacuucaccacagcucugcacagguuagucucacaacauuaacuuucaaccauuucaauauggagcugggaauauucauacauucaaagaucuaaaauuuauaggaaagugcagcagggcuuaguggugcaaacauauaaucccagcauacaggaagucgaaguucaaaggucagaaggucaagguuauccucugaaacauagaaguuugaggucagccugggcuacauggcacccugucuuagaauauacgugugaguugggagugauagcacaugacuuuaaucccaguacgaagaaggcagaggcagguggauuucugugaguuugagguaagcuuggucuauacagcaagcuccaggacagccaggacuacacagagagcuccugugucaaaaacaccaaaaagugaaaauaagaaaaaucuauggcuggggauauagcacauuuguuagguaugcacaaaguccuggguuccauugcagaacuagauaaaaccagcuggcuggaugggugcgcacaucugucguccuaaacaacaaccaagggaccagcuagguacaagugcugccugcuccugggcuagagaguuggcucagugguuaagagcauuggcuacucucacagaggacucagcacacacauggaagcucacaacugcuuguaacucuagaccuaggggaucaacacucucuucuggccuccacaggcaccuggcgugggcaugguacacagaaauacauacagaugggggcuggagagauggcucagugguuaagagcacugacugcucuuccagagguccugaguucaaaucccugcaacuacaugguggcucacaaccaucuguaauaggacccaaugcucucuucugguggaucugaagacagcuacaguguacucauauacauaaacuaaauaaaaucuuuuuaaaaauacauacaggcaaaauauccgugugcauaaaauaaacauauaaaaauuuguaaaaacugcuugucacacagccuggugaccugagucauggccacaagguggaaggaaagaacugaguccugcaaauguccugugaccuccacacucugugacacaugcacgcccccuccacacaaauaaauaugauaaaaaaauuaaggcaauguaaauauuaaaauaaaauagaaaauuaaaaaguguuuccuucuccaagucugccccuuuccugccuucuguccugacaggacaucccuuccuguucaucucauaaccauucucucuccuuccccucccucccucccuguccccauagaaagagggucucacugucugccaugcagccccagcugggccuccagcuccauccuccugccccagccucacaagcuuugacuacaacugugugucacucugcccaguuucuuuuguaccuuuucuuacaaaaaccaaagcaaaccagaacauguuuuuuuucuuacccacugaaccacaccuuguuuuuuaaaccuuccuuuuuuucaaagcccacuuuuuuuuuugacguguaauucacacacauaauucaaacucaucaaacguacaguuuuacaagagugagcacgcaugcuugcgugugucugugcaugcacgacuauacgcaugcaugccuguaugugcaagcauguguacaucaagacagagacuugagaacacuaaguacccacaguauccuaaccacgccccuagccagcuggccuaagcugcuuuuuuuuuuuuuuaagauaucuguauuugcaugugguucuuggucccugucacccuuuaauuuuuuguugccucccaagaccucagaucagaggccugugccagcuacacccaguauaugaggaacuggggaucaaacccaggacuucaugcaaguacuacaccaaccuuucugauaaguuuuggcaaagucauaaacccaccacaugugacauuguggggaaauacagaucagcaaagagagccuuagccuagaauccccuaaugaggggcuugggguguggcucaguggcagagcuccugccuugaaucucucaguaagggcuggggaugugguccacgcuaggucaccugccuagcaucugugaguuccuggguuccaccccuaaucccaaacacagacuuuucauuagacaaaaaaauuucuuucgcaauuuaaugguuguacguuauaggauuuacaucugagaucugccccagcagcagugggagagcuccggagaucuuuuuuuuuaguacagaggcagggaccugauccugaacuucuaacccuccaucuaucaaggaucucucgggcgacuugcaguagauguugcaaucugccugcagacagaacugcaauggcuguccuguguacucacauccuguguucagacuuacuucuggauaaacuggauuugcuccugggagaaccacugucauuguagcuucuguuugauggcauugggaaugaacuccagagccucacccagugugggcaagcgcucugcucauaaaugacccucccugcuccacauggagugaauacagagccugcugguggugcacaccuucaauaucagcacucaagacagaggcagguggaucucugugaguucaauccuagccuggucuacauagugcauuucagggcuauagugagacuauaucucaagaagaaagaaaaagaauaagagagggagacagagacagagguagaaagaaaagagaauaaacacaaaaagcuagcuggucugacaacuaccaggaguccaguucccuucuagggggggaauugaguaacauuuacccgcagacacauuugccuaaaccauuggugugaggaaagucacacaaaccacucucuugagagcuucagcugucacaccaggagugacagaauggggugcuggguugucuucugccuggcuaagucaaguggcaacugacagcacuucauccauguuuucauccacagagaggagcacggcagacgagcuaccaugugcuacccuggguuggcacuguugaaccucagacacaaguuacuguuaugguuaagaaaaagggaucauggggcuggggcaauggcucaggggguaaagaugauugcagccaagccugaggacccagauuccaugccuggaacaaacaugguggagagagaacuaacuuacaaaauuguauucugaccuucacuuauauacaacuuccuccuaucccuacuaauaaaauaaauauuuugaggguuuguuaguucauuuguuuguuuaaaaaagcaguuuuugcaguugucugccuccacagcuucaucugacuagacuuuuucuuaucuccugaaggcauccaaccccacacagcugcuggcagccuccuuuccugauccugccugccuuccugaaccuaagauaaaaggccuaucuuuccuucaccuuccuccuugccagcugcugaguccuuccuuccuuccuuccuuccuuccuuccuuccuuccuuccuuccuuccuuucuuucuuucuuucuuucuuucuuucuuucuuucuuucuuucuuucuuucuuucuuucuuucuuucuuucuuucuaagaucacuguagcugucuucagacaguccagaagagggagucagauuuuguuaaggaugguugugagccaccaugugguugcugggaccuuuggaagggcaguuggugcucuuaaccacuaagccauuucuccagcccugagaggcgcuuucuuacagcuugcuugcuccguuauuuuucucucagacucuauaaacuguuccuugagcugagaaggauggguggauggaugguuggauggcuagacagacagacagaaagacagacauacagauccuucuuuguucaagacaggcuuucucucuuucucuauauagccuggcuguccuggaaccagcucuguagaccagccuggccuccugagugcugggauuacaggcuucggcaccacugcccaagauggcagguuuuagugugauagcucauguguguaauucuaacacuugggaggcuuauguaggaagaucacuaugagucugaggacaaccugggcuacaaaaggaauucccgguuagccugggcugcagcggauccuugcaucaaugucacauuaaggagaaaguagaaagaaacuagucuugauuauuuugaccaggauaagcccaaauuugaauucuccauguuucucucugugccauauccguguguguagucuggguaccggcuggucgguagccugccugcugugugugucugaucugucccuguugucugugccugucugucugucuguugugucugucccaaacaagggucucuguucugcauuuauugaacagcacagaagccugggcaugggaaaggaagcggguucuguagggaaauggcuugcagaguuugcaaggggaauuacuuugccagcuucaguuaccuagacuggcaccaaacaccacagugaggugaccagucuguguccucaaguggcuuccaauacuuacaggauauuuguuuuguuuaagauugcuuucaacccacuggcugcuuucaguaaaugauuaccacacggcacacacauaucacauauacauacacacauaccacacauacaccacacacacacacacacuuacacccccccacacacacacacuuacaccccccuccacacacacacugaguuaauguaaaaaaagaaaaaaagaaguuaaagggcagaguggcaugucuguaaccagccuaggauauaugacacccuguccuuaaaaagaaaucacuucugacccugauccuugaggcaaagucuagacucauccuuguuucucauaggacauuacggaggcccacacaauucucagcaucauguuuguucugguuugcucucuacuguggugauaaaccgcucugaccaagaacaacauaagggggaaaggguuuauuaggcuuguacuuccagaucucaguccaucacugagggaagucagcacaggaacucaaggcaggaacugaggcagaagcuguuaaauggugcugcacauggguugcucuccauggcgcugucauccaccuaggaccaucugcccagggcuggcaccacccacaguaggcuggguccucucacaucgaucacgaagaaagugucccacaggcuugccuacuggauagucugauggaggcauuucucaauugagguucccuguccccagaugacccuaguugugugccaaguugaaaaaaacaaaaaaaccaaacccacauacccaacacagguugccaacuagcugugacuacagcucggcccuucucaacucucuuggaaauucacagccaccaagccucuucccacugauucagaggcuccuggcagucggagcucugaaucagcagucagcuucacccaaugucccuuuucccagagucuagaaaggagaagugacaaaguaaaugucacauguagaaugcaaaccaaguucccuauccagcuaagcaccaaaugcuacaaagauuucucagaggcacggcgagggacacuggaggcugugccaugcccgcagauggacuucuguccagcugaggugacaguagcuaccacuugcugguuuugagaucaauguuguuuguccccugcacuugaagugaaacccagggcccugugcaugcuaagcaaacacucgaccacgcaauccacagucccugggugcuuuuucuuagauacggucucaccauguaaaccagccuggccucagacucacagagcucugccugccucugcuuccuuggugcugugugcuaccacacccaguuuauuacuacugguguguguguguguguguguguaugugcacauauaucaugacacacacauggaagccagagaacuacuuggagggacugguuuuucuucuuccaccauggacucuggguauugaacucgagucaccuagcuugcagggcaaucaugguuaccuugugagcugucucuccaccccacgguuggcuuuuugaaacaagaauucaccguauagcuuggguuuuucuggagaccacugugaaguuaggcuggucucugguguaugcagauuucucguuucccaauccugaguguagaaauuaaagggucgauuuaccaugccuaucuuugauuuuuuuuuuaaguuuugggggcuggagcuaaguugcccaggcugaccuugaucuguuuagccucuugcuucagccuccacagaggcuggcaugacgacuuacaacaagccaggcuaagacaucggauuguuuauuuuaauucugugauuuuauuuauuuugauacgaggcaugauggcuggccaaguccuugugguuaggagucaaaagcacggcaugguugaacacaccuguaaucccagcucaggaggcugagauagaaggauuucauugucagaaugggcuauagagagaaacccugugauuggcugccccaagccccugcugccagucuuccacgucgccgcagaccaugcccuugaauugugagccagaagaaacucgucuucucucacgcugcaggcaagauauuucaucaagucggcaagcuacaggguaacaugcauagacuuaucccacgugcauuugugguuuuguuuuguuuuugugagccucccacuguugccaagguuagcuuugaauuauucacauuagcccaggcugguuaagaacuagcacagaucuuguuucugccuucugaguacugggauuuaaguccugaaccacuacacuccugugugaguagaugcugccaaccagaaauggucuucagaaaaggcaguuccaaggauggcacugcccccuauagggcauucucuuuaaagcaugcguaacaacgugugacacagcuaagcacuuuccguguguguguguguguguguguguguguguguguguguguguuaagaauugccuuuacccgcugagccaucuugcuggucagagccuuuaauuaagaaaagaaguauguacucagcagguauauuugugagggucugcaugugaaagccagacccucacaucucuccaucuuacauauugauguaacgcagugucucuugaacccagaacucaccucaucuggcuagucaccgugcccuggggauccugucuccugcaggcuuggauuacaggcggguaaccaagccuaccuggcuuuucuguagaugcuagggauucaagcuccugucuucaagcuuaccugacaagcgugcuggaggcccauauaaggacccuggaagaaggaaggcucacuuuucuucgccugcuugcauuuacuugccaguacgucuguuggaaccuauuucuauuucuuuaccagcuaaaccaacuggccucgugggacugagcgacgaacuacuagauucuuggacuucccauucacagcugaccaucguucggguaguuggacuacagacuguuaagucaucacaauaaauccccucaauauagagacauuccauaaguucugugacuguagagaacucugacuaguacaauguauuuugaccauuaaacccccuuacccguucuccugucucacaaucccgcugauccccucccucucccaacucgucucuucuagggcuaggauauuggagugagcauggaggguagggaaaaucuaggguuucaaggagguaagacaagugagacgaauccaggaagaugauuacaggugaggaccuuaaccaggaugaguacagguggagccaccgcuccucgcgaucacga

SEQ ID NO: 4970 - RNA, 9022 nt, Mus musculus
ggagaaaaagagagaaagucaagggaguggcagggcaggaacucuggagcaccaggggaagaaggaagagccuucaaguaaguggaacauugaggacaaaggcccugaggucagaggucagcagcucccuagaagguaagucagagaagccagguugggaggacagugggaagagaacaggcaggaggaggaaggggcagauauagcagagaggagcucugaggcugacggugcaggguuggguggaguagauggggacccugcaugguugcucuuccuugcuccuggcacuagggagguggaggcaggaagaucaggaguucaaggccagccucugcuaucuagugaguuuaaaucaaauucaggucauuaaaguuaaaaacaaaaagacaauuaugaaaugguagcccguuuuucucugaaggcaaauuaaagcacagaaaagugacuagaccuugagcccgcuggggcacggugguacaugccugccagcuggggcacagugguacucgccugccagcuggggcacggugcuaacaugccuguugucucugcuccuuggaagggugaagcaggaggauggcuugaggccaggaguuucagggcaaccuggacuaaccacaaauccuaaucucaaaaaacuacaauaagcagagcacagcauggggagcacgccucuggucccagcacuugagagcgcaagccagccucuggauauuugaggccagccaggucuaccuagcgaguuccugugacacugccuaaaaacaaacaaacaaacaaacaaacgagcaggcuuugugacacugauccucagugcucugcaagcccaggaguucaaagucauccccaacuccccgggggaugaggccagccuggucccuaaaaugucuguagauuuuaccagcuuuccaccaguguccuccugguggccuggaauucccaccauacucaggcuccaccgcuggcucuuuggucuccucagacuccaaccuguuuguuuguuuguuuaugcagccucuggcucugaggcugaaguucaugguccucugacuucugccuucccagugcugggaucccaggcguggccaccuugcccggcugugucugcgcccauuugcuuaacuucaucagcguguguauggcauauguagguauguguguacaggacuuggaggcccgguccaucuguccuucccucaucuuugucaacaagcacuuuuacacacugagcccucucaccauaccuagcucaucagugccagcuaugcaguucagggagaggcacacaggaagugggggggggggaggugguuaggggauggggaaugagggguaggaggggugggggagcucacacauuagcucaaagcuacaugacaucauugagacaucagaugaagauuucccucuguguguguguguguguguguguguguguguguguguguguggugugcaccuacccucuucuacuucaggauuuaaaauuuuuaauauuuaugugcaugauauaugugugggcucacauggaugcuauggaaagacuguggaggucagccaggcacaguggccucuacucccagcacucuagacgcagaggcagacauagcucugugaguucaagggcagccugaucuaccuauccaauuccagaacagcuagagcuacacagcgagacacugucuuaaaaaaacaaaacagggggcuggagagauggcucagugguuaagagcauugacugcucuuccgaagguccugaguucgaaucucagcaaccacaugguggcucacaaccauccuuaacaagugucugaagacaguuacaguguacuuacauuaaauaaauaaauaaaucuuuaaaaacaaagcaaaacaaacaaacaaaccaaaacuguagcgaucagaagagaacuuugugcagauguuucucucccuccgcuuugacaugggcuccagggacaaucucaggcuccccugcaaaggucuucccaauccucucugcuuccauggcguugugugauuguguagugauugugaacaugugugugugugugugugugugugugcaugcaugcacgcaugugcgcacugugugugugugugugugugugcgugcaugcaugcacgcaugugcgcacugugugcgugugugugugugugugugugugugcgcgugcaugcacgcaugugcgcacugugugugugugugugcgcgugaguuuccuaaggcuugcuuacaggagcaugggaaucucaccacugaagaaacugccucuccauccuucgguaccuguuaacuaccggcaggucucuaggaguguguagauuuauuuauucuuuucacuugugcaggugccugugugagucuauaugcacacaagugcaggugccuucggaggccugcagaggcaucaguugaccuggagcugaaguuacaggcaguugugagccuccccgcauguguccugggaaccaaaccugguccucugcaagagcaguguacaguuaugagugcacugggcuaugugagagauaaccacuggagcaguguacaguuaugagugcacugggcaugugaaagauagcaaccccugggauuauguucuuuuucucaggaauucauuuuuuggggaaguguauuuuuuagacaggaucucacacuuuagcccaggcugacccaguccucccuauuuagcccaguugucucaaacucacuccaauccuccugccauuaacagacaugaucuaccacaccaggacucuuuaaaucuuuauuacauuuauuuacuuacuuauuauugguagggcaacaacccggauguggaggucagaggacaacuuuugggagccggugcucuccuuccggaaaccugauggaacucaggcucucaagucuugccagaaagugccgcucugagccaucucgaaggcccaucgccagacuuuauucuuugggauuccuuuguuguucuguuuagguuuuguuuugguuuuagagacaggguuucucuguguagcuguggauauccuggaacuugcuauauagaucaggccgccuuuuaacucagagaucugcuuccgccucucgagugaugggauuaaagaagugagucccauucuggcccagcuuuauuuuguggaauucuaaggacaaccuauuuauuuaugaaugagacagucucaggucuugaacuugcuauggagcugagauuuaucaugaacucuugacccucugaccuccacggcccaggguuacacugcgcaccugguguauaccggccugcgucugugaccuagggcuucguacguguuggcacgcacucuaccaacugagucacaccccagccucccugcaaaccggcaaaauuucuuguuugaaauaacaggaaagaccugcagugugcggaagaggauggcuuugcuccgccccucugggucccucucugccuaaauuccuucucucccgaucaaucuugaaggccuguuuuacagguggcuguuaucuggcacagauagcucagucaaauccccuccuccgcccccccgcgcgccccaaacccacugcugggauggaacccgagccgcucuggggccaagcaagcccuccaccgcugaccugccaccagccugguaucuucucacccauuuuaaagaccgggagaccgagccuggcucaguccggggcuggaccuccccugcgcggccaccagaggcugugagcaccccaaaagucgaaggcaggugguauugaaaucaggucccgggucucccuuaacuccugggacucugaaccuuggaggcgaggcgccagguaauggcugaggcaggauuggggcggggaaaccgaggcacccgcccucugcaacucuggacucuguagggcaggcagggagccgugggcgaaggcuggcccgcgccgccucuucccaacucgugcagcccggagcgacccgccgcgaauccgcagcucaguuggguagcacagcuuguccuggacccaccgccaaggugagacucgcccgccaggcccuugcucugccucccacgggggagggggucucugucuguuggggccaccccacuuccuuccuguucgccucuacugagaggugcgaguggggaaugcaaggcaaacucuucgcugggugaccuggggugagucgcugacccucucugagccuuuaugcaaagcacggaacgagagauuccagaauccgagcuugcagggaccggagggguugguggugaguguucaaggaaggagucuggaaagauugggcggcuugugaaguuaaggagggaggggaggaggugggaagcuggccacacccaccacagcgcugggcucugcggucgaaacagccugcagcugacugcuguaggugccaaggucaaaaggcuacagccagccacguggugugugccuucuggaaguuccuuaggcuggaaaccgggugugggaaaggccauggaagaguguggacagaacuuccuggaaaaggcaguuauugcugcuguuuaugauggcgagggggaacucggagacagucccacacuuagaugacuccagauacacaauuugcacuaggacuuacaaaacacagaggagacagggggcuguuacaugggcgccacagaggaauuauuuaggccuguaauuccaacacuuggaaguggcucaucuuuggcuacccagggaggaaguuagggauagccugggcuucuugagacacugucucaaaacaaaaacaaaaaaaaaaaaauaauuggaguguaugucacaggcaagccacugagguucccaugcuagagucgagacacccacccagaaaaagugacagcgaguuacagacagccaagggugugaaaacacagacguucagccuagaacagccucagugcagugaacagucaaacucgggaccuacagaugcccaguacacauuaccaucagacccuggcugacugugcuggcuucgagaaacuuuucacggcucagucuggccugggugcccccgccccagccccauuuccaguucuggggaaguccagugcucacaugacccaaggggagggcuucuggacaauccucggagaaaaugcaucaucuuucccaaugaugcacuucugccccagagaauaaagacucggugaucaccgcuuuugguccaggagcuuaacugccucuugcagccucucugaccaccugugcuuccuccaggguaagugucagaggagcgagguggaagaggccugugggggccaccuucccagcuccucagcuccuugcaggcccaauugcuacuggugugucuguggaacugacggcuguagauggcuagggugugugugugugugugugugugugugugugugugucuuaagaccggucuuaugucuuuaucucagacuuucuguuuccauuuuucaaacuucccaauguagcugaggcuggccuugaacuucugguccaguugcuccaccuccaugguagugccugaguuuauaggcaugcaccgugagaccaggcucagcgggcuagucuuucuuugcuuggaccagggucucgcucucuguccucaccagagacucugaacucccucucuuccucacagauggauucauggguggugcugcugggccuacaaaucauauggcucccacuccugacccacgguacagcccccacucccacccugagauuuguggcugugggcgacuggggagggguccccaaugccccauuccacacagcccgggaaauggccaaugccaaagagaucgccagaaccgugcagacgaugggcgcugacuucaucaugucucugggggacaauuucuacuucacuggagugcacgaugccagcgacaagagguuccagguaugugcucaacagcagggucagaggugacagcggugaggucacuucacacugggaccuuccucuggggagagcagaaggcagaaggaugccuuuggguaccucgggcuuccauugguucccuugcccuugauuucugauucgguggaagcugcagaguggcuguugacuccagaggagggaugcccuuacugucugccacaggagaccuuugaggacguguucucugaccgugcccuucgcaacauccccugguaugugcuggcuggaaaccaugaucaccuuggcaacgucucugcacagauugcauacucuaagaucuccaagcgcuggugagccuucccucuuucccugaagagacugucacucagagacaaagaguuccuuuggcuuuugguuugugugugucuguguguaugucucugugugugugugugucuguguguguguguguguuuuauuuauugggggcacagcccaugugugcaggccagaggacagauuaugggaucaguuuucuccuccuguguagcugcagggauggaguuuaggucaucaggcagcgggcgcuuuucucacuggaccauggcacugcccucagaaggucuggguuugguuuuguuaaaacaggguauuguguagcccaggcuggccuugaacuggcuauguagccaaggauaucuugaacugacccuccaacucccaaguggcaggauuucacacaaacaucccuacauucagcugcucauuuuugagaugggaucuuguuauguggucuuagcuggucucaaaaauuuaagauucucuugccucagccuccaaaguauugagguggcagauacaugccacagugccuagucaaagaagccuuuugaggcagagcagcucagucaggaaagcgcuugguaagcaaacacaaggaccugaggucaguccacagccugugugaaaagcagcguggcagcccaugccugagucagugcugggggcagcguggcagcacaugccugagucagugcugggggcgggaggcagggacagagcauccugagguucagccgccagccagccuagccaaauccucgagccccacagcucagugagaugccccaucucagaaagcaagauugagggauaagcgagccaagucgcucaguggauacaaaagcauuugccuuguaaaccuaaggacccaaguucaauccucggaacccaccaugaaaagaaaacccauuaccaaaaguuguccucugacccuuacccacgcauccuaauaauaaaaaauggaaacaaacaaacaaacaaacaaaaaagucgguggggugguaggggagacaggaggaugaaggggcuuuccgguuuccaggcuagucuggggaugggauacacggcagggucaacaagagacccugaacaguucaccuggucagugaacaugguagaaagugacagaggacacuaagcccccuguguggcuuccauggauguaugaguguguccaccacaccacacauagagaaauacaccagaaaacucaagaugagugggucuugaggaacaacagccauuguuccugaccggacccugauugcacaugugcaaugugaauauaugugaauacacacacacacacacacacacacacacacacacacacuauaaaaagagguccuuugccucuggcuuuaauuccuagcacccauaugguagcucacaacuaaaaagaaauguuuuuaagauuuuucuaaaaaaaaaauaaaaacgggagguccuuuggccagaaccaacuuuagugugucucugcuuaaaauguguugcccacgacuucuguucccuccacaggaacuuccccagcccuuacuaccguuugcgcuucaaaauuccacguacaaacauaacuguggccaucuuuaugcuggacacagugaugcuguguggcaacucagaugacuuugccagucagcagcccaaaaugccucgagaccugggaguggcccgcacucagcuguccuggcucaaaaagcaguuggcagcagccaaggaggacuacguuuugguggccggccacuaccccaucugguccaucgccgagcacggacccacgcgcugccuugucaagaacuugcgaccauuguuagccacauacggggucacugccuaccuguguggacaugaccacaaccugcaggugaggacucuguggauggggaaucgggcaaggaauucuuaacuauacugcaaggcgucacauggcugcccuuuuguucagaggggcucugcagaauacuggauuagaauuccccagugaggggcugggggcguggcucaguggcagagccccugccuagaaucccccagugagggccugagacuaggacucagaaauagagugcuugccuaccaagcaggaagccauguucaaucucaacaccaccaaaaccaaaagguucccuaaaugcuuaaaguaacucccagucaugccuuugaaguaggcuccacuucagcagaccagggaaacugaagcaaagagaggcuauccacucagcucuguagccagggcuagaccuauuccggaccaaccuuguauccuuugcccccaguaucuucaggacgagaacggugugggcuaugugcugaguggggccggcaacuucauggaucccucugugcgacaucaacgaaagguccccaacggcuacuugcgguuucacuauggaucugaggacucccugggcggcuucacacauguggagauaagccccaaagaaaugaccaucauauauguggaagccucuggaaaaucacucuuuaagaccagccucccaaggagacccagacccugaacaccacgagaguccugcuuguccgcuaacgggugugagggaggaggcgucugcaggcguggugggugggcccugugaggaccucacucacggcagcuucucugcccugguacucuggcagagagggaaggggaaccaaggggcuuacuuacaggaaagaaguaugcccacaccaacugaucccacagccaggcucaccccuuuuaggguagagcuuucuugggaacgggcuuuccuuucagucaagucuuacugucacugcuauucaauaaaacaaugcuuugucuccagaau

SEQ ID NO: 4971 - RNA, 727 nt, Mus musculus
agcuuuccuuuccucuggcggcagccaucaggugagccaagaugggugcauacaaguacauccaggagcuauggaggaagaagcaguccgacgugaugcgcuuucuucugaggguccgcuguuggcaauaccgccagcucucugcgcugcacagggcuccccgccccacccggccugauaaagcucgaagacugggauacaaggcuaagcaaggcuaugucauuuacaggauucguguccgccgugguggucguaaacgcccaguuccuaagggugcaacuuacggcaagccuguccaccaugguguuaaccagcugaaauuugcccgaagccuucagucuguugcugaggagagagcugggcgccauuguggggcuuugagaguccugaauuccuacuggguuggugaagauuccacauauaaauuuuuugagguuauccucauugauccguuccauaaagcuaucagaagaaauccugacacccaguggaucaccaaaccaguccacaaacacagagaaaugcgugggcugacaucugcuggccgaaagagccguggccuuggaaagggccacaaguuccaccacacuauuggugguucccgccgugcagccuggagaaggcgcaauacucuccagcuccaccguuaccgcuaauacacgugauauuuguaaaauucauauccaauaaacaauuuaggacagucaaaaaaaaaaaaaaaagugac

SEQ ID NO: 4972 - RNA, 12494 nt, Mus musculus
ucugacuaccuccugccccacugucccacauguucuccguguuggauccuguccagguguuccgcgcucgcccagaaguccggagagguucugccugccgccgcgugucacauuuccccacugagaaccacagugagagcucugggugucccggaauccugagauggugagucuguggcagguccagaagccgagccccuuuguccccgggcugcgggguuggggcugagcgggcuccaggaauccugucccgucccuggucccugcagggacccgagcccugcugcagcgcuugccgcagcucuggcccggagccugggacuugcgggccugcacgggaaacgguaaccuggacccagucgaucggcucucuguugucucugccccuuggccacacaucucuguccccaugguccccgcaguucaauuccugagacgcuguaucuggaguuugggguguuaagucuggugccuagacgauccugucccugggaccucgggcucuauuccguuucccaggauccuggaaccccaucuaucuguggcaugaacucggaacccaccccuaggaagcacuuccauuuucugugucggcguugggauugaacugugucaccgugaacauggaugugaagccuuuuacucuuuuggcagcugggucucauuguguugcccugguuagccuagaacucauuauguagacugugcuagccuuaaacucauagaaaucucccagcuucugccacuccagggcugggauuaaaggagugcuguuuuacuuucguugagacagguucuuauguagcugggaaugaccuugguccucugucugaucuucauccuugaggccauuuucuaacuuucagauuucuguuccuuuagauacaucgcggcgguagugauugcuggguccuuugguaguucuauguuuacggcuuuaaggaacuggacuauaaauuuauaaaauguuugcacuaauuuucauacuaagaacagaguacuuuuuuuuuuuuuuuuuuuuuuuuuuuuugagucaggauuucucuguguagcccuggcuguccuggaacucacuuuguagaccaggcuggccucgaacucagaaauccgccugucucugccucccgagugcugggauugaaggcgagcgccagcacgcccggcucacacacaauuuuuauaguuuuguuuagaguuuaggaguccugcuaucugauacauucaauaucuggcgugacucuguuagacuucaagcugucaacagccauugaagagagcacccaaguggugucugugaauaguuccauuuuuccagcccuucccacauacgggugaagauuuuaggucauggaggugguuacaggcucucuucuucuuuugagaucugggaagauguccucguuuccagagcucugggcuuuuccauauucaauaaccgcuuuuaauacugaaguccguuggugcaugggccauccccuuccaggaaaugaaagauaucaguagaccuggagacuuuaauuagggaagccaggguauaacuguccguguugaaauccuuuggaacacucuggccauauuuucugacaucuuuacauuaacagaccucgaugcugaguuuucuuucucccaugagacaaaucaaacgucaccuuccauggaacccugcuauggaacacauacagaguagaauggaccccacuuucuguuccaaaagcugaccgcuuggguucaagagaaacaugucauuccaggggcugauaucauuugaagacguagccguggacuucaccugggaggaauggcaagaccuggacgcugcucagaggacccuguacagggacgugaugcuggagaccuacaucagccuggugucccuaggugagucugacuccuggagcucucaauagcaguuacucgcucuuuuaguugguaagggggaaaucauugugaacuuaauacuaauccugucguauacauuuuaguagacacacuguaauaacaugcaugcuuuugagaaacccugugguuuugcaguguacuuacaucauuuaugauuaucagaugaaguuaagaaauaaguuuaccagcucaggcauuauuccuuccuauugugaacauuuaaaaaucuucugauaauguuuugaaggauuuaauggcuuucaaucauauauguauguauugcuguucuguagaauauaaauuacucauuccauccauguguaucccaguaaauaccagucaugguucccccaucccaucccccucauguguuuuuccggacuccagaguaaacaugguucucaucucuacuucucugcuguauucuuuaucuuggaguuuggauaauauacaggccugugugugaacgcacauuucgcuuaugucuuugauuuuucugggaaaauagagaguaaacauccccuugcuacaaauguggagucccuuccccuacuguucaguggccuuauauguuauggaaaugaaugucuuguuaauuauucugugaguugauuucuuuauaauugcuugcuuuucuggaugcgugauuuugagguugaugucuuccacaugcccuguucuuucacauguauuaaugaaaacacugucuacaucauugccucaaaauguugucuguauauucuagaccuucacaguuuucaagucucacaucuaacuuuuuaguagacuucuugaaugguggcaaugaggcguccauugccccaguuucuuaucauagcuuacaucugagaacuuccuucugacugaguucaugagauugguugaaaaucaggcgguggguccauagcacugacaaaacuguggagaugaauauuuuuaaaaggagcgaaggucugccuuugcuuguggcuuuguuuucaguucauuuguuuuagggucacagaggcaucuuuauuuaaacaucugaacaaucuauuuaauguuuuaaugaggggaacaaagaccuucaugggugcuguuccuguggggcaucagcacagccauggcugucuucucagcugccagcuugguccuuuuuuuuuuuuuuuuugcuucucuggucuggcaacccugaucgcaugcuaucaccgagcucucuuaaccugcaguuucugauuccucuuggcugugauaucagcaagagaccagccaguccgacccuuacaaaucccucccuucuccuuagaaaagaggaagccucucuuuggguacaccccacccugggacauccagucuccguaggccuaagcauauccucucucacugaggcacaaccaggcaguccaguuaugagaaaggaauccaaugauggcaguaaugaagucagaaacaggcucccuuccaauuguuaggggucccacauaacgcugcacaucugcuacagauguggggggccuagauccagccucugcaugcucuugguuguuggugauucaaucucuaugagcccccauaaagccagguuaguugacucuguaggucuuauguccuugaccccucuggcucagucaauucuaucccccauucuuccacaagacuucccaggcaccaccugauguguggcugugggucucugcaucuguuuccauaagcagcuggaugaagccucucaggagacagucaugcuaggcuccugucuccaagcacagcaaaguaucauuuguagugucagggacugacuaucuuacaugggauguaugucaaguugggucagucauugacuggccauuccauccaucuuuaucccugcacaucuaguaggcaggacuaauuuugggucucagauuuguugguggguuguuguuucccuuccuccacuggaagucccaccuggcuacaggagguggccacuucagucccuauauccacugcugguaggagucucagcuagggucacucacccccauagacucccaggaaccuccuccuucccaggucaccagcuauucccaaagaugcccuugccaucgacugccguccucacucccggcccacucccacauccccauccccuccucaugcucgcucccacccaguuccucccucuagccaguacagaugacuguuuuguuuccccucugagugagauucacgcauccuccccugggaccuccuucuuacccaguuucuuugggucucuggauuguagcaugguuguccugcacuucacggcuuauguccacuuuuaagugaguacaugccauacgugucuuucugaauuugaguuaccucacuauuucucaccuucuaguucuauccauuugccugcaaaauucaugaugucuuuguuuuuucauagcugcauaguauuccauuguguagauguaccacauuuucuuuauccauucuuuaaucgaggguuaucuggguuguuuccaguuucuggcuauuacaaauaaagagugcuuaugagcauaguugagcaaguguucuugugguaugauggggcaucuuuuggguauauguccaggagugguuuagugguauaugcccagucuugggguagaacuauucccaguuuucugagaaacugacaaauugauuuccacaguggcuguagcaguuugcacucucaccagcaguggaggagguuccccuugcuccacauccuugcuagcaugugcugucacuugaaauuuuaucuuagauauucugauaaguauaaggaggaaucucagagucauuuugauuuacauuccccugaugacuaaaacauuaaacaugucuccaagugcuucuuggccacuagagaauccuauugaaaauucuagguaccccacuuuuuaauugauuuuggguuuuggugcuuaauuucuuguguucuuuauauuuuuuggauauuagucgucugucagauauagaguugguaaagaucuuugcccguucuguagacagcuauuuguccuacugauggugucuuguauguuguauuucuuuagguugguaaaguuuucuucuaugauuuuguuggaaauauuuucuuauucuuggagcuggaacucuucaccuucuauuccuauucuuagguuaguucuuuucaugguaucccagauuuccuggauguuuuaugucgaauuuuuuagauuuaacgcuuucuuugacugaugcaucaauuacuucuauuauaucuucuauccuugagauucuuucuuccauaucuuauauucucuuggugauguuugcaucucuugauucuguucucuucccugggguuugcaccucccagauucccucaguuuguguuuucuuuauugcuucuauuuacauuuucaggucuugaacaguuuuauuuauuuccuuuaccuuuuugauuguauuuuccuguauuucuuuaagggauuuauucauuuccucuuuaaaggacucuauaagauugaauuuaaggucauuuucuuaugcuuugauuguguuaggauauccagggcuugcuauauuaggguagcugugcucugaaguugucauauuguccuggcuuuuguugguucuguucuugcacuggucuuuagccaucugacugccccuggauguuccuauauguuuccaguucugcaggucugaugaagacuggcagagaggugguggaacuguggagcuccaggggaacagcaggccaaucagggcagcuaggcauaccccagaggaccuggagggcagggcaaucagggcagcugggcaugcuccagaggaccuggagggcagggcaaucagggcaccugggcaugccccagaggacccggagggcaggggagugggugcaugggcggaaucucuaccucuguuuucuuaagaaaccaccauguuauguucuuuaucaugcaguuuaaugacccugaagauaguauuccagucaaaaaagacagaguaaacgccaccaaagguuucuaauccugaucacagcagcgauuaugaauuggagcuguaugguuuuuuuauagacuggacucagcacucuggugucaugucuuucauacuuacagggcacuguaugaacaaaccugaguuaaucuucaaguuggagcaaggacucgggccauggagugucgcagaagccucagacaggaaccucucaggucagugaggacauguugggcaaggaaggucagcaagaagaaaguccauccaccauuggucauguugaucuuuuucuaccgacuuuuaucuaaaccuacuccugaugaacaaguuccacuccuagaauagacauugacaugaaugaagagaguguucauuauuagcuuaguaaaucagaaagccucuuaagauggaaggagacauuccugauuuucaauagcagcccuuaauguaaaucauuucaacuugccaaucaagucauacacaaaaguggugguuugaauaugcuuggcccaugguaaguggcacuguuaaaagauguggccuuauuggaggagguguagccuuauuagcggaagugugucacugucaggaguagguuuugggaucuccuccuauguucaagaucugcccaguacagagccugggugcauauggaucaagauguagaauucuuggcuucuccaguaccaugucugccuggauucugccaugcuucccaccaugaugauaauggacugagccucugaaacuguaagccagccccaauuaaaugguuuccuuuauaagaguugccaugaucauggugucucuucacagcaauggaaaucuaagacaauaagcaaaagccauuuuguggugguacaugccuuuaaucccagcacuugggaggcagaggcagguagauuucugaguuugaggccagucuggucuacagaguuccagggcagccaggacugcacagagaaaccacccugucuugaaaaaccaacaggcuggugagauggcucagcuguuaagagcaccgacugcucuuccagagguccugaguucaauucccuacaacaacaugguggaucacaacuaucuguaaugggaucugaugcccucuucucugcugugucugaagacagcaacaguguacucacauacauaaauuaauaaauaaaaucuuuaauuuaaaagaaaaaccaaaaaaaaaaaaaaaggacaaccaaacuaaauucuuagaaacaucugauuuuguuuacuuuuagaagaaaucucacuaaugaaaacagaccuuacagauagaaagugauguuugaagcaaacugugaaagagauuaauauuaggguuuuuuuauaauaguugaagcauaugaaaaacugaaguaaguuuguuuauuaugaaacuuuaugggcuauuucaugauaaagagaucucaaauauaaauauaugugcccugaacauuuguuaaccaauguuuuuaaaaauaacaugccucaaagugccaucuuaugauaguuaaugucaguaucccacuccugaaaagauagacuacccagacaaauccaaacuuaacaagauugaaacucuguuucaugcucaaaguagagcauuuccuuuaaagugagcaaugauacaguguucauucuuucucuuccuucucauuaauauaaagucuacagugagaggcgguaaaagccuuugaucucagcacucucgguuugaggcuagccucuucuuuauagcgaguuucaggccagaagcucacagaccagcuagcauugcggaugcaugcaguacagaggaaauaaggggaacccgcgcaacagugucuuaaguaauuucuuauuaguuucuauugccugaagagacaccaugaacacagcaacucuuacaaaggaaaacauuuaguuggugcuggcuaacaguucagaggcuuaguccauuaucauggcaggaaguguggcagcaugcagguagaugguagcaugcagguaggcauggugcugaagagguagguagcugagaacacagauguaggaaucuuuccucaacauauauuccagcuuaggagcaagaacauucucuauauaucuuaaaaguaacuuuucacaugugaauaagggguguuauagaugacauuguauguauaguuaauauccuagagaaauggagaagccaggaaacagcagaugaaaaucacuguugaguccuacagacgaaggugagcagcuuagcuuacccugcacuuuaccagaaggcacggcagcacgaccaugacccagugugucgugugauagucucacucguuauacaaauccaugaaguuccagaauauucacacuuauuauuuuacaacuuccaugaggaaaaagaagcccaauucauuuuagaaucgcauuaaaaagacuggugugauuuguaaauaaggacauuuuuauucuaauuuuagauuuucacauauugacugcaccaauugugaccagccagaaaaaucacaaggcauauauguggcaagcuagaaccaccgaaaauaaggcaucaaaugaaaagauuguaaguaaaacauuaaauuugggcacuugacuuaauucaaaccugaccauaaagaggggacccugucaucugcaagaaugguaugggugucuggcaagaggcucagugggaagagugcuccuuguaagcacaacgaccuaagcgggaucucaaggacccaugcagaaagcugaguguggccacaggcagccgauagcccagugcucagaagaauggggaggaaggaugucugggacuucaggacaucuaaacuauccaagugagggacccuuucuuaaaacuuaugguggagagugauugagaaaggcacgugauaucagccaaugguuuccacaugcaaacacacacacaugcgcaugcaaacuugcacaccaccagacacacaugcacaagcauggauaugcucauaugccccccucacuuacacucaacccaggcaacagugugcuguuucuugauauuuagucucauaaauugcagaguagagaauaacucaaaaaaauauuaauuuauuuauucacuucacauccugauggcagcccccucccuccucuccucucagucccucccauacccuuucccuacuccucuccccuuuucagagcaauuggcaaaucucucuugcauccugcauaucuucuuuuccauaacaacaaagcuucaguauauuugaccagggcuaucauucuucacugacucaauaugucugacacauaguaaagucuccuuuuaaagauguuauaguaaauucaauaauaaggugaugcuuacauauguagcccaagacugggaucaugggacguuaucuaaccacuauuaaucuauucaggauucuuuuuuauaaaaguugauucaguagacaaaaguguguauguaugagaaaugugugacuguggaaaaucauagcucacagaaccucaagaacauauucuaggaaaaaggccucuccucacauauaagaaauauaacaaauucuuuuauuucaaggcagagcuaaaggagcaacagaagauccaucaagggucaaaauccugcgaaagagaagcacaugggaagacauuuuuucagaaagcccagagcacugugauucaaaugucuccuacacgucagacagcucuccauuacacggcaacucucacuaaaggucagagaccucacagagggaagaugagccgugaguaugaagaaugcaggaaaaccaucuuccauaacucacacguuccaggaugucagaaaacucuuauagauacaaagcuuuguggauguacagagugcagaaaagauuucucuugcaacucaaaacucacaagucauccaagaacucgcauacguaagaggcccuauaaauguaaggaaugugggaaagccuucugcucucagggaaaacuuacucuacaucaaauaguucacacaggugagaagcccuaugaauguacagaaugugggaaagccuuuucccacaaggcauaccucacucagcaucagaaaauucacaugagcaagaagccuuaugcauguacugaaugugggaaagcuuucuaccgauuaucacaccuuacucugcaccagagaacucacacaaaugagaaaccuuaugacuguacagaaugccaaaaaucuuucuccugccggucacagcuuacucuacaucagcgaacucacacaggugagagaccuuuugagugcauggaauguggaaaaucuuucuacuacaaggcacaccuaauuagacaucagagaauucacaccaacgagaagcccuuugaauguauagagugugagaaauccuuuuacugccagucggaccucacugugcaucaacgaucccacacaggugagaagcccuaugaauguaaggagugugggaaaucauucuaccagaaaucaaaacucacucuacaucaaagaaaucauguaggugagaagucuuaugcaugcacagacuguggggaaguuuucuauugcaaaucacaucucacucuacaucagacuguccauacagaugaacacccauauauauguacagagugugggaaauguuucuacuauaagucacaacucauuguccauggaagaacucacacaggugauagacccuacaaaugcggagacugugggaaagcuuucucccgaaagucacaccucauucgacaucaaaguauuacucacauagauaagaacaauuugaauguagcaaaugugggaaagguuuccacuguaagaccagacucacuucacacucacucacuuuaccucagugaacacaagcaugcgccaagcauuuugaaggaaaagaaugcaggauagcuuuguacuucaagccacaaauaacagcagaggacaacucagaggaagagcccugugaaugggaagaaagagaaaacuuuauauuguaaggcugugagaaagaacucugaaaauaugaguucaagauacauaguuucccaacuaugcaaaauacaaagaugcaaaaugaauuauaugagaggcuucacaaaccuaaaagaacagcagcugcgcuaugacccagguugaaaaagauacaaaggcaggaagacuccugaguucaaggucagccuggaacagagcaaggauaggcccagguguggugggaauuguaaucucaggacuggaucccacccaacuaaaguuauugucuguguuuaacaaagacagaucucugaauucauuugcaaugaagaaagaaaggaaagaaacaaagaaagaaagaagauaaagguguuugcugucucuuucuaagaaucaaggggcuggagucaggggaugcugauucaugggauaaucaaaagugaaccugggguaaaugauugaacugauauguaaauaaaagauaggucgaagagaugaguuauccagcauuuucaaaauuguauucaagcaagagagagagcugucuugagcagaacacagguuggcugucggcuuguacccaugauugacuuugaguuuuuuuuaccgcucucaaacaccccuucucucaggaaccccucuccaagcugaggcugguccuuggcacagaaaaccugaauugaauucccaggucuucugcuaccaggaacucuagcuccagguaauucaacauccuugaaucucccucugcagcugaagaagguugcugaggcuaggcaugucccugucccugcauggaaguccagagaggcuauuguaugaaauugugaaggggaggccuagagacuccaagagguuagauaugccagaccugugggauaccugcccaggaaagcugcuaccagggagugcaaccagcccaagagaaagaaguuuguugcagucaacaaagcugaaaggagcuggagagcugaagaacacuuugauaucaaacauggagaugcagaguugggaguuugccagcugguuuucaguccugcuuugguccagucuuuucucacuaggcucucuucccuauguuuuagaauggugauguguauccugugccgugauacauugaaaguaugugcucugcuuuuuauuuauuuauuuaauuugaauuuuauuuuauuuuauaggggauuacaauuaagagguuguacaaaccucagaagagacuuugaacuuuggacuuuaaaacauuguugagacugauagacuguggggauuuuuugaaguuggacuaaaugcauuuugcauuauauuaugguuacaagccuaugggggaaggaaguagaauguggcaguuugaauagcuauggccccauugucaauggccugaaaaccuuuugauaaucaugaucucuauugggaaguuaaggcaggagaaugaauucaaagccauccucagccacauggcauguuccagguuacauaagacccuguuucagaaagcaaaaauagagcuggcucaaugguuaaaaaaaacagauguccuuccagaggaucugaguucuauuuccagcacccacaugacagcuaacaacugucuauaacuccaauucuaaauccaacaccuuuugcuggucucugacagcaauguacacgugugguccacagauauccaugcugguaaaauacucauaacacaugaaauaaaaauaaauaaauaaacaaauaauuaaaauau

SEQ ID NO: 4973 - RNA, 790 nt, Mus musculus
ggcauaagaugguggugacagaaaugaguuuguccaggcagguucaggccaugacaacaggccaggggugugggagcauggauagauaagugcuugggccguuugugcugcauagcccacauggcggaggcuggauggcagcaguucccgugguagaggucugugagucucacagcagccaguagguggcagugguucuggguggcagggccuuggcguugguggcuguagcugcacaguggcccacauaucgcuggcuggggcguuaagccaugguggcuguagcugcacagcaaggccggcagaccuguggcuccccgggccgguggguuggggcagaacugugcaaugggccaguggcaguugaggcagaggcaccgcaggucaggccugugagucugugccuuugaggggcggggauuccuaccagcagccagaagucacggcccagaguccacagugggcggggaaaggcagcuccugaaagagcgugucguagcaacguaguuggggugcaccccaccgcuagccuuuauaaguccuagacagagagggaaagaggaagggagaaaggggcucgcgugugcaggaaaacggcuuuggcaggggccagcaggugguugugcacaugggacagcaagucucacagacgggaccucuggcaggaagcaacgggcuuuucccaccacgaacugagaguaaaggagcagaguggggaggacagcaaguagggucccuaacuggugugcagcaggccacgagugaggaaggcagagaccagcagagugca

SEQ ID NO: 4974 - RNA, 1230 nt, Mus musculus
agggaguucagacggugccuuacccagaaacucaguuguuugcugcaaaaggaguaaagggguagcugagacauggauuggaaaacacaggccugucauugucuuaguugggauuucuacugcugugaggagacaccgugaccaccacuagucuuucaaaggaaauauuuaauuggggauagcuuacaguuuagaggcucaguucuuuaucguccugguuagaagcauggcagcaugcagacagacguggugcuggagaaggagcugagaguucuacaucagguucuucagguagcaggaagacagagccacugggccuaggcuugagcuucuaagaccucaaagcccaaccccuagugacacaccuccucuggguaggccacacuucccauagugcuacggggccauuuucguuuaaaguccuacaguuauuauagcuaucaaaguacuguagucauuagaaucugcagagauggaauguguuugagaaacgugggguggguuugugcacugaggguugaaaugagucugcugagguuuguuugguguuugugcaugcugagguuucaagugugaagucugcugggauguguccagugaggagugcagggagaggaggguggcagguugaagagagagcagagccaguuagugcaggaguuguuggaaauuucacuaaagggaaggaagaggagguggugucuggaaggcaggaaaaggcacagcuguuugaauucuuuguaaauucagguaaaugccaguauuggugggaaggaguuaggaaguaaggagucaagacaaaggaaaggcugguaacugauugguaggcgaaagggaggagaauccuuugugagaaagcaaggugggaacugcagguccugacagcucugggggcggagccugucugucaacacuguguccacugcugggcacgagaggugcucaccucugcauggaacauaguggaugaaauacuuggaaggagagauggcuagccuagaaacaagggaucuagaugauagaauagagaucagucgggcucuguauuaguuacuuuucuguugcugugauaaaacaccaugacagaaagcaucuuaaggaagaaaggguuguuuugaaacaguucaauaggacaagugaaaugaacaaacugaagucauugggaagugguugcaaugacgaguuacgaaauccaccuuggauggagggguaagaaaauagguuagaaac

SEQ ID NO: 4975 - RNA, 58699 nt, Mus musculus
cacaguggagcagucaccuucaugggaaacagauuguccccucaaguaaugagguauaugugacuaccuugcaagacaaugauugaaauaaccaaucauaacaugguuugaccaauauuuaauuguugguagcugaucccugccucaaaucuuccccuccuuacauccuaaaaccucgugccaguuaucuggaaauaggcugugaaacucaucucuauuuucucagugugggccacagugauuaguauccuuuuguugccccucccgcacugggagucaggcucugcuuauggcugguagaauuagcagcagguggugcacaccuuuaauccaggcacuugggaggaagaggcaggcggauuucugaguucgaagccagccgggucuacagagugaguuccaggacaaccagggcuacacccugacucgaaaaaccaaaauaauaauaauaauaauaauaauaauaauaauaauaauaauaauaauaaauaaauaaaacaagcaaacaaaaaagauuuagcagcacagaccagauugaacucauagagaacugccugccucugcugaguaccaaaaugccagccuaauaccuuucuuucuuuuucucggucguuccucuuugcuaccuuuggauaaguguagagaccuaacuuggaacgcuccgaguggagcuuccggccugagacaccgcuuauaggagcaaaggaggaagagcaaguuuuaaaaaaggaugcuccucugcaggauacugugugucugcuuuuauuuuuuauuugcaucaccaaaaaucuugguauaaaauauuaugaauauauuggucuguguuuuuacuacgaauucgcauagucugggaaacugaagauuuuauagagaacguuguuuucuucccagaauggaugaauccauagguaacaaguagcagccaaaaggcuuuuaguuuagaaggccauacugcuuuugcagagaaccagaguucgguucccagcauaggguggcucauauagcccacaguuccaauucuagagagccaucguccucuucugaauucugggcaacuaccgaacuccaccccugcaccaccaccccaaauauauacguagaaauaaaaucuuuucucuuuuuccuuuguaacaggaucuccccaggucucugacuuuacuagcuugaccucguacucacaggucaguguuucugccuccugcgugcugauauuaaagaccuuugacaccuugcccacccacaaauacuuaaaaccuucauaauauaaaaaaaaaaaaaaaauagaaagcaacgagucgcagaaguggguguggccugcaggcgacuuggagcacccggaagcccucgggccccgcccgccuucgccccgccccggcccgccccgccccucucagcuaagguucccgcaggccucagggccgcgggggccuggcugcacguucccugucggcguucugcggcacgggccggugggacguuggugggguugcgcugcggggaggaagaggcgacuuuccaccuucuaagcccgccucgggucgcgaugucguccggggccgggucucggcggccgcgggagccgccggagcacgagcugcagcggcggcgggagcagaaacggcggcggcacgacgcgcagcagcugcagcagcucaagcaccuggaguccuugugagucggcugggccgggugcgggcggugcgggccgccgccgacgggugggcgucgcggccuggcgagcccccggcucccucugcucgagggcggcggaaggacgcgaggagggaggccggccacuguccccgccacggcgaccguggcaauggcaguugacgcguccggaagccgagcucggagccccugggggucgaaggacgccagccucuguccacuaccacggacggcaucggcgggaagcucaggguggaaacugcgggagacgcgcgggaaggcagcggacccgcagccgggccugaggguggagcccgaugaccugcgacgacuguaguguagagucgcauguaggugagggaagguggcgggccucccguccacaaacuaaaccgagguaaaagucagaaccggggaggagagguuuggggacgcugagcguggugaggacaggacauuguaggagacuguagaagauguuuguuaugcagacauuucguguguguguuugaagacaaguuucccuguguguaucuuaugcaaacaagucuccguguguguguguguguguguguguguguguguggugugugugugugugugugugcgcgcgcgcgcgccugcauauuaccucaccugcccgccaccuuugaucauuuuaucuaugcuugacacaucacuggcacauuguuuguguguuauuuucuucuuucagugaugguguuucaguauggaguuuucccucuuauaugcccacaaccccaggcauccuguucgugucuaagacaaggaagggcucaugagccucccaccuuagacuagagcgcccucuuaaauuaaauuucucuacaugugaccuccuucaccuaggaaauuuucacacuacugcaugaguauggguauguaaaauaggggauacaagucaaacacuuacugauaauaagacauaaggaaauguguuuaaagcaguucuuauauaugcaguuuuaccauugauuaaaaacaaaagcaaaauugaauacuaaugagauagauuacuuguuuauuuuuacacaauuuaaucuuggcugcauauuugaaugaugaaggauguagaacaucuucaacauuuuucagaaugauuuuauauuuugauuuuauaauuguugaagcuuucacaccacugucacuaugcauaaguacauagaauauacgauaauaguaggaguauguuuagggccauuucagaaauuguugcaaauuugauccuaaccaaaaaaaaaaaaauugaacauuuuuuaaaaagauuuauuuaaguacaugaguacacuguagcugucuuuagacagaccagaagaggacaucagauuucauuauggaugguugugagccaccaugugguugcugggauuugaacucaggaccucuggaagagcagucagugcucuuauccucugagccaucucuccagccccuaauugaacauuuuuuaaaagaucuauuuauuaugaauaucuugccugcacguauguacuugcaucuccugcaugccuggugcccgaugaagccagaagacuucauugaaccccuugggacuggacuuguaguugugagcagccaugugggugcugggacccaaacuugggcccucugccagagcaacaaguacucuuaaccacugagacaucucuccagcaccacgggacaguucuguaugaaacguaaggcagcaacauuagcggcauuuuuaaaaucagauauucugggccagcaagauggcaaagcccugcugccaagccugauaaccaggguucaaugcccaggacccacagaguagaaggcaggaacagacuccugacuucuaaccuuuacacaugugccuuggcacauaugugcgcucacacuuacgugcacacuaaauaaauaaguauauaaaaauguaauguaauaaaauauucuagcacaguacuacuugaaaguaauacuaacuuaaugcuuacaacccagcaaugauaaugggaauauacuggaagccuuuguuuuucaugauuaaaccaucaccaguauuaaaaccugcuucuucggaauuccagcauauaccacagaugagcucagacauccagccuuguagagggaacugcuagcagcuucucagaauagccuuugcaguuugcugacgccucuccuggaagcauagagagcacugaaagcccagagugagcuauugagaagcaugcauuugaugaucugauccacccaccgugaggaacaagggauuuagugcucaggcucgggcagggguuacacuguacguaaaacucccaacaauugguggggaaaaaaggagauuaacaaugcugucugguugcuucuagcauuucuggauacagcgacaaaggaaaaauaucaacucugauauaauugacuggcuccagaugggcauagauagucuaaugguuucuaagugugcccuggaguagccacagagcuuaagcugaggaagaucaagccaaagaccccauuauacacuuggcugaauugcaguacagauucaaguucucuccucugacagggucagccauaauaguuaggacacugacugguaaggacuggguccuguacuuggccuagagaugaagcaguucucuacugaggcugaagacuuuggaaccucagauucucaaguguuuaucucacuguuagcggaguagucucuccacucuuagcagagaauguauucauaccuaacccauguagcauuguucugucugcauuuguguaaaggaaccaacccuucaucgucugccagacagcagugacuucccuugagagucgccaggcugauacugcuguccuucaggacccacugaccuacauccagaucuaaggcaggcuccugccaugaggaggugugcugugccacugaagaaccuaaugaguuugcugauccauucaagcaggaguuuggggauuauguguggggauggauuguaaggggaugggauaauguuggaaagaacauaaaacugcaucugaguaaguuuauugauacaggcucacuaaguggcgaaucuagguuugauauggaagauuacacaguuuuuaaaaagguguuaagggcuggagagagauggcucagugguuaagagcaccgacugcucuuccgaagguccugaguucaaaucccagcaaccacaugguggcucacaaccauccauaaugagaucggaugcccucuucuggugcaucugaagacagcuacaguguacuuagcuauaauaauaaauaaaucuuaaaaaaaaaaaagauguuaaaaguuugaucgguuggcuaaagaagcguuugucaaaagauggccuacugagauagaguuggagcaucugaugucccuuggcuuaaugcauauacuguguaaaaacuaguccuccacaauaggaaggccagaauucugacacacccuucacuaaugucaugagacaaaauggugaggggcaccagcacauguaaaggcauuuguugucacccuuuuccuugugccagaccucagaguggcuaugcugcuguucgauuagauggauucauugugauuggcuuaauugggccaugaguagcagaggccaaguagcagcacuaagucaccaaaggcaaggugacuguaguuaucauacugagcagcauagacaaagcaguguccgcggugaccugaccugaaaaggacaucacauguaaaguggguuuuaaagugucauaaauccuauggacucaucagucaugguguuuucaggguugaaguagguaagaaaccuacuaugcuuguguuugaucaguauaagcagaauucucauaggaaagauagacuacauugaguuguggcaagagggagucucagcccaugaaccaauuucuagacuugagccaguuugcagacccagaauaacuugagugaaaggaauggcaaggcuccccuaaguaagaaccucaggaaaccucuagaguuuuaguuagcauuucucccauccuuccccagaaggagcccuuuaaguauauacuaggggaaaggaaacagacuuuccauucuaaauugggugauuucaggagaccucagagaagcacggugacccgccagguaaauggaaccagguaauuaauggaguuguggcugaaguccaacucauaaugggucuccaaacucaucuuguauuuuuccuguuccagaauguauaauuaguauagauagacuuggcaguuggcuaaauuucuguauagguacccugacuuauggaguaaggguuauugugauuggaaaggccugguguaagucauuggaguugccucuaccagggaaaauagugaacaaaggcaauauugcaaccuacaaggaauuucagaaauuaaugccaacuaauaaggacuugaaagauggcagggguggucuuccaccacagauccuaucugguugugcagaagauaaguauauuguaguaaauugacaaaugacugccaaaaacuuaaucaaguaauaacuuauauugcagcuucuguaucagaugugguguccuuacuugagcagauuagcauaucuccugguacaugguaugccgcuauugauauagcaaauaccuuuucucaauaccugcccauaaggaccacuaaagacaauuugcuuucagcuggcaaggccagcaguauacuuuuacagucuuacaucaagaguacauuaacucucaagccgggcgugguggugcacgccuuuaaucccagcacuugagaggcagaggcaggcagauuucugauuucuaggccagccuggucuacaaagugaguuccaggacagccagggcuacacagauaaacccuuucucgaaaaaaaaaaaaauauauuaacucucuaggccuauguugcaacuuaguuaaagagauuuugauaucugucucuuucacaaaauuucacacugguuccccauguguugauggcauugugcugauuggaccagcugagcaggagauagcaaccacuuuggaauuguugcauuagugaauagggaauaaauccaacugaaauucaaggaccuucuaccucagugaauuuuuuuuuuaggaguccagcaguguugagcauacagagauauuccuucuaacauaaacaauaaguuguugcacuuggccccucccaccaccaagaaaguagcacaaccuuuagugggucuauuuggauucuggagacaacacacuccucacuuggguauauuacucuggcccauauaccaagugacuuagaaaccugcuaccuuuguguggggccuggaacaggagaaggcucuugaacagguccaggcugcuauacaggcugcucuaccacuuggaccauaugauccaacagacauaguacuugagauguccaguggcagaugggaugcuguuuggagccuuuggcaggccccuauaggugaaucauagcagggacuuuagggauuugggagcaaggcuuuaccaucauuugcagacagcuauucuuccuuugagaaaccgcccuuggccuacuacuaggaaugauuaguaacugaacauuugacaguaagucaccaaguuagaaaggaaagagcuguccaucauguguuggguauuaucucauccacuaaucacaaagaaggcccacccagcaacaauccauuaucaaauggaaguguuauauacaugcucaggcccaagcagguccuaagggcacacgcaauuuacaugaagaaguuguccaaaugccuaugguuucuaguucuguuacaauuccuucuguaaccaagcaugaagcuguaggcucgugguggcagagucagaggucaugaauggguuugacaacauggacuuccacucuccaaggcugaccuggcuaaaacugcugcugaaugccagaucugucaguagcagaagccaagagugagccccaacuauggcaccauucccugggaugacuagccaguagccugcuggcacgccagcugcuuugggccacuuccuucacggaauagccaacaguguuuguuuuuuuuuuuuuuuuccuuacuggaacagaucuuuauucuugcacauaaugcuucugccaaaacuaggcucugugggcuuacagagugcuuuauccaccaucacaguacucaacacagcuuugcuucuaaguacccgauauuauggccagagaagagugacagugagcuuguucuaccauguuccccaccauccugaagcagcuggccugagaagagugaugaaauggccuuuugaagacacaauuaaaacacuaacuacuuaggugucagcagccuggcggauaggggugcguucuccagagggugguauaggcuuugaguccuauuccaguaugugguagggucucucauagcuagaauccacagauugaagugggaaugguuccacucacugccacccuagugaccugggaaggucuugcuuccuguucugcuggcuuaauaguuuugggguugggggugcuccugccuggagccacaacaaacauuccacugaacuggaagcucacacuuuuccccuggucauuuugucuucugaugcccuuaaaccaacaggcuaagaaaggaauaacaauguuagcaggggugguggauccagauuaccauggggaaauuggauugcccuuccacaguggagguaagaaggauucuauuuggaguucuggagacccauggggaccucucuuagcacuaccauguccugugguuaaagucaaugggaaacuacaacagccuaauccaggcagaugacaugggcacagauccuucaggaaugaagguuugguucccuccugcaggaaaagagccaagaccugcugaaguacuugcuaaagguggagaaauauggaauggguagcagaggaaaguaguuauaaauaucacuacagagaugguguggcucuugcagaggacucagguccaguucccagcacccacauagcagcucacaaccaucucuaccagagcugaugccccacucugaccucuacagacaccaggcauacauguagugcacagacauacauggagggaaaacacucagacaugcuaauuuuugaaaagcauuuuaaaguacuucacagaguaaagauuaaugaguuguccccaaagacuccgaacuguaauccugcacucagaaggcugggacgggaaaauggcaacugugaagccagguuggugcaugaagagagacgccaccucaaaagacauccauccauguuucugugaaugagucugcauccauuucagauauuuccccuuccuaccuagucuuagagcaacuuaguacaugcucagugauaucacagcaagaccuaaggguacaaaauagaucuuaacugcucuuuuuaaaucuuaagaacuacagaaguuuacuacaccuccaugggguucagcauucaggagacugaggcaaaaagauugucaugaguucaagcccagccuggacuacagaauaagacccugccucaaacaauaacaaaaauaacuagucuuuuuuuuuuuuuaaucuguuuguauaguuuuccuuuuuuaacauuaguccuagugauuuggucuacagcuagagaacccaggcccagguuguaccaccaaacuauaccuccauccaaauguagguuugauguuugggcuggagagcucuuguuuuguuccuaguucugggauucaaagccuuacacaugaugggcuaaugcucuuccacugaggugcccaugucuuaggccuccauucccacauuucuuuccuuuuuuuguuuuuugagacagacuuuuacaguuggucuagaacuagagagccaacugccucugccucccaagugcugagauuaaaggugugcaccaccacacucgaccagccuagauuuuguuaacugucacagugggaacagauuuaucuuauuucuuaaucucuuugcuuagcacuugaguaaugcuuugagguguagugucuuucugaauguauggauuaauuugugcuagcaguaaauagcaaucaccuuacuuuaaacuuacaaaaacauccauacaauacacuuuuauggaacacuuuuugcuaauaauaacaaauuucaaaaucuguaauuguaucgcauucuucuacaguguuaaaauacaugcauuuggacccuguuauaauuggccauauguuguuuguucaacacuuguagcucagugaugaguuuggggauucauguacuuuacuagcaaguuccuuccaguccugaugcuugagacuuuguugguauugguaauuaauggcugcugaugggcuauggcaucuagccaaaugacccagguuucuguuggcuuugcugaguuagucuuguaucauagcauagcuucccuuuugaaaaugucuuaaauaucugcuuugggaaagguacuauacuaagucuaagaagcuaauuuugaucccacccagcuauuuacuaugcagccuucaggggacgcaccuugcccugaccuuucaaggcuuuggauucauggcaguucuaauccauccuuauacugguuaguuuuugucaacuuggcacaaacuagagacaacugggaaggcagaaguucaacggaggaauucccaccaccaucaaauuggccugugggaagucuggagacauuuuuuuuuuuuuuuuggauuaaugaugaaugugggaaggccuaacucccugugggcagugccacccuuagacacuugucguauaagaaguagucugaacaagccaugaucucugcuucaguuccugccuuagcuucagucaaugauaaccuaaucuaaccuguaagcugacauaaacccuuuccucuccaaauuccauuugguugugguguuggugacagcaacagaaaacaaccuaugccguuccccuaucaaguuauuucuccuacauuuccgagcaggaaagggaagaucugaagaccccuuaggcccugcauacaagagucagaacaaagacaauguacauccuugugcuuuucugucccuuccagccucuagcgaugagcacuuccggcgggugguggggagccauuuagagaggagaggcccagacagaaguguccuauaucccucuguggaguucauagaaauccugagccaccugaguguuggucuuugagcaucacuccuccugggcugccacuuaccccaaagacaacccucgugagucuggagugcauaguguggguacagugggcuguggcuggugucugacacagcugggaugguagggcaagccucugcuuugccccguguacauguguauuguuuucuguugaccuguuugaugaagccagcuuuuuguguuuuauuuucuaguuaugagaaaccuccuccuggguuuauaaaggugagugacuguguuuguccacuguauuaaauguacuugagcuuagugguguauuaggagaaaaaguauguggguuuuguuuucaaccuccuuguaucagcgguucucagccuuccugacgcuguuacccuuucauacaguuguucauguugugacuucugaccauaaaauuaguuuuauugcugcuucauaacuguaauguuguuacuguugugaaucguaaaguaucuguuuuccaauggucuuaguugaccccugugaaagggucauucaaacccaagggagucacuaccccacagguugagaaccacugccuuauaugaaaacauauaccuggugaacccuaauuuggaacuuugucacaaaggcuaugccuuccuagaaauuuaaucugcuaucccaggaguccugaaacacagcuuccuucucucuugggcaggaucuuccagaagcucugcuauccguuuuucuugucuuccucacucagccaucuccucgguacauuaaugcugggagucuugaguacccucagcucagggagcccgugaaggggccugagaggacacacgcagugcuuagggcagggaccccugcagccuaguaggaggggacucaggagcaggcaaaacccaaaagacuuucaguaaaagaaauguuuuaaauaacuagaaaguaaagaaauacugcaguucuaacuacagucaugcacucgugaaaaugcccacgagagacacaagcggccuguaagagagaaggugccgcggacuccuaaggcugccucuccacccgaccugcauuauggaagagucugcuucucccuggggucagguuuucagagcuguuuuccugugaagucucucucugauggucuagacagagugaacccuuuuugauguauuuuguguuagugcauggaggucccaagucauuccugcaugggcuugugcuucauggugacuccugcaguagagcccagcugucucucugugaaguugucucacugacugauucuucgccucugcagucccuggggaugcuguuaggguggccuugucacugagugagaggaagucagacaacagcaaccucucaagcaggaagcaaggacggaguccuguuuugguuuugguuuguuggguuuuuuggugucaguguguuuuuugguucugguuuuguccuguuguuuauacacuguuaucuuccugcaggaggacgagacgaagccagaagacuguauaccagaugugcccggcaaugaacaugccagggaguuucuggcucacgcuccgacuaaaggacuguggaugccccuggggagagaggucaaaguuaugcaaugugagugugcaagggcuugagugaucuccagcaucugucgucuacuaaacaaggugcaggguggguaacucaugaacgggucuauuuggcccacagucugguggcugcagggucugcacagcagagcaugagcguucuggccuguguucccugcuagcaucauacaugauggagaagccaacggaagcacagguagggagugaucaagauggcuguacagccacuccaaccuggcaaucauucucucccacucaugaggauuuaguccccgugacugaaaccugccucuaagcgcuaacaccacaucuaaaggguccucuaugcugcacuacuacagugugagcaagacuuucaacacaggaaccuuugggauaaaucagauccaauacuacuaguauuccucugugcacacagguucuaugcuguacuucacaguaccauaccuguucuccucacacagugugugugugugugugugugugugugucucugucugucugucugucugucugucugucugucugucuauauugcuguagggaucaacugaucaacuguaggacacugcccaugccaggugagugcuucaccagucccuacauuuuuuacuuaucauuacuaauuacugaguguaugucuguuguauaugugguuuccauggcacacauguggaggucagaagaaaaccugugggaguugguauucuuccccuaccaugaccaaugcuguuauaggcugagcuguauggcugacuggacuccaaggcuuauagcuucaaauccagugaucuuuccuuagccauagggcuggggaguaaguacuacaacagcaaaaagagcaucccaggagagaccccaaaggcauaauggaugcaccagagcucugcuuauaggcugccaguguugagugguguuuauccacuaaccugacaaaagugaccacaggccacuggcucuggacaggcagaguucuccaugcauauugugucccaccugccuucaggguugucacacacauaguacagcauuucacaggaugcaucugucauguuccugucccauuuuguuauauuuugaaaucaggcaucuccacggcccaggcugggcuucuugaauuugguuguuuguucccuugguuuuguuuuuguuuuuuggauuuuucuuugucuuguuuuguguguguguguauguauguguguguguguuguuguuguuguuguuugagacaggguuucucuguguagcccugguugucuuggaacucacucuguagaucaggcuggcccugugcucacagugaaacaccuuucucugccuuccaagcgcugggauuaaagguauacguuaccacugggcagcaugguuuuuuuaguuuuuaagaccaggucugggauuccagucucugcaucuccauggcagcuuaacaaccauccgcaauugcagugcuaggaauccagugaucucuucugcccucccuaggcaccaggcaugaauguggaguauagacagacagacgugcagucaaaacaccuauacaaacaaaauaauaacuuaaaauauugaaauauauagaaaagaaaaauguucccuuacaacaugcuuuguguaguugccggcguggaccagaucagguuaucuucccagcagccucuuguuuccucgccuccuuggucaacaccaaaauacagcugucacuuggcucucuauccccaggcagcccugacuugucuccaucuggauggcaugaaaagauguggggguaacugggaccccauccuugcugcgucacacagcucgggcugccacaccacaugacaagcccauauucacugcuuugaguuguaugcuuguuucugugacuugaaacacguuuauauguguuuauuuuaucagguccucaggaccuucuguacuucucauuauaaaucucuuuagccagguauagugaugcucaccuuuaaugccagcacuugguaggcaguggcaugcagcucucugugagcucuagaggucuaaauaguuccaggacaggcagagcuacaaaaaagcaaaacaaacaacaauuaaaaacaucuuuaacuggagagauggcucagugguuaagagcaccaacugcucuccugaagguccagaguucaaccacaugguggcucauaaccaucuguaacaaaaucugacucccucuucuggagugucugaagacaacuacaguguacuuacauauaauaaauaaauaaaucuuugaaaaaagucuucaaacacaguuucucuauuuaucagauuaugauguaguucuaauggcacuaacuaacauuuuaagagaauguuuucuuuaaacacaggcucaagcuggagaaguggcucacagugaagcgugcacagugcucuugcagaggagcacagcucagcggcucacaaccaccuggaacuccaguuccaggggaccccaccccaucaucuggccucuuugggcagugcacucacguguacaaacacauucucagauacauauacgcauauuuuuuaaaacaaggucagguuaguuauggugcaagccuuuaauccaagcacuccaagugaaaggcgggcuaucucuaugaauuuaagucuagcccuuaaauggaacagaaguaugcccuuuaaguccuagggcuucagaggcaaaugucacuugagucuagaaauuugagcuguaccuggggcagguguguguguggcgcuucaaaucugguuuacucaacccaagaaggugcuguuguugagcagcuggaggccuuaaccgcagccucaagcgagcacacugagccgcucuuucucucuaacugcaacuccuagcccucagaaucagagccaguucauaaauaaagacuauucuaccuuuuaauuauuuuuauguguaugugugauugcgugaguucauguucaccacaugcauacagcugcccauggaggccaaaagagcauuggaugcccuggaacuggaguugcaagggauugugggccaccgugucagugcuaggaaccaucauugaccuuauuucguuuuuuguuuguuuguuuguuuuuuguuuuguuuguuuuuucgagacaggguuucucuguguaucccuggcuguccuggaacucacucuguagaccaggcuggccucgaacucagaaauccgccugccucugccucugccucugccuccccagugcugggauuaaaggcgugcgccaccacugcguaaaauguagugaaguacacagaguaaauucacauuuuaugauacuuuuacaaugcauugcuucauaauauuuggugaugaacauuuaaacacuccuagccugacaagauucaaagguguguaaggaagcaguuaguugacccucauugcuuucugggaccuucacgguuucauccauuaauccuguaaaucuaaagaaaaacuugaaucuacugaaacauuaucucaaugaagaaagaacauauaaucuuacggaacuguuuucugugguuuuagguuggcguugcaaacgguauggccaucgaacaggcgacaaagaaugcccuuucuuuaucaaaggcaaccagaaguuagaacaguuccgagucguaaguaaaaccccacuccgucacuguuuacaguuggcacagauggcaaauguuagcuggggagucuguagugagcugcucaguaacugcuuuccccagaagccucccagccaagcucucagaugucaguacaccuguaugcauugugugacagauaacaagcagcuaauggggguagagguguggcuccuuugauagagugcuugucuagcaugcacacagcccuugguuccagcccagcaccgcauuaaguaagccugauggugcgugcucuugucucacacugagaaaagagcuuucagaggcuggaguugacugugugcccggugcuugcccagcacauacagacccugcauaggcucaggccccagcacugcagaaggaaaagcaaaggcagauacccucagccuuaggaacaagguucauuuucuuuuucccaaagccagcaccgugggcucagccccuucuuuguaauuugcuauauauaacuucacuuuuuauuacuaaggugaaggauuugucccagggccauguaaauguagaugugucuuuugagcuggaaguguguauuugcuaagaugacacaggacagcucuacugucuccucaugucaccucucagaggugugcauucacauccagugacuaauucugcuaaguaaggcaggaucuuaugagguuauugguguuucuaaaauggggccaaccagaccaguguggugacucgugucugcaguccaguacgcagaagugucaggaagacccugaaugaggcaagcagggagcccauagcaacagccuaucucacgaaaacaaccucagaacgucuucagggacgaggcagaggacuggguggauaguagccguugccaggcaagcacagcacuggagugugaaugaaucccugucaugcauauaaauacuaggugggcauggcagccugcuagugcgcagagggcaggagcgguucgcuguggaagcuggcuggcuggaauggcuaccuugggggcucuggcuucagcugagaugccuugccucaaggaauaggauggagagcucuggaaaaggaguccucacgucagccuugugaaaccugagcacagccugugauggcaccacacaccuuuaguccugucacucauuucugagcgugaggccagcuugagguccauagcacguuccagaccagccagggcuacacagugacacucuguugcacauaucuuauggcucaaacucuauuacaaguacaccaaaaguuaacaguaauuaugucugguuagcaagcagauuuuuuauguuuauuuuuacauauuuauuuccagcacugugguagagccaacggcguaauugucgcuguguugaucccugaggaaacagcuccuaagaagagacuuacccugccucagucucaguccaaagcugacuccaguccuuuuucagacaggauuucccuguauaucccaggcugaccccagacucaggauccuucuuucguagccucccaagugcugagguuacaaacuccaucacagccaccaaucugaagcuuuagaccuggagugaggcggaccaucaugguggagaggccguguggagcagagcuccucuaacgcccugacagcuguuagccaucaggucugagcuugccucccccagagcagcccacagguacagaagauuugcagacuccucuggggugacaaguauugucucuuguucucuuucaccuaagacagucuuuaagugauugcaugccuggaguccuuaggaagcucggacugggcuugacuggcuaugccaccaaagaugaccucagcccacucgcccuccgccucucugcuuacaacccuucagccccacccugccucugccacuugcuuuguuuuggauacagggucaggauguguggcugaggaugauccugaaguuuugauccuccugccucaccuccaggguacugagaucacagaugugugccacuguagcugguucuacaaugcuggggagcaaauccagggcucugugcaccucagcuccggggcucugugcagccuagacaagcacugugcaccucagccuguguuucuaagcacuuaguucuuuccauaguagugccaccgccugugguugguucugggauagguguuucaugggaucuuucucuuuuuucccaauuuuucuuaauauuggugugugagcgugauuuugccacagcacucacaugugaaggugacacaaccugagagagucaguucucaccuaccacaugggucuucgggaucaaauucaggugaucagacuuguuggcaaguaucuuaaccacugagccaucuugcuggccccuguuucuguauucuuaguaucuuguuuaagaaugaaugucuggcucaugaguagaggcauuuccugccaagccugcuggccuggguuuucgccccagaacccaaauaguagaaggaaaaaaaaaaaaacuucugaaagcuguucucugacuccauaagcacacaguugcacacaagcaugugcacauuuguguaauguguacugcagaauaguaauaauaauaaugugacugcagagaucgcucagugguuaaaggcgcuugcccaucuucaguggacuugaguuccauucccagaacccauaucaggcagcucacauuuucuauaacuccaguuccaggguaucugauacccucuucuggccuccaugggcacccccacacauauaugacauacauguacacauguacuugaauaaaaacuaaaaugcuguuuaaaaaacauaaacacacagauuuacgaagaaaaagaauauguccuucaaaccaaagcaucaguacagauuaggaaagaacagacugucgcgcuuggcacgggagggcugggcauggagcagcacaccucugaucucgaagucaagaggcugaggcaggaagagcucuugagcucuagucuauccuggucuacaaggagaacuucaugccacuaggcuacauagugagacccugccucaaacaaaaaacaacaaaaagaugcucuggaacuggaguuguagaugguugugagcugucauguagaugcugagaauagaaacuguccuggaagagcagcggugcucuacccacugacccucuucccagcccucccuauaaaauuggagaaguguuuuguacccuuaguguaucuacaguaauaaagucugaguaugguggcacacagcuaugaucucaguauucagaaggcugaagcaggauugcugugacuuagggggcagcuuggucuacauagugaguuugagggucauccaauaacuguuucaaaacauaauaagacuuaucuccaaaagcccuaauaauuauaggccuuuaaagggauuagaauacauuguaagacaggugugaugguuucuguuugagagcccagcacuuuggagacugcagcaggaucagcauaguacaaagccauccuggacagcauugugaggccuugucucaagaugagcuggacgcagugcugacccagcacugcaggguacaagcaggagggucaagacuucaagaucaucugcagcgccuuagcaaguucaaagcuagccugagcuauauaguaagaucuuacaugguugggaaaagacauagaugcugauauaucuaucaucaagcuacaggaagcuaacuguauucuuggcacucagggggcuaagaagggaagguuaaaaacucaaggccagucugagcuccauugccaguuugaagccaguccaggauaaauaaagacucucaaauuuaacaacaacaacaacaacaacaaaaucuacaucaaauauuaguuucuguacauagagguuuaauuuuuacaugauaagcaguacauuguaacuaaccaaacugcaacccucuacaacccuuaaggcacaugaagauccuauguacgacaucauucgcgagaauaaaagacaugaaaaggauguaagguaaggccgcucgcucaucgauaccaauguccucucucuuguuguuggguuuuuuguuuguuuuucuuuuuuuuuuuucgagacaggguuucuuuguguagcccuagcuguccuggaacucacucuguagacuaggcuggccucaaacucaaaaaucugccugccucugccugagugcugggauuaaaggcgugcgccaccacgcccggcuccaauguccucuugaagucugaaaucaugcaauguuauaaacaacacugggagagcaagauuaaucacugaacagagaugucagguaacaagcaggucagcuucuacuguagaucccuaaauaugcagugggcaugccucgacuuguggacaaucacauuguggugugugugugugucuaugugugguguguguggcuacaguguaggccaagcuggccucagucucuggagugcugagaugacucauaugccaccacacucugugugacugacgaaguccaaguuuuuguuauuuucauuuuuagacaagauuaaggaaggggcugugguucaguugguagcaugucugaagcccuggguuguguuggauccccagcacggcauauaccagcuauuaggaugcacacauauagcaccaucacuuaggacgugaaggcuggaggauuagaagucaaggucacgagugacugggcaugaguugaggcuagccuggaauaaugaacaccaggaagguguguuugcuaauugcuguguuagaguucuugagaagcugcacuccugucaacagugcggauggcucaggcggugugcguuugcuaggagccacggggccugaggagcaagcacagauauuuaggacaauaagaaggggaagggaugucuuagcaaggcaguuacccaugauccacuccucagugcugccugaugaaguguugcugugguggcucugucuaggauccagcaguuaaagcaguuacuggaggacuccaccucagaugacgacgggagcagcuccagcuccucgggggacagagagaagcgcaagaaaaggaagaaaaaagaaaagcacaagaaacgcaagaaggagaagaaaaagaagaagaaacggaagcacaaggcuuccaaguccagugagagcucugacucagagugacagcaccacccacaggccaaaggacagagccgccgccgagagugagagacuggacaucuagcacagcccugggcccucaccgccuccuggugccaagugaccacugcagagcaggugggcuccugcgacaccuguguccucuaccuuauggucaccgugucugugacugcuucaguaggccgcugcagugggaggugaugagaagacccugaaggggcagacacucuagggcacugccacggcggcguuugcccuccauggugugguaacucauuuuccaugaacuuaaggcuucacccuucuuugugguuugggauaauaaaaguccauguuuuauuuuucaaauguagucauuauuaauacagacaagucuaaacacuacauacuucuuuuuccagcuggcuuaccuguuugcauugaaguuuuucagaaauaucucauguagaccuaagugccuccacaugccuccaaucccagcccuggaagagacugauacagaaagauucccgaguucauggcuggcccaggcuaaguagcaagaccuuuauuuuuaaagaaaagaucucauaugcugccaacaugauauauaggauguuuuguuucauuuugagacugggucugacuauauagcucugucuggcccaaggcuggcuauguagagagacugacuuuaaagucauagacaucugccugccucuguuuccuaagugccaagauuaaaagcaucuuccacuaugccagugcauauaggguguguguguguguguguguguguguguguguguguguguguguguacaugcacgugcgugucugaggacaaccucagaugugacucuuagguguccucacuggccugaagcucagacuggcuggccagugaggcucagggauucuccugucuccacuugccuagcacagaaucacaaguacauaccaccaugcuggccuuuucacaugacuccugaugcuugcagugcacuuacagacugaacgaucucucuaguccuacagauggccugacaugcugacuguuguguucuuggcuuucuaaaaugaacaguuugaaaaggacccucguaguauccaauauuugcugccuuguaaguguaaguuuggcuggccaagaguccuaccaucuucacagaggcacuaacucagaaagcggcaggaaauaaauccaagggaagcaucauacugaggagugagcuguaucacagggcacacccaucaacuccucccucauguugcauaaucacaaccuacccaagcgcccgcagugaagacuccaugugccggaggucagggcugcugcugcugcugcugcugcugcugcugcugcugcugcugcugcugcugcugcugcugguugugccaaagcuguccacacucuuuguugguuuuggcuuuugguuuuugaagaugguuucucugcauagcccuggccguccuggagcucacucuguagaggucugccagccucugccucccgacugcugggauugaaggcgugcggcaccgugcauggcuuguacuuguacaugcucuugaacaaaugagccauuccuccagucccagcauagcaagucucaaaagcauuaaaggccuggguaggagguacagaguggucuuugcucacagagaagcacuagggagccuggaauuauagcacacaagauuguuccuucaagggaagggaugcaauaccuguuagcccccagaagccuggagcagaugugcuuucuagccuggugaccucgccauuggugcaacuaggcuuuuccagcaucgggcccuccccuagacccuccuaggauaugugauuuucuuggucagucaguagaacccaucuuuauggacuucacaaguaguuuuuauacagucacaucuuaucuguccuccgggagacuuagguacacuuuguuguacaugggacugaauuaucauuaaacuauacuacacuuaaauacaccuaagauaaaccacagcuagacaguaaucugugaguauagcagaauaucaguaagaauuuaauggacuguuuuuugucagugggauauguauccuccaguuucuggucauccagacagugucagacaugggccucaaguaauugguuggccacucccauaaguucugugcgaaccguuaccccaguacaucuuacaagcaagacaacuuguagguuuuguggcuggauuggugucugagucuuccccuagaaaucuugccuaguuacagaagauggccaguucaggcucuauauccuccauuguuggggauuugauuugugcuuacaugggaauucgcacaacagcugugggucccugccaacaguugguuuauuugacaacaaagagccaauggccaauggcuggacaggggacagaggugggacuuugaggaaacacugaauagggaggagaauugccggggcagaaggaagaggauucacacaugagagcuguggaagacagagacccaaccauguaagaaucagggaagagcugaccccauugggucuggggagcagggauaaaguacagauuuuauaacucaagaauaccagaguggagaguauguuagccacguggagguucggcuguaggaagaaccaauuacuagccuacguguacaugcugcaagcagggaacuggcccaaaacggaauucucauaaguucaagcugugucagaacuggccagaggcuguuuaucagaagaaaauagccagaaaugucacuuuucagaccauagccagguuuauucuaggucagccugucuguccucuccucaugauagauaccaaacaaggggagaggccucgcuuuccccagauaauugauuugaguagguaaauccuccagggacuuaguacuugguaaaagauggaagacaguaacucauacucaagacuccaucucccccaauacacacacacacacacacacacacugcugcagggaacugccacucuacugcagacccagggaagggucuuaaaacuacuaaaaauuaaaaggggcaaccauguucccaauguaaagagauguaggcuucuucagugaacucaauaacaggaaggagagauaaacagagacaaacauugaggcuuggguuauagaucaguaacagaguacacccaugucugauccccaguaccaugcacagacacacacacaggcacacacacacagacuacacacaggcacacagacauagacaugcacagacacacacaggcauacacacacacagauauagacaugcacagacacacacgggcacagacacacacagacacacagacacacacaggcacacagacauagacaugcacaaacacacacacagacauacuacacacaaacacacacacaggcacacacacacacagacauagacaugcacagacacacagacaaacacacagacacacacaggcacacauacacagacauacacacacagacacacacagacauaugcagacaauacacacagacacacacauagacacacacagacauacacacacacagacacauacugacacagacacaaagauacacacagacauagacaugcacagacacacagacauacuacacacagacacacacaggcacacacacagacauagacacacacaggcacacagacauagacauguacagacacacacacacacacaggcacacagacauagacaugcacagacacacacacagacauacuacacacagacacacagacaaacacacagacacacacaggcacacauacacagacauacacagacauaugcagacaauacacacagacacacacauagacauacacacacacagacacauacugauacagacacaaagauacacacagacaaaaaaaagauacauacugacauacacacacuuuuccauaaacugagaggguaagaugaaaauguauaaaauaagaacugaacaaaaaguuuucaaucuccuuuuaauauuacuuaacauaagaaaaauaagagcuuagauauugcuagccuucucugguguacaaaauggcuauuucaaagaacaacucucucuguuuaggagaggaaauagaaccuugggguuuauacugcagagcauuagacuggccaccuccaauccagagcuggccuuggugcccaaguucacagcucaucguggugucaccagcagcgaagucuucauuugucucuggagagaucugaaugaaaagacaagugacuuccacccgaagucuauagaaauguucuaggaaaauaguuucaggucuacauggaaccuagaauuucagcuggauccugagagcuggucuucaacaagcgaaggucagcugcucuccucuaguucugcaggugcugggugcccuagcugcuaacagccaugaagagccggcucugcugcuuagaugagguuuuucagcucagcgucugucagcucguucaccuccaugauccucucuaagugcuccauguaccggcugugaucaugaaggaaaugugggacucgcauguuuucaguaacugccaauucuuuuaagcgauccacaucuucguaagauaccuggaaaaaaaaaggaauuguuuuugcaacuacaagugacauuuagaggggaccaagggcauuaaacgaaaauguguggauauaaggccagguguggugguucacaucuuuaauccuagcaugcaggaacuuggaggcagagauagguggguaucugugaguuuggggccaaccuggacuacacagugagacccuguaucaaaaccaaaaucaaauguggucugcagaaauacaaaaggugguugguuacuuuccuuuaguacauuaaaugaaauauuauguuuauggcugcgggaagcggaugcggccgcauugggccaagauguuuacugccuugcccgagcaugcacagugaggcugccugccaggcuggacuguuccucgugaucuggaccugucagccuauccaugaccgaccugagcucgugccuggagcgugugugugugugugugugugugugugugugugugugugugugugugugugaauucugauuggaugaggugggguggagcuagaaggaagucaguugccgugagguaaguuuuagcccuugccuuaaguagaagcuaguuguaguaagagaagcuguuguaaggggaguuuuguaagaaaagcugcaagaaggagaacaaguaaagaagcuguugcguaaacccgacuugguguccgugucguuccugucaccgcaggaacgaaggaccuguagcauauggccucucauaacugagcauaaaaaagaaagucagcacccgacuucacacccugucuuggaacuaauucagucugugugagcguuaggcagugcgcucccuguguguucacagcagacuuuuaccuuuuuggugcuacugagaacccaacuuuggcaaagcauauuaggcaaguagucuaccacuaagcuccauacucagguaagagagacuuuaaacucaaacaaaucucuugauuaaaucuaaauaaaagacagugggaucaaaucugaagaagggacacucuuacauccuggcuuccugauucuguuuauuaagccggcagacauaauuuguuagauucucuugcuguaacugaauuuuucuaagcacuuaaagaacaugguaaacucucccugcuggccagaggugcucugcuggggaggaacuguccccacgcuucacucgguucggcucagcgauucguccacuguggcaucuuggacagcuuuacagggauggccaacuccuucugggucaagaucaagagagucucuccauaggagagaauguuguaaaggaaccaugaaccuggccugaagccugugguggaggagucacaguccucgcugggaagcuacuguuacuguuggcaaaggaagcagaguuccuaccagaucaccuucuaaauaaccauggccuugccuccaggugaacacugcucucagcugaggccagagcagauuccuucuacagugggcaguccaagugucaagaacuaaguggcauuugaagaagcagccauaaaugggccaccuaugacacugucccagacucugggaauauggaaggagggucaggaagaaugccaucgcuggugugugggaugccgaguucugggcugaagucacagcagcuaugaugaccuccacaugaccugaggcugaagggaggaucaggagccccaccuccaccccccaaguuggaagcaguuaauggcuaauggcaaaggagacauuuuguuugguagugcuaccacuggugggcugcccgugugucugagucauugaaaacaggcaugaagccaggauugcuagcaaacacuuuaaucccagcacuuggaaggcagacauaggcagaucucugugaguucaagaccagccuggucuacacagggcugcacagugaggaauccugucucaaaacaaacaagcccaugaaaagaggaacuaauuagaagagaaaaccauuuacaauucuauaaguuauuuuuaccuuuaaauuccaaaucaaggcugauuuuauuuauuuuugaaacagggucucacuguguagcccccuagcuguccuagaacucaguauguaguucauguuggccuugaauucacagagaucucccugacucugccuccugagugcugggauaaggugugcaccacuaagccugguuuggcauggcugauuuuaaacagcccaucuucugaucaccacucuuccaggguuggcaggaagucuuuuugagaagaaaccacagucauauugcacuuccaacuuauugauuuuuaauguuucuauuaucaaguuacuuauuuauaccccuaguguaauagaaguagguuuuucagcuuaugacagacaugacuaaaauauacauguguaccuuguccuaucacagcuggaggauacuguguuguuuacacacugcagguugggcagcucugcuuuaaccaagucuaauggcaacuuaaaaaacauacugacuuauuuacugggcugggugucuggaagagacaguggaaggucaccagaaggccagcaugaccaggcugagggaaagcugcucccugcaggaccagcaccccagcccuaagggcagcagaaagccagcauggccaggcugaggggaccugcucucugcagggucagcaccccagcccuaagggcagcagaaggccagcacggccaggcugaggggaccugcucccugcagggucagcaccccagcccuaagggcagcagaaggccagcauggccaggcugaggggaccugcucccugcagggucagcacacagcccuuaagacaacauuuaacacaacacugauucauuuaacaucuuucucauauuuggguaauuuuucucacaauauuuuaaaccuuuucauccuuguuaaacuuuguuaaggcaauguguccuauagggugaauguagcuggugacuucugaguggagcuaaugcuuacuaacuguucccaauuccuaacaccccgagaaugaugcuaaaaucucuuccacuugugcucaguaaguggaguggcaggggccagaugacaguaugucuguuuauaaccgggcuugugagauauauacauauuuuuuaacuuugucagaauguguuuaagugcaugccuguauguacauaccugccugcugccuuucgagaucagaagaggguuuggaauccccugaaacugaaguuccaagugguuaugagaggccauaugggugcugggaaucaagcgcugguccucugcaaagcugcaaacacucuuaaacaccaacucaucccuccaguccccaaaugcagcggaaaaagauuguguguguguguguguguguguguguguguguguguguguguggccaaaaguaggaguucuguguggcuaugagcuuacagcccugagucuucuccccagguccccagguccccagguccccagguucuggaauccuuggaguccacuguugagacuuguugcuuacaaaggauuccuugcaaaugccaggguuuacugacaaaggaccuggucacuggagaccuugauggccacacgcaacaagauuuguacugcauuuuaacuuuauaucgaauuaaugauaacccuuguucacaggagaccucaaaaaagccaggugucauauuuaucgcuuccuuucaaacacucuuagaaaaacauuuuaaagaaagguauuguggugcaugcccauaaucucagcacugucuccccccaaaaaacaacaaacaacaaaaaacaaaaaaaccaaaaaaaaaaaguuuaaggucaccuucagcuaguuggaagccauccugggcuucaugagauccugguucaaaaccaagcaaacccaaaacugauguuuuuuuauagaugcacauauaaauaaagaacauuaaaaaaaaaaagaaagaaauagggaggaaggaaggaaggaaggaaggaaggaaggauggauggauggaaggauggaugaaaggauggauugauucccaaauggucuauuccuggaucucuuacugaucacagagaacauuuccuucuauuaucauagaaagaaacuuguuccaacagcaacaaaggaacacgcuuggccuugaguugcuuuccucgaggcuggcccacuguucacgcaccuugcccagggcagucagcagauggaagucuauggacucucugaaucgcaggauuugaaggacuccauccaaguagaccugguccuuacugaaacacccuggaagaaccagaacgacacuuacuuccuuucucuucagacggauauuuuaaaauauccuuuccagcuccaguguuuacuaucuaauguuuauagagauacagaaucuguauuuaaaacauucuaguguuuauuauuugagacugggucucacucauuguguagcuuuaguuguccuggcacucacuauguagucuaggcuagcuuugaacucagagauccaccucccuugucucaugcugggaucaaagcuugggccgccaugccugacccauguauaauuguauucaguuaucaucacagcuuaaaauggaggcucucggaaaguaacaggacaggagcccaguacuuugccugaagaacucccuuuaacugcuguuucuuaacuaaaaugacaucuucccccaaauuaaagacugguacucaaaguccaugacauaaaaacaccaccccgcgcacgcacacccaggugagcaugaggguagauccuggugugagcggacugggugagagggaggucuaacaagggcaauccggcaauccggcaauguggggguuugaauguccgauuuuccuuggugugcacugaacaauagcccuguccuaauuccuuuguaaggaaggauuaugacucuggacacgauggcacauaccugugaucccagguuaucugggaggcugaagcaaaaggaucuugagauggagauuauccugggugaaauaauauaauuuuguuuugguugauuuuguuuguuuguuuuuuguuuuuguuuugcuuuuuaagauuuauuauguacacaauguucugccugcauguaugccugcaggcccaaagagggcaccagauauccuuauagaugguuaugugccaccaagugguugcugggaauugaauucaggaagaagagucagugcucuuaaccucugagccaucucuccagccucagauuggagguuucucugcgacuagguuucaggcucaggaaaucucucaagucuguaaauuguuucccucuuaagcaugaagaccugaguucaacucacgucuauuucccaucucagccuccuggagagugggacugcaggcacguguacuaugcacagcuaaagcuauaguuuaaugguuuaaaaaugguaaagcccagauucaucuacacagggaguuccuagucagccaggguuaccaugugagaccuugucucaaaaacaaaacacauagccuaacaugauggguguguagcucaguugguacagggcuugcccagcacacaagagcccuggcuuggaagcccagcacugcacaacccuagaauaguggugcacaucuguauuccuagguagggguaaaaggaucagaaauacacaguaagucuaaagacaaccuggacuaccaaaccuugucuuagaaaagaagacaaacaaacaaacaaaacaaaaacaaaaaacugcuggacauggugguauauaccuuuaauccugaccuuuaggaggcagaaaccagcaaaucucugugaguuugaggccagccuggucuacauaguagagagcuacauaaucaagagcccuugucucucaaacaaacaaacaaacaaacaaacaaauaaacccaaccagcucccugacaaaagacugcaugggaucagaagcaggaacuucugaaagggaacuuuucucauucacacacagaaaccguccaggacggugcaguguucacacugaaaucccagcacuuggaagucucaacacaggggccaagccagccaagcauacgagacccggguucaaacaaaagaagccacaaucaacaugaagaaauccuccugcauggccagagcuuuuaaaaaauaauguggucacacacuggauaaucauugcuagcuuuauuggguaugcuaguaaguagucacagcaaucccugaaacccguggggaaaagccagaugcaauaaaacgcauguguaacacaggucuacugagaagccuggggaaccaggcagccuggagcagguaacuguagagacaggggaggccugccucaguagggugcaaggagagcccugacucuaaaaaguuguccuguaaccucacaaacaugguucacccacacacacacacacacacacacacacacaaaauaaauaaaaaucacccuccuccaaacaaaaccacuacuaccaagguguaguaccaagaauccugggaguugaucucucguccaauucugcacacacaaugcacaugugcuagcacugaguugucucccucuccauggucauacucccuuguuaccaaaagacaucagacagaaggcuaggcaugaagaacauuugccaaguuuuguaucucaagcauggguggguagauggcaucaaagacaauguaagaagaaacugagaagacacuccacagaacgguaaagauauuugucaaucauacaucugacaagagaguuuuaucuacauaaagaccucuugugauucaauuuuuuaaaaaaaaagguaaauaguccaauuaaaauggggggggggggacgggacuggagagauggcucagcggcuaagagcacugacugcucuucuagagguucugaguucaaaucccagcaaccacaugguggcucacaaccaucuguaaugagaucugaugcccucuucuggggugucugaaggcagcuacaguguacuuacauaagaugaauaaauaauuuuuaaaaaagaaaugggguaaaaacaagcagauaguucucauaaagaaacacagugaucaaccaagcaaauuaagagaugccuaaccccacagucaucaagucaacgcacaccaaaacuauaaaagcguaccuucccauagcuacauuguuuuguacuguugaaaguaguaauugcugauuuaaaaaugaaaaucacagauguuggcaaggacgaggagaggaguccugaacacugggauguagcaggcagcguggucaccacccccaaagcuaagcauggucaccaugucccuugccugugcuaccucuacgaagaguaugguggcucaggcuugcaaugccagcacucaggaagcugaggcuggaagauuccuguguguuccaggucaggcuaagcuacgaagugagacucaguuucaaacuuccaccaaaacauccacucgugggcagagucgaguguaagaaaacacgcugcacgcgagcucugacaaacacucagcagcauugcuccugggagccuaacugaaucugaugaaccaagucagccaacagcaaaggaugaacaaccgcagccgcuacagcagggucugaaacguccugcuggccacugggguucugaugauguccaucucagcacucagaggcagaggcagggggaucucugggaguuugaagccaccauggucuacaugguuuguuccagguuauccagggcgaaacaguggggcacuuuagaaaaaaauugaaaaaauaguccugcuaauuagaagaagccaauuauauaauuuuauuaauaugaaauauucaaaacagguaaaucuacagagacaaaagguaaaaaccgcuaaagguguuuccugaaagcugagggagugaagauacaggggaagaauguucauggguguuguuucucgagggugguggagcugguaaacaggauauucagaauuuagagguaguaacugcguggcuugcuaauacugaaaaauaugaggcucgcauuuuaaagaggugaacuaauuguaggcaaaugcuaucucaaauaucucaaaaaccugucuuuaaagucggagaaggauggggaugcucagugguuacagcgcuuaaugcucuccaaaggacacaggcuggguuucagugagguaggucacaccugccuauaacucaguuucuaggagcucugguacccucugaccuaagggcaccaggcauacauaaacucaaaggcacacacauacacauaaauaaagacaaauaagccuuagaaaauaaagaaaugcccccccccccaaauuagcuacugcuuagucagcgacugguugauccagaaugcuguguguucaaucuauguaguuacaagaacuuuuacauuuauuuauucagaguguguguuuaccacaguuuacaaguggaagggucagaggacaacuugcaggagucaccuuacuaaaucuuacuagcccucccugcuaauuggccucaaacuuguauccuucugccccaaccuacugggugcugggauuacauaaacucaucaccuugaccagcucauucuauuacucuuuccagagucuauuggucugaacuguuucaaggggauugggccaaaauaaugcugugugcuauggggcuccacagcaagagccuuugaugaccucaagucacaaacauuucauuaucagauucagagauuaaaacaugacccaaguuacuagcuaacaaauaaaaaguucgaagaccuaccauggagggacacuuaccgggcucagaagugucaguccacccucucuuggcucuuacacaauagucccaucuuguauuaggguccuugacaaacuugccaaugucuuugaagaguucacagaaggacauguggcuggcuuuauacaccguguaguacaggagagcggcccuccacaggaaggggucuuuucugaacaggacacuguggaugcuugccagcccuuccuccguuggguuguugggcuuuagcucauguuuuuuucggccaauccaacuguuccacgguugcugaagguuguuaauaccccgaaaauaaugugugccuacauggaagaaaagguacaaaugauaagaaaugacauccuuuuuuuguuuuuuuguuuuuguuuuguuuucaguuuuucaaggcaagguuucucuguguagcccuggcuguccuggaauucacucuguagaccaggcuggccucgaacucagaaaucugccugccucugccucccaagugcuaggauuaaaggcguguccaccacugccugacuaagaaaugacauucuugcuuugauccuuucccaaagaaaauuugcauucaucuggaauauucuuccucagaguuccaaaggcuaaagccuugucuccaacuuggugcuccugggaggugguaggacccuuaagguauaaggccuggugaggguguagagaagggggccaugagacccuuuccuauccauugucuucucugcucuuuugaccauguucaguggccacaugagcccaccaugauaugcagccuuaccaggcucaagagcaguaacauuggcccacagggagcugaaaccuacagaucaugagcaaaaauaagcauuuauuuuuuuaaguucaugugggcuacaugagaucuggucucagaaaacaaacagauaaauaaacaaaucuccaagaucccaaagccaaaaauggaguggucuuucaugguucuuugacagcaaguguguacucaggacuaaggacgauuaugcaaagaucccagcgacaucuuuuaguguugccaguacaacuggugagcucaccugggaggcaucucagacugggauuccagccauuccaccagcaucagagucccugaaugcagauccugggaacaucacucuggagucaggccuuggaggccaaacaaaagaaacaaacuccuuggagcacaacagagggcuuuguacuaaguauggccugcuccuggugggaugaaaucuuuccucuguuuagaaggcuccaauaucaugagccccagacuccuuuguugccuuuaucccacagaugcaccucuauccaagggcaagucacuaacuugaaaggaaaccauggaugcacguuuauaucuccagauaguuccacuggagaggcacggggaggacauaaccaaugggcccacccaggaggaagaaaccagauucuguuaucaacccaaaucuccugaaggcaguugguuaggauuaccucuucagggaugaugagaaccggagguagaaacaaggcagaaguuuaaggaugggggccucaguuuaugucccugacaauaaacugaaaauaaucuugguccuguccugaacggaggccagaaauggcagaaguuagcucugguuuaggucucagccuaaaaugaacaacacugauuggaggacugagucagucagacaacaguccuuucuggcagcagcuuuagaaccgaguuucuagauucucauaguagaagagugucuuaggguuucuauugcugugaagaaacaccaagaacauaucuuauaaagaagaacauguaauugggacuggcuuacaguuagaggucuaguccauuauugucauggugggaaacuggcagcaugcaagcagacagggugccagagaaggagcugagaguucuacaucaggauguuacacuggguguggcuugagauucugagaccucaaauuccaccuccuaaugacacaccuacuccaacaaagccacaccuccuaacagugccagucucugagaccaagcauucaaacaucugagccuauaggggccauuccuauucaauccaccacguuccauucccugcccccauaggcuuggagccauaaugcagaaauguauucaguccaacguaaaagucuccauagucuguaacagucucaagcuugguuaaaaguccaaaguucacagucucuucugggacucaugcaaucucuuagcuguaaucucuguaaacucaaaauaaaaaagcagaucacauacuuccaauaggauauauauuaccauuccaaaagggaggaaaggaaacauagagaggaaagacugaaaaccaacugggcaaacuccaaacucugcaucuccguaucugaugucaaaaugcucuucagaucuccaauuccucucagcuuuguugacugcaacacacuucucucucuugggcucgggcucguuccagucccuguuagcauacuggggugggggcaggugucccguggcucuggaaucucuaacaccuugggguauccacggcaauccaggcuucaacagcuucacacaauggccucucugggccuccaugcaggggcaccccugccgcacaccuggccucagcaacuauccugguuucuacuguuaugaagagacaucacaaccaugcaguucuuguaaggacaacauuucauuggggcuggcuuacaguuucagugguucaguccauuaucaucauaucaggaaacauggcaucaugcaggcagacacggugcugaaaaaggagcugagagcucuacaucuggauccacaggcacccuugggcaccuugggcauggcuuaagcuucugagaucucaaagcccacccccuagagacacauguccuccaaaaaagccacacuuccuauggccaagcacucaaacacaugagucaauuggggccauuccuauucaaaccaguacacauggguuauaucuauuucccaauuauagccuaucuccuaaaggaugcuggccucuaucagaggaucagauguuauacucgaaauauaaaccuauuuccuuuuguucaagagaauggacuauaucuuuggccauugauggacacuucuagcuacccaaaacauuagaguuaaucuacuugggacagccaauuaccuggauaaaggaccaccuugcagcaaaguggguuuacuuucagccaugcugaagagaugguggaaauaaacauccuuuaagugagauaauguccucugccuucccagaaagcaagccucuaguacagugacugcugcagcagcuauggcgugugcuaucccggaaggacggaugacuucuccgagucuuuaauuagagaagaauaacuuuuccuuuucuuacugucucuucccuaagcaugauugcccucaauuucagauguggaacuaaaaccaaaaggauggaaaugacuucccaagaaugcuguaaaauucuaauuugaaaugacauacagucccugcaaggcuugacaacaucaugaauuuuuacuaaacauuacuaagaaaaaaacacucugaaagaauagcagguaauucuugauagucacaagagugaguagaaaggguaccccuaccuaucucgugccucagcaugcccuccagccagugcucucgugcaguagaaauauugaugguuagagucgggcauccguuuacuaccgucauggaugcccuggaaagcaggucuucggugagaugaacuacaaucugggcagcaagaggagagacacacauacagggcugugagaugacgcagggauaggaugcucaacaucaaggcuggugagccaagcucuccaaaaccaacaugcucccaguaacucucaaauguuguccccuuguccugugacuaccacacacgcuguggcaugcauguucccacauacauauaaauauauaagcauauaauacacacaugcacagucaugcauacacacacaaauguaaauggagaggaaaguuuuugcaaaaaauaacgggccuauucaccuauugauuacccaauucaccuaaguugacgacguguacguccagccacauuugaacugucuaauugguuuuguguuguuugcuuuugaaccuuaucauuuuaacccucugagauuuucauuggauucauuggacugaaaggaaaugaaggaggcugguugugguagcauauaccuuuaauggccagcacuugagaggcaaagacaggaggaucucugugaguucaaguccacccuggucuauauagucagcucuaggacaguuaggacugaaagagacccugucuuaacaaagaggaaggaagagagagaggaagugaaggaaagaaggaaggaagggagggaagaagggagggaaggaggggaggaagaaggaaggaaggaaggaagaaggaaaagaaagaagacagaagaaaagguaccccagagacuagagaaacuaaagcaggaagaaggucugggcugcagagagaauuccaggccagccugagcaacuuagugagguccucuaucaagccaaacggaaaagguggggauagagccucacagcagagugcuugccccagccucugaauccacacaaaacugggaagaucuagagcaugcaugugucagaaaccugcaccuugucagugcugguuuugagacugaugacuaagaacacugcagcaaaaucucucuucaauaauucucauugagaaacucagauaaugcuauugcuacacauacagaaaugacacuaggagcaaaagacagauggcaagaacccaauccaaccaguaaaacagaacugaccaaacaaaaccugcagaaaagagcuugcauuuggcacuaaucuugccccgcccacccauggcccacgccucucccaggccccgcccacccacgaccauaccucucccaggcagccuuccuucaccauguacuuucuaacaugacuccagauucgaguuuuagacaacaagcuaccaccaguagcuuguucaaauuuuucauaacuuccauauuuuuguaaagucagcuccauaauauugauggacuguaaaagaaaggagauuaagucagcagcucaugccacucugagaugaaguuagcuaauuaggaccuuauuugucaagacgcgcucagauuuccugguuaacgaaguuaagcugaaacuccagcugcacauuuucugagcuuaaauaguuuccacugacuuuugaaguuuucuauaaaugccugugaacuuacaagugcccuugcuggcccaguggcgcgugucugaucuuuagcugcuuccuguggggcgccuccaggauacacagugaggccaaccgaaaagggaaaggaggucggggacgauacacacgcucuucuucccugucuucuagucucuuuagccagagauggugcagcugacauacugcacauugcaccuguaacugccgcuaggagaagcuggauagagaggauauuggcuucuugacaagauacauggugguuuggaagaacuccaauguaaaccgaguauggcuccaaaucaguuaguagguuacaaguaccauuuagauaaagggggaaaaacuuaaaaauuuaaaaacauacaagacaaccaguccucucuaacaaucuauaaaaucaccucuguaacgaucuauaaagucugcuuagaaugcaucuauuuauuuacuuguguguuauggguauuucgccugcauuuaugucugggcaccacuuggauacaugugcuuuuuuuugggcaaaguagcaaggaaaauuuauucaagaggcaaacaaaagucccgaucggaaauacaggcagcggagcacaagccugaaagacuacugaagggcaaagcaagcuuuuauucucgugacaaaaaauaauacucuuuggugacagugaugaugaugaggaggagggugacagucuuaaaauauuuccaucuuucgucuagggcaauguacuauccacuucucaucaucuuaaaaaguugagauguuuuuccaaauauacacaaagugaaaacuaauuaaaaaucugguuuaaaaaaaaacacaaauuaucagaaccuccaagaaagccacaggaaacaagacucuaauugagaggacaccugacaauucugugaggugagcguuuacuucgcugcccucugggcaggcgggugggccgcucuggcagauccacccagucugggccccagcacucacacagcagugcacaguggucugugacucauuuccaggcaccuaacaucugccucuggccuccauaggcaucuaugcauucaccacacuuacacacagugaaaagacccauacacauaacaaccaguaaaucuuuuuaaaacaccucauauacagaacauaaaacaaaucuucaauaaaacguaugaaaagaaauccuguuucugggcuguugugagacugguaaggacaguggcgaucugccagcacugagaaggugcgucgaccucugucaucaguaaaugcuaaccagcacauccaugcugauacggguccguacuguacagcacuauaaacaacacaucugauacgucaaaauaggagggaaaaaucacaaugugugagucaacacacgaauacauuaguaaggaaugagggcgcaucauaaaguuaucacaacucaaaauacuccaacaggccuuugcugccaaagccuugcuacucaggagggccaggggcaguggcaggcacuaggauagccaggcuguuguaaacgcaggccuuggcucgcagcuggucuuuaugccuauuaaaucagaaccugguuuuuugcuugguuuuguuggggggggagggggugcauuguacuggcugauuuugugggucaguuuaacacaagcuagaggcagcagagaggaagagccuaaguugaugggcugccuccuccaugagaucuaacuguaaggcacuuucuuaaucagugaucagugugggagggcagggagggcucagcccauuuguggguggugccauccugggcuggguucaauaaaaaggaaggcugagcaaacggggggggggggggguuaggggggcgaggagcaagucugugggcagcgcccuccaugaccucugcaucagcuccugccuccagguuccagcccugcuugagcuccuguccugacuuucuuuaaugaugaacagcaguguggaaguguaagcuagucaauaaacccucuccuccccagcuugcuuuuuagucaugguguuuugucacagcaauagacagugacaccuaagacagugacuguuuuuuugagacagguccagugucaauucacagagaucugcccaccucugcccccugagcaggggauuaaaggcaugcagcccaccucugcccccugagcaggggauuaaaggcaugcagcccaccucugcccccugagcaggggauuaaaggcgugcaacccacaucuggucccugagcauggggguuaaaggcaugcagccaacaucuggccccugagcacagggguuaaaggcgugcagcccaccucuggccccagaaucugcuuuguuugguugguuucgaagcaggguuucucuguguagcccuggaggucuuggaacucaacugaauagaccaggcuggccuugaacucaagagaucugccugccucugcucccgaguucuggggcuaaaggagugugccauaguaagcauccugaaguccauccuaaguuuaaaacuagcacaaggcauggaaauacuucaucuauaaaaugaaaucguuuucucuacaaaugaccgugguugucuuuggugagacggcaaacguucugaacaaccucagugcccaacuaacagaucuucuucagacuauuagcuaguuugguuuuguuuggaauuugaccaucacaagcuacuuccacaguuaugugcuaacaaauacucucucuucucaagugcaguuugauucaguaaauaccuauuuacaauggggacacugauacaggaggaggggugacccugucggaagaggaacgguuaggaguccuggcuucccaguaaggcuccaccacuuagcaaugugguuccaccuuuccugggcuugcucucuucacugauaccauggagauaccaaggccuuuauccuacuuaccuuauggaauuguuauaaggacaaaauggacauggggaaguccgugcucuguaaucuauuucccaaaucucuauaaaguauugacuuugucaggauugcuagacuuuaauuuuagaauuuaguguaaauaaguguuuuuuuuaaagacuuauuuauuauuuuauguaaguacacuguaguugucuucagacaccccagaagagggcaucagaucucauuacagauggcugugagccaccaugugguugcugggauuugaacucagaaccuucagaagagcagucagugcucuuaaccacugagccaucucuccagccccucaaauaaguguuuuauuaggagcauugucuuuccuauguugcuaauauccaacccccaaaccccauuuccuuucuuuuuaaaaaguuguaaaaucuaagauuuuucuccuuaauucugaauaucuucauagacucagaagaccauuuuaccuuagcuucucaaaacucuaacuacaggcauaauccaauuguacccaacaagauagucuuuguguggggguguaaggguaggagggaagacuucagauagggucucacauggccuaggcuagcccugagcuguguagccaagggugaccuugaccuugguuguccuguccgaaacuuuccaggugcuaggaauauaggcacggcauccuuaaacccagccuuuaaaacaguacggcaaggggacagagaggacucagagguucagaacuuuggcugccccugcaggggacccugguuugagucccagcacuuacauggcgauucacaagugucuguaacuccaguuuauggucucuaugggcaccaaguacacacauuuuacagacauacaugcaagcaaaacaccuacacauugaauaaguguuuuaauaaaaaaaaaaucugccaguauuugguaauuauucuggggccucauacacucuaggcaagagcucuagcacugaacuacagcccucauuuucuggcaagcagacuggacuauauacgcggccgagaaagcaugguccugccugugagggacccauccagcagugauuucccaugcuuucugcuguacuugcagagcugugagccaguucccugccuuccaauuccagcccugacuucccucagggaugagaacccaucucccuuacacugcgucuggucuguucucucacagcaacagaaugaaacuagaaguagcccaggcuagcucauacuggagaucuuccuacugcagccuccuaagugcuagagugacuuguaugcacagccucaaaaaguuguuuucagcacugaggggagguaaccacuuagaaugauuuuaaacauuuuccuauguaaugauuauguauuuucuuauguaacaauaaagaagagaagacaaaaggcacaaggaugauaggaacuaaaaagaacagcgaacuagccuggguguagcucaauggguagggcuugccucggaugcuugaagcccaaggucugauuccccagcauaaagcaagcagauagacaaucagaaggucaaggucauuuucccuacacaggaacucuagaccaggcugcgcaucugaaaucugcgcaucugaaauccugucugaaccacaagcaaauaaaagagugagugcucacuggaaaacacagagcaagagaagaguucucccaagggagauacacagcauauuuaaaaucauuuuacaauuuuaaaaagcuuuauaauguaguuauggagagcacacucuuguaaucccaggacuuaguuuauuuauuuuucaaacuguaugugugauguggcagauguaucuggaagucagaggacaauauaugcaguuguucucucccaucuaacccugugucuuggggacugacuaccugagguugucagauuuaguggcaggagccuuucccugcugagccaucucagcagccuggucccaguacuuggaagguaaaagcagagagcucuagaguucaagacucucuucaguccuacuguuaaucugagguuggccuggguuacuagagccugucucucuugugcucaugaagggaugucauccgauggagaacaauugcccagaauguccaagccuccgaguuugaucuccuagaccccggggggcacgggggggggggaugaccacaaacagugcagucuaccuagcccuuaucuguguguuggcuaaugagccacaauucauaauucuaagucaaaaaacagacuagugucuucuagucagagaacacagcgcagaguguguagauuuuuauuacuacaacauaguucucauacaggugagcaaaaacacucccuacaaauuucuuaucacauagcuaccccucccugguggguguugauaauagaggauaugaaggcaucuccuuuugcuuacacaaugguagauaaucacuuuagcuacauaacgauauacauacuacuaccaaagugguauuuuaccugcuuaagaaaccggucagaggcguugcuguguuuggcuaacaccccuggcagagugggauuggcauacucaaacugaggguuguaaguauaguccgacuugaagaaccgcagcuuuuccuucuccagguugaugggcuuuauagcagucaauauacaaagcuuuuucccagaaaugucaucuccucucucaaagcuucuacacagcugaggcuguugcuuuggcuuuggaagccgggucagauugcgucguuugaccuugcuuuuugguuuagguggcagugcuaggccgcuuccuguaauagagauaucacgggugaacuuuacaggacuugguacugagcuaguaacaaaaacagcagacugcccgucuaggcaguaccaagugccagcgccugucccaggcaccagggcugucauccugcuaggaucuuugcuaugagaggagcuaggagauuugcugggcuuccuauguuguuuggagcuggcagaggaaaaccgcuuuugugaacggugcuuuuucuccuccuugcucuguaguagaacauuguaacuacugguuccaguugugaaaguguccuugagaaucccagaggacaaacucgaaaagcuucuuuugcugucagugaucaaugccucuucugcauuuagaacaaacuucuuagcaaguucauguucaggccagugaagcuuuucugugauaauaaacaaaaccaaaacaaagaaacaacagagauaccagaugaagcacacuucggagaagaugcaaacaacccugaagcuucugugaacuuuauaaaccugcacacaucuuuagaaacgcuaguucaagcguuaaaagguccuauuacuaggcuaccauacauuauccacuggaauguucagcuucaagcuacacacguggugacagucuaguaaaaugacauaaaacacacaagugcccugaaugccucacugcugugagcuuuacauggacagacuguaacugcaccagaucaccauccaagagguuaauacaagcuugacauuuggaacuaaauagagagauaaccacaguaaaggaagcaggcugugggugugcucacaccugucaucagaacucaggaaacagaagcaauaggacugucuggggucccaggccaaccuggaguaaccagugagugcuaacccagaguugcacagcaagaccugaguuaucuuaaaacaaacuagcugggaauggugccaaaugucuuuaauccuagcacuagugaggcaaaggcaggaggaucuccgaguucaagaccaguuccaggaucaaguuccagaaaagccagggcuacagagacaaaaaauuaagacaaaacaauaaccaccccccaacccaaaccucaaaaguacaaacuuaacaguacuuuucuaccuuagaaacauucuuaagauuugagagaugaccgcuggaugcagcagugcacgccuuuaaucccagcacuuggggagcagaggcaguggauaugcaugagacugagacagccugggcuacaguguguuccaggucagccagggcuacacagcgagauccuguuuuaaaaacaaaacaaaacaacuauggcauauguguguguaagcauguuuaguaaggucagucacuacuaauaaugugugugccaguauguuucaguaaggucagucacuacuaauaacuggauaagagcuggaauggcagcuuggugauggaauguuugcuauuuccccagcacagagaaacagcaacaauaauuuuuggguggcggagguaguaccacauuccuguaaucuccaaacuugaaagauagaagcaagagagucagaauuucaagguuagacuuagcaguguacuuuuagaccagccugggauacaugagaugcuguugccaaaaaggaagaaaauauaauuaugauuaccagugucaguacaguaaauggcaauugaagacuuugucuuuaagccucgagugccuuaaacaguuaaauugcuuagacugcuugcucaugcaccagcuucaaagcuguuagcugucaggugacucaccaggaaucccugcauuucagagauggaagugggagggucaagagucccagauuauccuuagaacucuaggauagacugaguacaugagacccugucucaaaaauuuaguuucuguccuuuaggaucuuuucuucugcaaagggauaguguauuuggcacaugucucuaauaaaaaucucuauaaauacacacuugaguuguuucugugcagucugcuuuuccccacuagugcuagggaugaacccauggcuucccacauacuaggugaacaccccuccauguagcuacagcccaguccuacaacugacguccgacaccgaagccuuuugauacagcacauggucaucacacagggcagacuccuggcaugcuuugagcagagucuaggacauccuuuuuauaggacaguuacuuacaugaugagauauucuaaacuagcaucaugucaaaguagagcagaaugucacuugguagcccaggcuggccuagaacucacaaugguccucuuccccaggugcugggauuauaggugugugccaccauggcuggcaaaaugucaguuuuaaaguucagaaguuuaguguuuagggugaagaaacaauaccaggucaaagauagguaacagacauucuaaguauguaagauaccuaaagaccuuuaaguaaaauuccuggccuccuguccaguacucacuggagaaguaaggacaggagagucaggucacuuuguggacauagcaagcauaaggccagccuacguuaugugagacccuacuucaagaaaaaccaaaaagcaaaaaaaaaaaaaaaaaaaaaaaaacaaaaaacaaaaguucuuagacaacaggugaaaguuuaacucuagugucuaaaagauaauauaaaaguaugaacuucaccauugcauacacuagcaagauuuugcugaaaggacccagauauggcugucucuugugagacuaugccggggccuggcaaacacagaaguggaugcucacagucagcuauuggauggaucacagggcccccaauggaggagcuagagaaaguacccaaggagcuaaagggaucugcaauccuauagguggaacaacaauacgaacuaaccaauacccccccuccccguucgugucucuagcugcauaugaaucagaagauggccuagucggccaucaguggaaagaaaggcccauuggucgugcaaacuuuauaugccucaguacaggggaaugccagggccaagaagugggaguggguggaugggggagcgugugggggacuuuugggauagcauuggaaauguaaaugaaauaaauacccaauuuaaaaaaaaguguaugucaaacacugguaagacucuauuagccaauucugcaucuccaacuauaaaagaauugucacagauauucaaaugcuaacuugauucagaaaugcauuuucuauuuuccugugauaaugauugaugguauuaagacuucaggggagcgauuucugauaaaauguaagaaucaugagaauaaaaaaugauuaccauaaaaaaaaaaagaaaaaaguaugaacuuguaagggccaaauguaacuagaugcaaauuagaggaggaggggcuggagggauggcugcucuugcagaagaugugggccucauauccagcacccagauggcagcucacaauugucuauaacuccaaucucaggggaugugaugcccucaucugcccuccacgggcaacaggcauccacaugguaaccaaacauacaugcaggcaaaaugcccauacgcauaaacgaaaaauaaaauggaauaaaaaaaauaaaauugauguagcaguuuagauuuuacaggucauguugaagaugaacuguacaaagaugucaucuaagauguuaaagauucaaccagcccaacguagaaagacaaauacuauuuccaucacaggccgguuggugacaguuucucaggaggcucagacuuuggugucgccaagagagagucaaaacugggcuagcaaggcaaccgagcuaacgaacaccaggacaugggcagaacuccaaauguucagcaacacugucaauguccuuaaaaggacacgguucaggagauaaaaagucacacuggaagacaaugaaacagacaccacagggaagcagaggacagaggucagagugcaggaacugugagacucggagcccugaaacagaagagggaggcagccaagucauuuuaucauuccaucuucacagaaucaaguaaaucaaaccauucuaaaaccaauuaauaaaaauuacucugaagaguccauguuuuuauaguuuguuuguuuguuuguuuguuuguuuaagacagggucuuauucugugggagccagacuugccuggaacucauuaugcagcccaggcuggcuuucucccaccucagcccaacugcugggguuacagagauagcuuaccaugcuuggcugugcugaguuuuacaaggugaauauucaauguaaaaauggguugauucugaaaacuuaaaguacucuuaagaccaaggggcuaauugauuuauuuuauuuagucaaaaguaccaaaaaaauccaaauuaaaaccuauuaagacuggaugugguggcacacaacuuuaaccccaggacuccagaagcagaggcagguggauugcuguaaauucaagauaagcccagucugcauaaugagauccggguuagccaggaccacugagacucugucuaaaacaaaacaauacaaccuuauuguguaucagggcacuuuuuaaguagcccugaggcugcagguguacccuaccuuagcuagcauggacgaagcccuggaugcaaugccccagcaccuuguaacagcguagcagcacacuugggaaggagguggaggcaguaagaucauuacuucaaggcuaucuuaaguauacagugcuggagcugagcuuaagccucaaaaaccaaaucaaggggcuggugagauggcucaguggguaagagcacccgacugcucuucugaagguccgaaguucaaaucccagcaacuacaugguggcucacaaccauccguaacaagaucugacucccucuucuggagugucugaagacagcuacaguguauuuacauauaauaaauaaauaaauaaaucuaaaaaaaaaaaaucaaaccaaacuacaaacacuacaaaacuaaagcucucacaccucccccccuugaggaguccauacccucacuuggguaugucuuuuguuuuguuuuguuuuguuuuguuuuguuuugagacaggguuucucuguguggcccuagcuguccuggaacucacuuuguagaccaggcuggccucgaacucagaaaucugccugccucugccucccgagugcugggguuaaaggugugugccaccaccgcccagcacuuggauaugucuuacuucccauggcucuacuuugagaagccauaagugcuuucuugggugugccuugcuuccuucugagugccucucauacccuuguuuucaagccuaaaucaaaacaucuuuauuuagcccacuccugggaggggguaccugggaggaagaggaggaagaggaagaggaggaggaggaagaggaggaggaagauggaaaugcaaauaaucaagugcauaugguuaacauguacagaauugcaaaaaauaaacggaagauagccuauuaaaaacaacaauccugacugcaaaaauaaaguccugccaagucuuccuggaggacugggaagcagcagugcccugcagacccucuccccagcagucccugcaguucagcucucuugucauugucuacugagggccuaggucccucucugcagagucucccagugcgauggugaggccaguccugucgcaauuuauuucccaaucacagaaauucuauuucccuuauauuaaauggaacagaaccagaguugucugcaguggcucauaugucuacucaggagacuuaagucagaaauacugucaugaguuaguuaaaagugagacagaguuacacagcaaagaugugugcuucaaaaaacaaacagacauuauaacaagggccauucaagauggcucagaggguacuuaccaucaaucuugccaaccugaguccgauuacuggaaccccaugguggagagacagaaugacucucacaagucauccccuacuuccagagcacuucagucacucacaacucuuuuauuaaaaaccuggagugccaagaaccuguggcugagaaggucauacacccucaggaacacccugcuaccguuucuuugcuaaguggacugugaauaaauacuuauccugauacccacagaucaguacagcucucugcucucacugcaauagacaucaguuaacagagacucacaccucuucaaaaugcaggacacaugugaguguggacucgucgcugcaucauccccccacuuccaggacccagguaacaccacagaagagaaggugaaaagguuaucgggagggcugcugugaagugguguucccagacacaggagggcugggcgccaucaacucaugguagcuagggcugcuugcacaagguaaagcuggcaaugguugccagagaagagagaccauuuucauaguggucacugguaaagugcugcuucuguccuguauauuccuguaagcaucccuccaaaggccaagaagacaugaagggaaugccucaggagugggagggggugagggauagggcggagaaagcauaacccaaacccacugcauacacauuugaaacccuuuguauacaggcuaaccggguuagccgagcaucuuaaaagacaaauaguauuacuucauuaaaauugcuucucagcauuagcacucugauaaauacacugaauucuccaauacaacaaaagcucccuauguaucuagaacaggagaaaaggacacucagauuccuggcuuccuccccggcucugucaaggacgcucuguaacauuagccuaaucauuaaacccaucggggcucuuguuccuaucuaaaagcaugcaggagaagggacacugcucaguaaacaagcguuucacugcugggaauggcuuagguuucugaaaaguuauaaaguccugacuacaaacgagaccagcaaaaacaacacgcaguggaaaaauaccagcagcugacaaaauggugcuucucucuuuucuuuuuguuuugcuguucugaguuuaucuucuuccuuucuuguuuuugccccagcaucuuguuacuuuguaaccgucuuucugugugucugcgaauggagugaauggaugccacucguguacaguacccucaggugccagaagagaugguucugucccuuggagccagauccugguaccugucaguacaugguggcugaacuauuguccucuaaaacucagcaaguguucuacccugcugagcaaucucuccacuccccuaucccuccucacacacacugccuagcuuuuugggguuuuuuguuuuguuuuguuuuuugauacaaggucucuucuguaccacccuggcuggccuggaacucuauguagagcaggcuggccuggaacuuggagagcugcugucucugaguacaguucuggguuuugaaccuagggucuugcauauacuaacuagcuguucugccacuuagcuauacuccuggccaaaugaaaauuucaugaugcacuaauacuuauuauaaaacccgacaacuuggguuaauguugcaaaaaggaugucugguugccaacaggaauauaaaacagaacaaaacaaaagccccacaguguccaaagagaaacacuuuaauguuauuaaagaguauuucaucucuugcacucagaugauaucuaucaaacaguacuuaucagaauacuagaguacugugcacagaaaauaaaagugaaguuacaagugccagcgcugagcaacaucagguaauguugaacaguggaagcuagaucaaaggaauacaugacuacauuuauauauuguucacgaacagcaaaguuagcuuaggccucuagcuuuugcuucuaauuuuuaggagaggcuaagacaaggggcuagccugggcuauacagugaguuccaagccauucugagcuagaaugagaacuuauguaaaaaaacacugccccaccccugcaaaaagaaaauagagaacaacaacauucaagggaccaaauucucuguccuuucucaaguucuuucccucccuaggcugccuuucuguuuccccuuucuuaagcacgaaggagagcaaaccaauugaaagcagucccacacugcaaagaguucagaguuuugcuguugggaaagccgucaauacaaaaaaauauaaauuguaaccaugacaguuacaucaaggugucaggagagucuggugcaaagugagaacugaccuacuaagugcuuucugaugccagauaaguauauguuagccaagcagccagggagaagaggcaaaccuagggaggcagggaggaucugaggauugguacuacagaagugggaagauuagauggcugugggagacgaggcuggagaggaggagucaaagauauggauggaguuucuccuaaggcucgggaaagauuugugucuguccuuaguuauaagucaacacuugcucaucuccaccaucagggcuaaagugcuuauagaucccuaaccacagaagcaauacaaaauaaguguaacauuagaaggcucuuauuaggguuggcgagauggguaaagaugcuuguugcuaaaucaauucacaaaguagaaggcaagaacuguguacuggcuaguuuugugucaacuugacacaggcuggaguuaucacagagaaaggagcuucaauugggggaaugccuccaugagauccagcuguaaggcauuuucucaauuaguggucaagggggaaagcccccuuguaggugguaccaucucugggcugguagucuugguucuauaagagagcaggcugagcaugccaggggaagcaagccaguaaggaacaucccuccauggccucugcaucagcuccugcuuucugacaugcuugaguuccaguccugacuucuuggugaugaacagcaguaugaaaguguaagcugaauaaacccuuuccuccccaacuuguuucuuggucaugauguuugugcaggaauagaaacccugacuaagacaagcugaauccagaaaaucaugcucugacauucacacaugugcugcagcauguuuauuacucccaacucucucucucucucucucucucucucucucucucucucucucucucucucucucucuccuuccucucuuucucucucuucucucucucuucucucuuuccccucucucucucuuuccucucucuucccccccccucugaaaguaaaaaccaaaugcguuugcacuguuguuaucacuacuaggauaacacugagguacucuccacagggacuuuggaguacaugcucagcauggcgguggccacugggcagcucacaccuacaacccuagcacuugggaggcaaaggcaggaggaacucuaacugaagccaacagggacuacauagugagacccuguuucuaaaaacuaaaaggaaaccaagcauggcuggcucaggccguuuugcccagcacucuggaggcuagggcaggcagaucucacaggaaaaaaaacugaaagcaaaaacaaaaaacaaaaacaaaaaacaugacaccaaauacugggccacugggauugcaugggugaaccgcaaugcuaggauucuggaaguuuuguuuuuugugacaaggucucacagaucccagacuggccucaaacucacuguguagcuaaggauaaccaugaaccccugaucuuccaaauccugagauuacaggugcacccaccaugcagagcugcuugccugaggcuugauggaaaagaacgucaucccagaaagacaugagacacugaaguagcuagcugugguccuuaugagauccuggagacaggacggcugugagcucugcagcagucacagcuacaaagugaggagagggggggaugaggauggaggagauagagggggaaaggagggggagaagagggagaggagaagagaagggggagggaguggagaaggggagagagagggaggggaagaggggaggaagaaggaggggaggagaagaaggagaggggagggagaagggguggaauuggugaggagagagaguuauaagagaugagcuagaacuagaugugguguugcaaccuguaaugccagcacucaggagacuaagccaagaggccacucuguaccaugcagaaaaaaaacaggaaagaaagggacaaagggacaagggacagagggaggagugagagaggaaagaaaauaaaccuuuucugacuugaugccauuucuaagcaacauucuuuuuuuuuuaauaacuuucacuucugugucaccucacccuccuguuagcaguuucacgaggaugucaugucuagaucacagaacgucaugacuaaguaaaacucggguaccauacaaagugauuuuacaaacaacugcuucaguuuuggaauguaaauugccacuuuagucuacauuuauaguuuuuuaccauacuugaacuucugauucucucccuccacaucuugggugguaggguuuuaagugugcacuaccacaccuggauuagcuggcacugggcaccagaagcagggugcuugcaugcuaggcgagcacgcucucagcugggccauccccagucccccagacauguauuuugggacaggcacucacuuaaguuagccaggaagaccugaacuugcaucucccugcugcagcuucccaguagcuaggguuccaggccugugccaccaggcuggcauauauauugcucuuucaaagcaaaaagaaaaaagguccacauuuucaucaguguucuuauugcaaucaaguucuacuggcaagaaaggggcaggggcaucugagacacugcagagugaggggaagucuggauaguacagaucuguuucucagcuacacucuccauaaagguucugguugucccauuuauugauugacagauaugucagcacgaagccuacacaacaggagagccuauauaauaaauuaacaauacuaauacuaauaaucgcuuuguaacaauggugaauguuuaaaaauaccagaaacaaguuucccuaaugcuaguguuucacugccaaguuaccuacaucagaaaaugcacgaccacgaaggucugccacuuguaguccauuaaauucuggugaaagaacugauuuaacaagaguagguguucaguuuaaaaagaauccaucugcaaaccccuggcucuauaggaauacagucuguacugcagacucucaacauaucuguuuccuaauacuauauuuuaaucauaugccauacuaauauuuuaaucauucucucaccacaaugacuuucaguuugggggaaaauaauuuuaauugguguaguuucuaaacccagugacucacguggcaacagaaucuauugucuugcaggcaaugauuuuaacuggaugauagggagaguauuuugccacccacagggcauuuuugguugucacaauucucuguguguuaaaacagucgcucacaauaaagaauuaacuccuucaauauuaaacugcuguggcugagaggccuuguucuauaucauaaaacggaccggaaguuuucauuaccuuuguuaguguacauaagaaugcauuucuuucuggcaucuccuguucgauccuggucucuaguaagcaaguaucccaucagcccgacuacgcagcugcaugcacacggaccacugagucauccucauauuugccacucuucugccaggcuugauguuuuaaagcaacguuuugacauuguauuguuuugggaguuuuguuuguuuguuuuuagagacaggguaucaguggcuggucuggaacuucuguagaccaggcugacuaagcucaccugcgucugccucugauaauguguuuuaaggugaaagaguuauaucuacaucaaaucacaauuuuaaaaagccuaaugccaauuuaaguggccucuaagaucuuggcuuuuauaacugcaugucuccugucaacauaacaguggaauagucuguagguuaucgcaaucgcacaacaguagguucuguguuuuauaacacugaacagcaaacaguguaaaaaaauuaagaugagaaaguaguuucacuuaaaaauaauuuaguuuuucaguuuaaaaaguucugcaauaacauauaaugaaaggaguuucaaaguaccauaaugaaaccucuuacuuuguaugcuaacuuaaagaaugguuuuagcuauugauguccauaucuuagcacuggggagacugaggcaggagggucagggguucaaaacaacuaauuuggaaaauuggucuacuggguacugcaauagccugaagcuaaaaguucuaggcuuauuuuugacucuacugugggaauuagcuauuucccuuuauuccguuguuuugguaucuguccugcagaaauguuuucaugcagaaucaaaugcuaggaaaaugacucuggaacuguuuaauauuauuaaagauuuaaauagggcuaauaugcauaucuauucaaaaaugaaagacaaacuuuccaaccuuggaucuaaacaccugcucuuauuaauaacaucaauucaaaauguuugcuaauaaaugcaaacaaaaauacacaacauacacugaaauguagagauguguuuucacagcugauuuuuuuuuuuucugaacauucuagaaaauauaacaccuuacuacacaccuaaaaugcucuggaaucguauuggacucuacacucucuagauugcacagcucuugccccucaccucugcugggcuagggcugugcgacugcaccuggucuuccgagucccagacccaacggucuccacccgcugcagccgcgccacuugggccagcagugccuacacucacccguuacgcgaauagacuccagcaucgucccgccaaggccaaggccaaggccggcgggccgcaccgacgaaaacucccguaaggcagcucgagaccagauggggcaggacuggcagcgcaagguggaggaccacgucuuacccagaggcuggaaagcgcucuggcgguuccaccuagucucagagcuaagaacccgccacggugacgucgcugcaaccccguugcuaggagacgauccugccuucuucccgcacuccacgccaccaaacaugcucgccgcuggaggcgcuccugcgacugacacccugcucguagggagagaagggaagcgaacuacaacucccagcgugcacaacgcggacccgugcaaggagcugguccgcagaggcugggguguuuguguggggaggucgggaucuguaugaggcucaaagggcuucauuucaugaugguagagggaaauagaaaugguguaauaauucugaguuuuaguugaccagagcaaauucagaccccugaccuuccagcuaauuuacaugguaugaaauaaauagggcgauuuuagaagaaaaaaauggccagguaugguggcacacuccuguuauccaaacacuugagaugugcagcaaagaugaucagggguucaagaccaucauugcuauauagugaauuuugagaccaucuugacuauacaagaaugucua

SEQ ID NO: 4976 - RNA, 4628 nt, Mus musculus
gucacuuguggcuuccgagggauccaugucgucuccccugcuugucucugggggaugacaagagggugcaggggaucuugggacucacuucaccuccgcggagcuuguguugcugcuuggcaggauucugucugcuugggaacguggaaaacuucgaacacaaacaagaccaagagguacuagugguguuaaguguuguuuuuccuugcacggcuguuacuucuguuccagcacuggauucucauccggagggaagucuguggauaguggguucguagcaaggcgagucaaagcccacuuguuggcaucagguaagaaauaucccagaaauuaaucucggauguauaaaugcauuggcuaugcuuggucaacaggacuaacgcucaaugccauguaaugguucgggagauguaggaugaucucuuaauuagaaaggaggcuugcauucaaacaaaccgcuaacacggcguggguagauccuauaaacaccuuugagcggggagugauuuuuaaggaguccauguagcagucacguggaguaagagcuucuuucuccugugacauuucaacaggucuugugagcagagcgucaaaucgcugcucagucugcggcugaagugggagcauguugaugcucuccagugcugccugcaauaggauuaaugguuauccuuucucuuuccuuugcagaccacagcaguuuagauggacuaagcugauuuuaucagcagcuccucccaagcaaggucugcauuugccuuugauuuuucuguauaaacguauagauuauuuuuugguaucucacauugucuuuaaacaucaaauugugucuaauguguacacauauauacauacaucucacuuuauacacacaaauugaaagauacuggagagaaagugggguuuuuaucuuuucuuccuuucucuuauuuuuaaaaauuuauaauguggcccaaaacaggccuggaacuuucuguauauccuaggccaucuuuaagcauaucuugccucagguucccaaauguuguuauuacagguguguaccaccauggaauguauuacuguuugcuaacauuccaagagacaagaaguaacuuauuagcaauaauugagauuggguuuugucuuuucuuuggugauggguuagaauguuauaagaauuaagaacaagagacuuuauuuugaaaaccauuuacaaguuauuuguaagaguuuagggauuuaaaaauuauguauauugguugugguuauaccucccacuuauguuuaugcuauaguuuuaaaaguugauuagauuuuaauauuuuaauauuucagugcauguauguuguugggcauggguaccacagugaagguguggagguuagaggacaacuugcaagagucaguucucuggcaccauguggguccggucaggcuuggcagcaagcaucuuuguuugccaagccaucucacugguccuaugguauagcuucuugauugaaaggcucuuugcaggaagaaaaaaaucuacuaccaguacuguacaguuuuaugccuuucagauacauaggaugucuccuugcucagaguguauguguguacauguguaccacugaacacuccaaucccuucagguauuuuugaaaaguauugaaauauaucaaguuauuauaaaacauguuugcugauuauaacauuuauaaggucuggggguguagcucuuucaauacccaguaagacacacacucaccuguauacacagguacuugugcgcgcgcgcgcgcgcacacacacacacacacacacacacacacacacacacacuuucugaucugcccuuugguugucccaguugaaauugugugccuauaagaccuugcugucacaccuagaugaucaccaccacuucuauuuccgcauuauuuuuacuggguuacaacugacuuuuauuaaaugguuguaguggcugaacacuggcuaaggaagugcauaucuuagagcacuguauuuucccaccaccaagaucaguugaugcuagagcauaagggcuucucugagggugugcgguugagacgucacauuaggaagugaacacaggucuaucugaccacuacuccugugccuuucacgucagcugaaaacuccaauacaagcccuugucauaauggguuuuuuuuuuuuuuuuuuuggaguggugguucaagacaggguuuuucuguguagcuccagcucuccuggaacucacucuguagaccaggcuggccucgaacucaaagaucugcuugcuucugcauccacaguguugagauuaaaggcauucaccaccacugcuuggcugucauauugcuuucaaagaaauauuuguuuaauuuuacaugacuguaccauuguccuggaccagacaacccaauugcuauuuccugaaauuuaaugacagaaacauuauuuggagaaaguuccauaugugaacaacagcaguuuuaggacaacuuccugauuucagagccugccucagacuuucggguuguucccacugcauucuguggccauugauauuacucaguucuacaugugugagucugguuuagugaggguugaaacugccugucucauacauaaaacuuaaguauaaguaagugaccacgugggcagauuucuuaccuucucuguggucagggauaaccaaauaaugguaucuuugugcucuguagaguaaaaaaaaauuuuccuuuaaaauuacauuuauugauuuaugguguguguguguguguguguguguguguguguagaggucagaguauaccuuuggaguugguucuccuucuaccauguuggucccaaggauugaacucaguuugucaguuggggacccacauacagaaagagagaaccaacuuccacaaguuguccucuguccgccacaggugugccauggcgcaagccucucucaaaugugauaaaauauccuuuaaaaagaaaaacuagugauguaggugugguggaggauuuuuguaaucccagccuugagaaaaaccaaggcaagaacauucugaguucacagcccgccuugucacagagcaaguucugggccagcucacgcaacauaggagaccuugucucaaaaaccaaaaaccagacaaaaaagcaaaagaaaugaaaacccuguacugacacaugccuuuuuucauuuccccagaccuuaaauuuuacagcacuauuaguguguacugaaauaagggucugaaacccggacagcgcaugcgcagaagcaagguuugucauuggcugagggauuuaacugcagcuguccuauagcaugcugggacgaggcaccucgccacagucuuggguggucugccuuuucucuggaugcuuuucuuucucaacuccaaugcaccaaaccuguauucaaaucucuugcuaaauuccaacucugcuuggaaagcaagacaaguccgaaacagaacgggaggacuacuugauuaacggauacuuccggcuguguaagagcuuugaugcaaacaaaaugaauuccuccaagcuuuggaauaaccauuagguccuaggagaaagaagggcaagguggagcugugauggagggaaugcucacuuagguugccaggcaugagcugagcaucuucgcauccagaacucagagagcuuccaaaucugaaaccuuagaguccugaugugacgccacgcguggggcguccacgccuaccucgucugacagguuauagucaaaacucagaaacacucugcauauaaucacacucaggccauguguagaagaugcuuaugggauauaugugaauuuaguguuuaaaguuggcucuucucuaagacauuacauaugcaaauauuccaaagucugaaauccagaauggcuggcccuaggcuuccugggcuggggagacucacuguccaguaaauuggaccuucuaauacugcauggagcaugcagcucggucaucugggcgugauguuugaaggggacaggcgugugcauuucuaaaagcuccgggguaccaacacuuugagucucaagacauucccagauguuugagcaggugauaaaguagagcacccccaucuuucgacacagggcagguaggaaaaccaccagcucaauggggucuacaucaugggcaaucaccaccagcugagccuucuuguucuccaccaagguggugacuguauugacuccugcucaguggacagguggucucuuaguugggacguugccuuugccagcaguuuuccucucaucacgggccaguagccuuugcuucuuuucuugcuuugucucuggccuguacuugugggcaagcuuaagcagcagaguagcugucugccuguccagcgccugggugaacugguuaaugguaggagggacuuugagccgcuuguagaggauggcucuuugccccugcagccugauguaguggggccauuugacaaagcguguuagaucucuuuugggcuggauguccugcccaaugucgaaguucuugggccucuucucgaacagaggguugaccaccuucuuggccuccugcuucuugaugacggcgggggcuggggccaccuucuuccccuuggccuucuucccuuugggcgucuugcuuggcugcuggagcaccauu

SEQ ID NO: 4977 - RNA, 1830 nt, Mus musculus
agagaggaagcaggagagagugaguucucuuuggaacgggacaucagagguguaagauguagcugcuagaguuucuggguauuguggaggaucugcaagaacucgccgccagaggaaugggauuuuaauaaggcuuacaacacuagccuuuagaugcugcacccagagacugaguugccauugucucugaaguaaguuuguguugcaauuuccuucacgcggugccucgucuggguucaagagugaaagguacaguggccaagcguagguuugccugaggugcuccaugaaggcauuuaaagcacgggguuguugugguagcgccucaccagugggaaccuagcgaucuggguggagagauuguggaguucagagucagaaucuccacaacauaaaaaacaagucggccauugcccgccagugcauggccagccaggucucggggcagagaguugaggcacaagcauggaagcaugccaguuaguucuauaauauuucccgcaacaacuauuaaaaauugaaacacagagcuuagcacagaaaucuuuuaacaaaauaucuaacuuccuuucaugaccaacuacaacauccucugcucuggaaguacagguacucagagaguguccacuuccuccagaaaaggcaagguggaagagaaacuguaucacaggugcgaauacacaugcacacaugugcacaugcacacagacagacaccaggcaaucagguuugcagguccauacacuuaaccguguguccucagacaaccacaagccucuguaccuugauuuccuucacagaaugagcauccccaacccuuccuucuaaguuacuccugugaaugcauacugcacuuuucaacaaaaauacagcagcaccuacccugagauuauacauuccucuacuuaauuguuuagacaaagucucacaccauagcucaaagguaaccuagcaacccuccugcaucagccgcugagaacugagauuugaguaccaaacccagcuucugcauuaguuucuacuguacuugaaacaucccuccaugguaugggcuucagugguacuuagggcacacauuuccuucuuaaccaguuacuuacagaaggucuccacaaacauucaauucaaaugaguugguuacagagccaccacucacaggagugaaggcuuagguccugaaccucuggacaccacaucucuauugcucaguagauagugucacuauguauuucuguauaaagacacuuuauauuguugacucauaaccacugaacucacggucaggagcugggacucuaucagccugaccaaaacauuucuuaucacguggauuuucucacagcuuccuuguacuuaggaacauuagccggcacuucauuacuucauugcuucauuacuucuuugguuguuuuguugucuugucuugucuugcuuugcuuuuugaaacacagucuaaucguguagccccaacuggcuuugaacauucgauccccugccucagacucuugaguccugggauugaaagcaugcaccacuacuaaccacugccuaggcacgaaacaggaaaugcagagcuggcgagaaggcucagcagggcuggccaccaagccuccugaccuaaguuugaucccagagaacagacucgcacagcuuguucuuguuucuagcauaagaacugaaagaagacaaauauuggccuuggcaucugugggguggguccaguagguuaccauucucgcggcugaagcagcggccacagaagagugaaacacagugagaacacugcuuaugagauuacaacugacuuuuagcaaguggcggguucacaaa

SEQ ID NO: 4978 - RNA, 649 nt, Mus musculus
cauggaggaaaaucagcuaaaccugggcaaaggagauccuaagaagccgagaggcaagauguccucauaugcauucuuugugcaaaccugccgagaggagcacaagaagaagcacccggaugcuucugucaacuucucagaguucuccaagaagugcucagagagguggaagaccauguuugcuaaagaaagggggaaauucgaagauauuugucagcaaaggcugacaaggcucguuaugaaagaaaagugaaaaccuacaucccucccaaaggggagaccaaaaagaaggucaaggaccccaaugcacccaagaggccuccuucggccuucuccuuguucuguucugaguacugccccaaaaucaaaggugagcauccuggcuuauccauuggugauguugcaaaggaacuaggagagauguggaacaacacugcagcagaugacaagcagcccuaugagaagaaggcugccaagcugaaggagaaguacgagaaggauauugcugccuacagagcuaaaggaaaaccugaugcagcaaaaaaggggguggucaaggcugaaaagagcaagaaaaagaaggaagaggaagaugaugaggaggaugaagaggaugaggaagaagaggaagaugaugaugaugaauaag

SEQ ID NO: 4979 - RNA, 4292 nt, Mus musculus
ugcuucguucacucggagcguguucucccuggcgccgccgccgauuugcugcgccuccucaaccgccauguuuacauuggccgcgucugggcacuuccguugucguggacaguagggucuuuuguaugguuuuucuuuuuuucuuucuuuuuuuuucgagacuaccucuacgaucaacugcgcuacuuuugacaaugaaaguccuggggacucggugggagcggcgacuggggcgcgagggcggggucuugcccggacuaaagauggccgccgccagugccgccccgcgcaauuucacgucagguucuggagcccagggagccgcgggguuggccccccgcuccuuacggaauuggcguaaagcugggaggcgccgguuaaagagccuggcagcucuuggaaaacugcccucggggugggggccccgcagaggucgcugggccguggaccugacgucuuugaaagaagaaggcaggugucuguccucgucuccucacucgggugacuuuguggguggguagcgagguuaggcccugcucgccuggacacuuccugcuggucauccccgguggucuggcgcacacaugaggccggcugugcagucuccucacacucccuuggugacucaccuuggucccugcucucgcucugcuugaggaaaugaauggacacacgugaaggaagcucgggaccaguugaggguugaaaggcgggaggugucguuuucugcugucuuuggagcgagccuucccucacauguuuccuagugagaguguccucagcuuugccauggauacucccugucugucuccccuuucuugagacugaugcucccuucgcuguaaaguucacgcccaagcuaagggguuuguauacaaaguuacugugagcacuaaagaaauguucacagcagcagggcucuauccgugaaacaguaucuaccaauggaaucgauaaguuacaguguuuuaaaaguugauacaaagaggacugcuaugugaacucagugaauuacagcuaucagcauuaauauggagaacaauaaugagggggaagcacguugcaaaaauuaucuaguauaaguagcguuuuuagggagguuuuaguuuuuagaugagaagcugugaacucaaagugcaaaggucucauaaaugauacauauaaaguuuaaaauaauggcuacuuuuacggaagaggagauggagugaaacaggaaguguuccauuguaucuuuauuuuucuguccaaguaaucugaagaaaaugugaaagccaaaaguuaagguauguuaaaauuaaguauagggcacauggguguucaauuuucuuguaugacagcacaugcaagggugcuugaaauacuuccaaguagcuuuuuuaaggaaauaaauuuuaucuaagaaaaccaauuauauuguaucuugauuuauucuguuccuacaucuacauuuuuacauuuuaaaaguaucccaccuuagcugucaaccaaucacuguguuaaaauucuaucuuuaauuuucugccucaaaaaaagccauguagcuugccagucggggugcacuacuuuugcagaucucugaguuccaggccagccuggucugggugagguccagaacagccagagcuagagagcgagagagagauuucuuacacgugcaacauugaaaaaauacuauuauugauauaauuuaauauaaucuauaaagaaaauacuugucuuuguuaguaaauuucuuugagaacaagcuuuuaguaggaucugaaucucauuaagagauuggugaauugugagcuuugucauuuccugaaaauggauaguuuuucaauauaaauaacgucaaaguuacauuugugcugucauacaaaguccaccccaaauaauaacuucaguguuuuccauugaaaauguguggaaaugagauuauaccauguggagcuuucucagaaagagauucgauaaccaauguuauauacuguauauauguuaaaaauuacauguaagauauagaaaguaagaaucgugcucauuuuaugaucucucuuugugcugucuagaguauuacauuuauuaauaaaauaauuccuagaucuuaaccaaauucagaaagaggcuugagaaagaaaauccugggcuuaucaaguagguuguuuccaauauauauuuacaauguacucauccaguaaacugccagcuuccucaagugcucauuucccuaguuagcucuucuuuccacuuucaacaacagccucuucagaauuucuccauuauuuucaagccaucucucucacuuauuuuuagaaaacaaaaaagguggggggauauaaaccaauggauugauuccucacucacaagccugccugcauaggcaucugacuuggcaccacggauuaaauacuccacuucccccugccgucucugaagcacauauuucugccucuucaggaacucucaauggauauuuuauuccacucaacaaguuucagcauuuuauccccaucauucuaccuuauaaaaugaugaacuucgucauaaaguuaucacuacucaguuuuucaauagaguggaccauucuuucuuuuuaaaaugaacuucucugcagcauuagagaguaguaaucaugguuuccugaauauauaucacuugauuuguaaaaucacacuuuccugauuuuccucuuagaucucuagcuuuuuuucuuaaucuuccagucuagacuaauuaauaaucuucugccuaucacuuaacaccuagaagcuguucaaacugauuuguucccauuuuuacacauacauauauauauauauguauguauguaaauacauacuauguauuuacuguaugcauaucacuguuuuaucugcauguaugucuguauaucauguguauacauggcacucaaagaggccagaaaagggcaucagaccccugagacuguagugacaaaugauuaucaauugccaugagugcugagaauggaaacuagguacucuggaagaucagccuguaaucgugaccacugaagcaucucaccacaucccugucuuauauuuuaaaaaguuauuuauuacugauauacacguguauguacaccaaauguacagaggacuuuuaggaaucuguucuauucuuucaccacugauuccauucaugaaauucaacaggcuuacccagcaaguguuuuuauccacugcacuauccugaaucccaucucaccuuuaaccauccgacucuuguggucucguugguuucccagaagugguuguuucacauccucuucucuuuuuuaacuauaaaguccacauaccuuuaaaaugucuauccuagauaguccaagguaucucauaacauauccuaaacuaaacuucucauuucauuauaccuguauuugcuucaaaucucuaaaugguaucaucaucaauccaguguauaagccagaaaucuggguguaucuggcccuacccuccuauaguuguggaaacuccaaucagguuuccuuucucaacucuuuguccacuucuuuccaucuccaucucuugccuuggcucuguguagcagccuuucugacuauugcuguacaauuuauaacucauucuucuccuauauccauagugaccauucuaaaccuuaacugucauucuguuuagucuucagaccuggaaaauguacaugauauauuucuucauuucuggccugcucacugugucuuccucucuagacugcagcaagacuugcucucccucucuguaauacucuuaacauuccaguuuccuuuccucacacuuauuugauuuuuaauuucugucucaguuuaaccauuauuucucuaaaagccuuuuuuugaucccccuugauugggugacacacccucuaaacuuccauagugucuuguauuuacucucauauugugcuaauaauacaauuuuguaaauauuugacucccuuccagaggagagcagggauucuugguaacauauauagccccaacacaggguaugguauucauuacuuaauucagcaacuauuucuugagggauaauuguauaguagggacuaauacaguacuuauguguugcgugaggaaucccaacagugaagcggaaauuguguccuugagaaugugggagcuguaaggccgauauuuuaacauacuaauacugacuuuuaaagccaaaauuaaacugaauaugagguuuuauucucuuaaauuuguuucacaugaaaauacacuaguauuuuucaugguaauuguaacagguugaaugcaaauaaauaaagucagcuguuucuuauua

SEQ ID NO: 4980 - RNA, 8069 nt, Mus musculus
cguggucgaauccacugucuccuguuaugugagauacguuucgacccggagcuccgccauuaaaaaaccucuuguuguuacaucaagguguuguguucuauucgugauucuugggugcacgccgaaucgggagcugaguggggcuuuccccacugaguucuuucauuuggaggucccaccgagaucugcgugacacccaggaaccccgaaggaccccuuggaggugcguuuguuugugugagucuuguuauguugucuguugucuaagugucuaaguguggcacugcugaauuugugucuuaguuuuucaguucugagauuguggguuugagccccaccuguguuaccaguucugguauucuguauucuggcagcugccacugcagaccguaaggacccuaguggcugugggaagacgacggucuauuuccccacaggcugcacccuuggaagacauuccgagggagacccuggagugccugggguacggaacagucaggaggaccuggcuguugccuggcagagugaagaagagugagugcucuuccugccagaggaguggagcggaaucccacuccaucagagguagcguuuggcugguuguguaaguccagacgcagacgagugugcuuggaugucuuaguguuuuccgucucugucauuguguuguguuuacucuuauucuucacuaugggacagaccgugucuacuccuuuaucuuugacuaaggaccauuggauggacguuagggcuagaggacaaaauuugucaguaaaagugaagaaaaagccauggaugacuuucuguuccucagaauggccuguuuuuggaguagguuggccagcagaaggaacuuuuuacuuacccaccauaagggcugugaaggccauuguuuuucaggaaggaccggggucgcauccagaccaacaaccguacaucaugguaugggaggacuuggcacgcuacccacccccguggguucgcccauuccucccgccucuccgcccuggcaccaagauucuagccauccgagaaaauggugagaaagagaaaccgaaaccaccgcucgggagagaugaugaucgcagcacaccagugacgaaaccccccaagaucuauccagagauugaagaacccccugaguggcccgauaccccucaacccccaccguaugcuccccagccccaaccuuuagcucccucgggaccccugccucaggccccggccggaggagggggucccuccacaggaacaaggagccagcgaggagucaccccugaggggccugcggauucaacuguggcgcucccccucagggcuauuggggcucccccugccgauccaaauagucuacagccccuacaguauuggccuuuuuccucuucugaccuuuacaacuggaaagcucaucaccccccuuuuucagaaaaaccugcaggacucacuggguugguugaaucauuaauguauucacaccagccgaccugggaugacugccagcagcuucugcagacucuauucacaaccgaggagagagagaggauucuccucgaggcucggaaaaacguccgagaugaggcugggcgcccuguccaaacuccagcugagauagaugaaggauuuccgcuaacccggccccgaugggauuauaauacggcaucagguagggaacgacuguccaauuaucgccggguccuaguggcgggucucagaggugcugcccggcagcccacgaaucuggccaagguaagagagguuaugcagggagcgacugagccccccucagucuuccuugaaaggcucauggaggcuuauaggagauauaccccauucgaccccacgucugagggucaaagggccucaguaauuauggccuucauuggccagucagcuccugacauuaggaagaaguuacagcgaauugagggcuugcaggauuacaccauaagggauguaguuagagaggcagagaaaguguaucauaggagagaaacagaagaugaaaaguuagagagagagaaaagagagaaaagagaagaggaggauaggagagacaggaggcaagaaaagguuuugacuaggauccuggcugcaguaggagaaagagauaauggaagaagagguagacagucagggaaccugggagacaaaaggcagcagggaccaaggagacccagagaaggcgggcagcgccuggagaggaaccaaugcgcguauugcaaggaaaugggccacuggaagagcgacuguccgaaaaaaaaacaagagguaaaggugcuuucucuuggagaagaugaagacuagggggaacggggcucggccccccuccccgagccuaggguaacuuuagaaguggaggggaccccuguggacuuucuaguugacacgggagccgaauuuucaguacucaaaacaccucuaggaaaaguaaagaaaaaugaaaaaaccuuggugaucggggccacgggacaaaaaucguauccauggaccacaucccgaguaguagacauagggcgaaaucgaguaacucauucguuucuagucauuccagaguguccuaugccuuuaugggggagagacuuacuaaccaaguuaaaagcacaaauaacuuucaccucucaucgaccggagguuuucuggggaauaaaagcgccccagacucuagagcugucuuuacaacuaggggaggaauaucgacuuuaccaaaauaaaguaaagcccccugagggauuacaggacugguugaauugauacccccaggcgugggcagagacgggaggaguggggauggcaaaacuggucccccacguggugauugaacuuaaguccggggccaccccuauagggguccgacaauaucccaugagcagagaagcucaagaggguauacgcccccaaauuaacaaacugcuccaacaagggauuuuggucccaugcaaauccccuuggaacacuccucuacuuccaguaaaaaaaccagggaccagggacuaccuuccaguacaagaccuuagagaagucaacaagagaguucaggacauacacccuacggugccaaauccuuauaaccuccucagcaccuugccaccuggucggacaugguacacaguccuggaucucaaagacgcuuuuuucuguuugagguuacaccccaacagccagcccuuguucgcuuucgaauggcgagacuccgagaguggacaagccggacagcucacauggacgaggcugccucagggauucaagaacucgcccacuuuguucgaugaagcccuacaccgagaucuugcucuuuuccaagccaauaacccacaggugacucuucugcaauauguagaugaccugcuccuagcugcagaaacacgcgaggacugugaaauugggacccaaaaccuccugggcgaguuagguaagcugggguaucgggccucugcuaaaaaggcucaguuaugccagauagaagugaccuaccuaggauaugucuugagagauggacaacgguggcucacagaagccagaaaacaagcuguuaugcagaucccgaccccaaccacugcucgccagguaagagaguuccuggggaccgccggguuuugcagacucuggauucccggauuugccacacuggcagcucccuuguauccacuaaccaaagagaaaggggaauucaccuggaccagagaacaucagcuagccuuugaaacucucaaaaaggcacugcugcaggcuccggcauuggcccugccagauuuaaacaaaccuuucacccuauacauugaugaaagaaauggaguggcaaggggaguccuuacccagguuuugggaccauggaagcgcccaguagccuacuuaucaaagaaacuggacgcuguggccaguggauggcccuccugccugcgagcgauagcagccacggcugugcuaguaaaagaugcugacaaacugacuaugggccagaauguuacuauaguggccccacacucucuugagagcaucaucaggcaaccaccggaccgcuggaugaccaacgcccgaaugacgcacuaccagagccuauugcugacagagcgaguaaguuuugcacccccagccauucucaaccccgccuccuuacuaccugaggcugacgaggccccugcacauaagugugaagaaauacuggcagaagagacuggaauccggccagaccucacagaccaaccuuggccaggggcgaugacuugguucacggacggaagcagcuuugugguagaagguaagcggaaggcuggggcggcaguaguggauggaaaggcugucauaugggccagcagucugccggaggguacaucagcucaaaaagcggaacuaaucgcauuaauucaagccuuaaggcuggcagaaggaagggcucuuaaugucuauaccgacagcugguacgcuuuugccacggcucauguucacggagcaauauaccgacaccauggacugcugacgucugccggcaaauauaucaaaaauaaagaagaaauucucagcuuauuagaagcuguacauuugccccguaggguggcaauuauccauugcccaggacaccagaagggaacugggcccguugaaaagggaaaucaaauggcagaccaagaagcuaaaaaagcagcccaagggcgaaugacucugguggugagaacccaacagcccgcugcugaggaaauaaauaaaagaacccucacagaagaagaggggcgagauuacuuagcuaacauacaccaucugacucauuuaggaacuaaaaaauuacuaaaauugguuaguaagucccccuauuacauuccuggauuaaaaggaauuguggaagagauaguaaaaaacugccgugcuugugcacuuaccaacgcugggucuagcaggcuccaggaaggaaaacgacugcgaggagacagaccuggagccuacugggaaacugacuucacugaggugaaaccggcuagguauggaaauaaauaucuccuaguuuuuauagacaccuuuucaggaugggucgaggcguuccccaccaagaaagaaacggcuaauguaguggucaagaagauacuugaagaaauccuuccccgcuuugggauaccuaagguaauggggucagacaacggaccugccuucgucucccagguaagucagggauuggccagacaacuggggacaaauuggaaauuacauugugcauacagaccccagaguucaggacagguagaaaggaugaacagaacgcuaaaggagacucugacuaaaauagccuuagaauccggcggaagcgauuggacagccguucucccuuaugccuuguucaggguucggaauacaccuggaccccuuggccuaacuccauuugaauuaauguauggggcgcccccacccauuuuuaugaccguagaggauaagaaucgcccggaugugucuuucucuccuucuucuagucuuuuggcucgauuaaaagcucucgaaauaguaagaaaagaggucugggaacagcuaaaagaaaccuauguugcuggugacacacaggugccacaucaguuugaaguaggagacgcaguccuggugaggagacaccgagcgggaaaccuagaaccgagguggaagggacccuacuuggugcuacugacaacgcccaccgcggucaaagugaaaggaauccccacuuggguccacgcaucccacgucaagagagcacccccuggagucagccaugaugaguggacuuuggagaagacuacuaauccuuuuaaguugcgccugcuucguaggagcgaucccaaaagacuucaacccccacaguccuguucaacaaacgugggagguacucaaugagggggguagggcuguauggacaaucgccgagguacacccucuguggacuugguggccugaucuuuucccugacaucuguaaguuggcuauaggagccccuccuggaugggacuuggagggguacucugacauucagagggcaccuuuaacacccccuccguauguagaaaaacauucgagagacccauggggugguugcucuaaccaaagggauagaaguaugcuucgaacccaucccuucuaugucugccccgggccccaccgaagucagucccucaauccaacguguggagguaaggcugacuucuuuuguaagagcugggguugcgagacuucagguacagcccgcuggaagcccuccucgaguugggacuauauuagaguaacagccaacuauucccuagcgucuuauguaccuggaggauuugacuuagacgaguguacugacuggugccauccgcuccgugucaccuucacugaaccagggaagagagcucugggauggacaaaaggguauaccuggggucuuaggauuuacaaggaaagauaugaugagggauuauuguucacuaucagauuaaaaauagagacccccuacaaucccuuaggccccccaaccaaguucacaccccucacccauacaauuacucagccuacuccagugauugcggacccccuuaauauggccgcuaucacccaaccucccacuccucagguaccucuaacuauuacccccgagauuccuucaagacagaggauguuuaaccuagugagaggagccuuuuaugcccuuaacagaacugauccaagcgcuacugaggacugcuggcuaugccuguccucggguccuccuuauuaugaaggaaucgccuucaauagaaauuucaacagaaccagcagccauacuuccugcucuugggguacaggacaaaaacugacccugacugaaguauccgcaaggaauccaggucucuguauagguaccccaccuuccacucacaaacaccuaugcggacaaauucaguccguguccagaacggaagcugauuacuaucuuguaccuuccccgguuggauggugggcuugcaauacaggacuuacucccuguguaucaacuaagguuuuuaauucaucucaugauuuuugugucaugauccagcuguuaccccguguauauuaucacccugcauccaguuuagaagaaagcuaugcgggccggcggucaaaaagagaaccaauuacuuuaacccuggcugcauucaugggaauagguauggcaguaggaguggggacgggagugucagcuuugauagaaggaagacagggaauucagucuuugagggaugcugucaaugaagaccuagcggcaauagagaaguccauugacgcuuuagaaaaaucuuugaccucccugucugagguaguuuuacagaacaggagaggucuugauuuguuguuccuaaaggaaggaggacugugugcugcccuuaaagaagagugcugcuucuaugcagaucauacaggaauaguuagagacucuaugcagaaacugagagaaagauuagagcgaaggaaacgggaacgggaugcucaacgggggugguuugagucgugguuugaaucacgaccaucuuggauaacuucuuuaauuuccgcuguagccggaccaauccuuaugauaugcuuagcuuuaguuuucggcccuuguauaauaaauagaggaauggcuuucauccagaguaaaauugauacaguaaaacucaugguucuucaaaggcaauaucaaccuauaguucagguagaugaagaguuaggggacaccaaucucuaagauucuaugauuagaauuagucuaaacagaagaagaggggaaugaaaggaaauaaaacuguaauucauguaauguauguuaaauagcccaaagaguuguuugugagcuuugaaaccuggggcugagaacacagcagaacagaccaggacaugcccgggcaagcccaucgccucccuagcucccaccccucugaccuaaguuaaauguuacaggcugcugauguuuaaauggaccaaucaugugaaaccgcgccaauuccuuccccagccccacuccuuuucuauaaaaaccccuagcuuccaagccucguggucgaauccacugucuccuguuaugugagauacguuucgacccggagcuccgccauuaaaaaaccucuuguuguuacauc

SEQ ID NO: 4981 - RNA, 2453 nt, Mus musculus
uaugccuaaucagggagaagacugcuauuuuuauuucuauucuacaugcgccgaaggugacagcugcucauuccgucacugugaagcugcacugggaaaugaaacuguuugcacacuauggcaagaagguccuuguuuucaacaagugugcagauuucaccacauggaaguugacaaaaaacaaagugaaauuccuuguuauugggaaaaucagccauggugaugucaaaaaacuaaacugugcuuuccauuacaccagaagccacuauguugauggacucuucauaccuccaagcaaaacuguguuacccacugugccugagucucaagaagaaguaaagauuagccagcuuuacaguucaacagaacaaauuguucagucuaaccccuccccucagcugcggaguguaaugaaaguagagagcucagaaaauguucccagccccacacauccgccuguuguaaucaaugcugcagaugauaaugaagaugaccaugaucaguuuucugaggaaggugaugagagcaagacaccugcccugcaaccaacuccugacguccauaauggauuacgaguggcuucugcccgcaaaccuggagucaguuuaaagcaaggugaauguuugaauuuuggaauaaagacucuugaggaaauuaaaucaaagaaaaugaaggaaaaauccaagaagcaagauagcuccucgggaguuuccaggguuuuacaucagccucaguccaauccaggcccugagaggagaauguuugggcugugaugaggaugguaacucuaucaagcaaaccagaagagcccuugguuagacugagucuuucugagagacuggggaaacgaaaacuuucaguagguggugacagugacccuccauuaaagugaagccuugcacagagacuggggaaaaaaguggaagcgccagaaacuaacauugauaaagcaccaaagaaagagcgaggucauaaagcuggggagauccaugugaagacacuggaagaaauucuucuugaaagagccagucagaaacuggagauuugcaaacuaaacugaggacagaagaaccuucaggagcugaugauucuccaucgggaacaaaaaguucuucuucagugcggaucaaaaccuucuuugaaguccuguccgaaaagaaacaucggcagcaggaaauggaaagacagaaauccaaaaaggauacaaguugccucaugcuaacagaagacacugaagugaaaaagacagugagucugccgacuguugcugauagcaaaggacaaccagaggagucugcaggaagagccaggucuaagcaggaggugcauauuaagccacuagaggaaauuaagcuggagaaggcccagagggugcagcaaagcucugagaguaguggcaacuccugaccucaagcugaggcugccucagggacaaagaggcugcacggaaucaccaagagagcagguacaaaagaagagaaaaacaaacaaacaaacaaacaaaaaccgugacguugaagacaguggugacgcuccaucucagagcagugugacuaagauggaggcuaaugagacuucagaugagaccauaagugaucccacaaaacuuccagucaacagaugugacacugucaaagagaaacauacacagagacugcgggagagaggagcaucacaaaaggagaaagcagccuugucaucacagaugacaagaaggggugggggggaggugggagaugaggcuucuuauuauacccgagugguagggaagccggugcucacugcuuaucaggugucacuccgcaccuggcaaaacggcuccccacagagucaucccagaaaccggagguagaaaccucuggaaucugagacucaauacugaaugugaaaugcgcagcacagacuuuggagaagaggaguaaagccaaacccaaaguaaaugugaagccaucuguagucaagguugucucagcucccaauugacuggcucccaaacgcaaagcuguggaugugcgucaucgcagccgugaagcugcucagcuccagcaguguccugcaggaaagucccaccaggaaagcagcuguggcuguugucccacucuucccugaggauaaauccgucaccaugucugugacagaaaacccgaaagacaguucugugcugucuucagcccaagcgucuucagaacccuugcucccaccagaaggcucuggcccuuccucaucccagacagcaacaaaaccgugccggcugagcgccgccuccacgggaaagccuccacucucuguggaagaugauuuugagaaacuaauaugggaaauuucagggggcaaauuagaagcugagaucgacuuggauccugagaagaugaaggugaccuucugcuugagcucucagagaugacugacagcugaagcccaaggggauaaugaggacacucaaaaacaaaaac

SEQ ID NO: 4982 - RNA, 25434 nt, Mus musculus
aggggggcggggcgggaacggcuaguucuggccugggcuaagaggccuggggucugagauucgaaguuuacauggcgauguugcgguccggauacaggcgcuuuggcugucugcgcgcggcacucaagucccuggcucagacccaccaccggagcaucaccuucugcaucgaucguaaggcucaucuaggcgaggggagagugggucuucggugggcaucugugcccgcccgaguucccagcgcuuugguggcucucgggcuucgccugacaccgaucccucucgggucccuugacggacucacuucauccucugacucugcccgucugggacccacuucucucuccccgaccaguccuguuucacgaacuggcuuccucccauaacucaggaucuacucucgggaccagcucuuaauggucccugugaccagcgcucaguccaguccaguugccugucccccgaccccgccaaugcuuuucaaagacgaaggaacgugugacuuuggcaauagauuuccaagguagaaagagcuaaguauaugagcgcugguagagauaguugaaaagcuccagguuauaccguauguuuugcucacaaguauagauuucguaaaaacacucauacuguagaaacugcugcaggaaaaagaaagauaaccgcaauugagaaacccuaucugagauuacaaacugauuguuuaaaaaccuggcagaaaacuugcauguaacugggaguguuugccacccaugcaaaccaagccaaauauuuagauuugucaaucacuuuaaauaccaaacuaaaaaccagaaccaccuuuucuucugaaacaguuuuuaaaauaauucuaaauuuuauuuuaaauaagaaucuauuauuuauggccuuauggcuuugaaaauugagaacagaguuauaaaguacauggaggcauagacugguuuuuuguuuguuuguuuuuguuuuguuuuuuguagaaaaccaguuuuaagaguuacugcccuacuuaggcaccuaaaauuggguaaacaaaguagcgugguuugguacuaaaguuaggaaagagucugucccaguaacagauuuacguuauugauuguuguuuugaccugggcaacuaagaugugugagacaggcuuuauuugugcaacugugacacuucuggagcuagcuuuguagaccaggcuggccuuaaacucaggagagaucacuggugccuaucucccaagccuuggcuguaccaccagaguucagcuugcucucuuucacuguuuuuaacgaaguguuggaguuggggaucuagcucagucagcuugaaugcuugccuaauguuuucauucaugcagcccuggguuccaaccccaguauugacucggccugccagaccugccauggcauaugacucuaauuccagcacuugugaugaggaggcuggaggaucaggguccagccucaaguuacauacaaagaugaaggccaaccuggacuacaugagauccugucuuaacaacaaaaaauuauuuuugaguuguucaagauacuuuucuacuuguagauuugugugccacgauagugggugggcuggggugcuuagcuguguaguaagcauucauuggggguuucuuacccaccuuaggucauuuaguucccaaauaaaugacacgagaccuuaauaaauauuauggccauagguuuucuuccuuucucuccuggcucccucucucccccucuucaucugugccucaaacaccaacccugggaacccugggaacugaagcuccgccuaccucucuucuacccagcuauaggcuguagacaucuuuauucaaccaauagcuuuaaauuaaggugcaagguuugcacaacaaaagcuggcauaggugagagaauucucuugaggcaacgugaccuugggauacauaauuuagcauugcagcauuggaggccaggagucacccuacaaaccacacaaacaccaaucccagccagacagggauagauuauugaacacacauguaaagacugauugauuagggcaagagcugaaagcugcauucuugugcauuguccagggucacuuuaugggggggggggguggacaauaacaaacuaagcagaugcaggugcagggugguuggccuuuucucaagguuuuuaguacuuuagacaauaaucuugacuaaccuuuaucuggcuuggcucugaaugaaggcuacaguugguaaaucuagcguggcucugagugaagaccauggcuagagacuuccccaaaagaguccuaagucucugugguaguuugaauacacuaggccaaugggaggugcuacugguagaagguguggccuuauugaaggaaguguucuagcuccacccaguguggaagagucagucuuuuccuuguugccuuuagagcaagaaguagaacucuuagcuccgucuccaacaccuugucugcauggacacugccaugcuucccgccaugaugauaaugaacuaaaccucugaaacaaaugcaauguuaccucuuaaaugaguugucuuggcuucacagcaauaaaacccuaagacagucucauaaaaggauauguggucagccugaccuugcugugagccaaacuauuuuucuguaucuauagucaggcuguuuuuucucuuuuuucuuuuucuuucuuuucuuuucuuuucuucuuauaccagcaauaugagauggcugacaguccugaagcagaauggcuacaauuaugccaggaaaguaaugccagggaagcagguuucuacaacaguacacagcaacagaccaaaucucaggauuuagugguggcucacuugagccuaugcaagguucuagauuuaaucucagcacuacaaaacugauugaugacuacuacccacagcuauaaauuguuuuguugguuuguuuugauuuuuuuguuggggauuuuuuuuuuuuuuuauugucucacuugguaguucaagcuggccuggaacuuuguaguucucgauauacuuauuuuaaacuugaagcaugagccacaugucuggcugcucauugcauauuuuaagguuaaauaauuuaagagaugcagccucacuucauagugggcuguaacacuaaauuuagaaaagucaccgagucucugaaauaauuauuuuauguuuuaauuuuuuaaucauuauuuuuuuuagauagggucucucuacacagcuguccuggaacucaguauguagaccaggcuggccucaaacacagguccuccugucuccugccucuguccccacgugcuggaauuagguguguaccacuacuccugagccagagcucaacagcuugguuugcugcagcugucagguacuccuugaauaccuggauucucagggccguugucucucuggcuuuauuacauuugaagaucuugauguuauuuaaagguuuuggggacacuaccuuuuguuaguaauaaagacuuuucuaauuucccuuggucuagugguguuuuuugcaaguucuuuguuguuauuguuaguuuuugcuccuaagacagugucucuccauguugccucagacuggccugacacuugcaguucuccuuugucagcuucccagugcuuugacacaccuaccugcccauagcuaccuguucugcuugucuaccgaggcucacacuuuuuuggacgcuuguguucaugcuuugaacucugcccuuaggguuuuauuguuuucugacaauugguguguuuuugcuuagacaauguaguuuacgcuuguuguuguuugcauuuuagagucagggugucacuguguaccccagccuguucugagauuugcuguguagugcagauggaccuugaauucaugauccucagacaucucucuaguccugggauuauaaacaugacauuguacuggcuucaguucauuauuuaacuugcuauccaucauuuccuuuucugaauaucaaauguaauugcuauauaagaagaauuuguggcuacguuguauuuacuauauacugacuacauauaacuuacauaaaacuacucuucugaaaaggaaauccuaaaacuuuuaagucuuugguuggcugaacuguuugucuuaggaagaagccuuuuacuuuguuguaauaaaauaaagauuuauuaauacauauuaaaacuggacauagugacucauaccuguaauccuagcauuugggaaucuuaggaguagucuuaccucaaguuuaaggccaccugaacuauguaauaaauugcaggccagcuggaacuauagaguaagacugucucaaaagcuaaaagcaaagacucuguauugaacucuugauagaaauaaaacuuagcagcccuucuuuaugguuuaaggucuuugaauuauuaccauguaagagugugugcaugucugugcacacauguucgugucuucauguguacuauguucaucuuaguaacaccagcacugccacacaguugaugcucgauaaauauuuguuggguacagugguacugguguucaaacuucgggaaccgcuguggcuggacagguuccuaccagggaaguauggcucaggugcauauuguuuguuguuuaaauagugaauuuacugcaugguugcuuuuugcuuuuaguuuuuguuuuuguuuuguuuuguuuuuuucuacaguugugaguuuaauccagggccuuaggcacgcuagacaaggcccaccacucagcugcauccucccaauucuuuuguacauaagcuuuuaacuaccaucuggagcagcagcacuuguacaaaaaaaaaaaaaaaaaacaaaacaaaacaaaaaaaaaacauaaaaaauagccugacacuugccccaguaagaaaaccgugaauuauauugucccacucaauauuccuaagaguggucccuucagguuucuauuguaggucuuuuagggaagacuuugcuagaauccucacaacccuccccaccuugauuacaucccuucuaccccucauaugcuuuugaggcagagccuuacuauguagccuugaauauucuggaauuguauguagaccacauuggccucagacucagagagaggauuccuagaugaugggauugaaggugugcaccaccaugcuaggauucccuuuuaacuaagagugaugcccagauguuccccagaggaacaaacuuugucaaccucacuaugugcuaugggaagagccuugcauagccaacaggcaccaaagcaaauuauugucauuauggcuugcacuuuuccuuuaagucuauaucuauaccaccucagaugugccccaucucuuccucauagcuuuucuuuaggaucuguuagcauuguaaugaccaaaguuuuagcauugaagggccugccccuccccccaccugagccaucacuguauccugauuuuuacuggaccuccaaguguagucgguaugcacucauucuuuccuuugcuuugcaccagcacacccgaggcagugguucucacaguagaagagaaaggaaugggaauaguauaggccugugcaaucaucuaugaguugcugguucugcuucagugcucuggcuucuggaauucauucugucuucuuuucccgucuuaaaaagucauuacuuuuucacaguguugccuaaguucauuguuuuuagugucugccuugucucuggaaaucugcuuuaucuuaaaaaauauggaaaauacucuaggcuuucgugacacucuuguuuuccaauucaauccuaccauccuuacugaauguuuaccuuaccuuugagaauauuuguaaaaauucaauucugugcuuuacugcuaggggaccagguuacuuaugauguauagguagguagcgucucccaccauuuccucugcagagauucuguuacaauggagucuuuguacauuuuaggaguuucuagaaaaauuucccauccgucuauccuauuuaacaucaugacuuuacaggucauucuuucaaguuucauuuuucucaguccaagaaaugaagcagguacugagucauaucauaguaguuaagacaggaaacuuucuaagaauucaacuuaacuguguuucaacauacgaaagguuuuguuuuuguuuuaaaucaguguuauccacauguuguaugcccauauuauuccauugcagccuugguaggaaauuaagccaacguauacagauuaugauuucuuaaucgauguuauaaagugaacauguugguggaaacaguggcugcugccaaauaugcagagaggaugggaauuuuuccaaggaauguuugcagaaaaacuaggacagcgcauccgaaaacacggcacacgagagcaacugcagcccauccgaaaacacggcacacgagagcaacugcuuuuuuuuuuuuuacuuucuuuuuuuuuuuuuuuuuuuuuugguuuuguuuugugaugcugaacuugaacagguaccucaacuaagcaacacuuugcuuuggguuguaucaccgcccuucguuuaaaggaaaaaaaaagcgggggggggggauuuaugaggaggaagagugaaacaauuuugaaaacaacaguugaccuacuuggaauuaaaagaagcaagaugacuuagugagguaaugggaccugccacugagccugaugacaugaguucagcccccauguuuaaaacuuguccucugaccuccauaugcaacacaggcauguguguacauacacacacacacagacacagacacacacagaauaaauaaauaaauaaauaaaugaaaucccuguuuugaaaggaauggugauggaguuuggugaguugguauccuuauguaucuugcucuucccagaaauguuucacaauauggcagagugggauagaagauaggaguguuuuguggcuagauaguguuuuaugcauccugguuuuuccuguuguguucccugaggccucuaccuaucuacuuauaagucugucuuaccaaggaaccaaggaacagaugucugggaguagcuauguuuuaucuuaggauacuauggguaagugcuagaaagaucacuucuccaccugggaaacugguaaugauccuagcuuagcacuaggauagcagaggcaggauggucaggaguccaaggccagccuggacuagauuauaagacccuaucucaaaaacaaaaacaaugaaacacuuaguagguggcuccauucucuacuaggaugugucuaggaaaugcuuuaguagguccacucuuagcuuugaggcacuccuuaugagugaaacucuucucucauuuccauccuagaauugaauaugucugguccuguucacagcuuccuuggggcuaaaugaagaacagaaaggauuucagaaaguggccuuugacuuugcagcucgggaaauggcucccaauauggcggagugggaucagaagguaagaguguucucauggcuagauguuccaacaaaugcuguauacaaugacuuaccucucuacaguccucaccgcuuagugccugccuucuacccaccaacuccacugcaaguguggagaucggugauagaugugcuggauaguuuuaugugagcuuaacacaagcuggaaucaucagagaggagggagccucaaaugagaaaauguuuccgcaagauggggcuauagucaagccuguagggcauuuucuuaauuagugauuuaugagggagccaauugugggugggucaccucuggacugguaguucuugguucuaaaagaaagcaaacugagcaaggcaguaagcagcacuccuccauggcuucugcaucagcuccucccuccagguuuccggccccuugagguucuguccucacugcuuuugauggugagcuguuacauggaagcaugagugaaguaacccuuuccucuccaaguugcuuuuggucauucuguuucauuacugacuaggacaguaaaugacuccuuucuuggaggccaucccggauguacugagacggcccuuuucuuauuuaauuggacagacauuuagacguaccuaaaauuaaagcauuucuauagaaaaaaaauuggcaaacauuuguuaauuggugcuacuauaaaauagcaagggcauucuucauuguccccucuaaaggaacaccugucucagaacuggucucugaccacuuccucucuuugcuaugcaggagcuguucccuguggaugugaugcggaaggcugcacagcugggauuugggggggucuaugugcgaacagauguggguggaucuggacugucucgccuugauacuucugucaucuuugaagccuuggccacaggcugcaccagcaccacugccuauauaagcauccacaagugagcauccgugucuaaaagcauggugaagggcugugcucauacagggugguagggaaacuucacugagaaaaagaugagucauggugggcugauuguccuugggaaacuaaacuguuauugguacgcaguaggucuguugcugccuguuggauuugauucuguugccuucuauggcaguacuuaaagaauugguucucucacauuucaguuuuggcaccagcagacuucucuaguuguccucagucuauagcugagaccucccguaauuugagaaaguaagaggaaguacauuugucucugauuuuuaggacuuacuugucugagaagccccugggccucugguauagguuccagggauguuuuuagaccagccccuuccuuucaaguugcgucaucucauuugucucuuuccccuucccacucucuccugcuuccauucugccuugcuguccuuuguuucucuccccaccccccaccccccaccccaaucuucuugucugucuuuacuucuguccauggcuuuucuucuugguguaccuaucagcaugugugccuggaugauugauagcuuuggaaaugaggaacagaggcacaaauuuugcccaccgcucuguaccauggagaaguuugcuuccuacugccucacugaaccaggugcguuuguccucccugcaagugagaccuaacaaggagcuaagugggaccugugugaucauugaccgagcauccucaucucuugacacauaauaugguuuacaaugcaguuugguuguggaauagucaggguacuugucuuuggaccagggccuuuagguuagaguuccuccaggcugcagacuaccguuggcugcuuugguagagagguaguggacuucuuggugcaagcaguuuuuacccagcaugagaauuucuugguuguguggguuuuaaagcaauacacgauagacucuuaggaagaccuucuaagaugugggacugugccaagcuccugugacaucacugacuuccuuccaucuguuccccuuugaccccugucucaggcagugggagugaugcugcaucucuucugaccucagcuaaacaacaaggagaucauuacauccucaaugguuccaagguaagaguguguguucucagagcaacuugaggcuguucccacaugccuccuaacaucccucaguuccuugagucucaguuacaauuucuucguagcaguuugcauuggaaagagcugcucacucuuaccucaguacaucggaccacauuccuccccuccguccacuccucccaguucuguuccaucuucucccccaaaccacugccaucuccccucugcccuagauccccuuguccuuuucuccaucagagaagaacaggcaggcaaucagcugagcacagcauaacaagauguaaaaagaguagguacaaacccuccugucaaggcuggaggagggaacucauuaggaggaaagggucccaagagcagggaaaagucagagccacccucacuccuacuguuaggaaucccacaagacccccaagcuaaauaacuauaucauauuugcagaggauguagcauagauccauauaggcuuccugaucggcacuucagucuccgugagccccuaugagcccagcuuacuugauucugugggccauguucuccugguguccucaucaccuuuggcuccuacaguccuuccucuagcucugccuaaugucugucuguggguuucugcauguacuccccccaucggcuuccagaggagguuucucugaugaugauugggcaaggcaccaaucuguggguauaguagaauaucauuaggagucaaucauuucauugacuucucucucucucucucucucucucucucucucucucaaguucugggccaccauuaccccagcauaucuugcacacaggacauauuauagguugaaaguuuugugauuauguuguuguuccaguuccaccauuggaaaccuugccugguuacagaagguggacaguucuaguccucauuacuagaaguccucacuagaguaacucuuguagauuccagggaguuuucacugcacuagguuuucauauccuuucacccccaagugcccccaacccccauccugaccuguccccacaaaaucuauucuauuuucccuuccugggaagaucuaugcauccucuccuccugaauucaggaccucuguuugcucuggucaacccugcucucaccaucccugcucgcuccggcccaaagauuuauuuauuauuauaaauaaguacacuguaagcugucuucagacacaccagaagagggcaucagaucucuuuaugggugguugugagccaccaugugguugcugggauuugaacucaggaccuuuagaagagcagucagugcucuuaccugcugagccaucucaccaucccucuugaauucuuuauauacuuuggaaauuagcccuguguucgauguggaguuaaugaaaauucuuuuccauuuuguagggugcuguuuuguccuuuugauggugucuuuugccuuauagaagcuuuucaguuucaugagaucccauuuauuaauuauugaucuuagugccugugcuguugguguucuguuuagaaaguugucucuguugccaacguguucaaggcuauucccuacuuucucuucuguuagguucaguuuauaugauuuuauguugaguucauugauccauuuggacuugaguuuugugcagggugauaaauauggaucuauuacauuuuucuacaugcagaaauccaguuagaccagcaccauuuguugaaguuuuuauuuauuuuuuuauuauguauuucuggcuucuuuauaaagaaucagguuuccauguguguggauuuaugucuugaucuucaguuugauuccauugaugagccugucugguuugugccaauaccaugcaguuuuuauuacuauaacucuguaauacagcuuggaaucagggauggugauaccuccagauguuuuuuuauuauucaggauuguuuuagcuauccugagguuuuuuuuuuuuuuuuuucuauaugagguugaauaugauucuucaggucuauaaagaauuguguuguaauuuugauggggauugcuuugagucuguagauugcuuuugguaggauaguuacuaugcuaauucuacugauccaugagcaggagagaucuuuccaccuucugauaucuucuucaguuucuucaaacacugaaaguuuuugucauauaaguauuucacuugcaugguuaggguuacccaaagauauuucauauuguuuguggcuauugugaaggguauuuuuuucucugauuuuuuuuucccucaguccauaugccauuuguaucugggagggcugcugaauuguuuguuuguuuguuuguucuugaguuaaucuucuauccagccacuuugcugaagguguuuaucagcuacaugaguuuccagggagaauuuuugaguugcguauguauacuaucagugucaggaaaaauauaagcucgggaauuccaagaccagguuuccagcacaaagaucuauuugcaccagaaggauaggggauaaggaacaaggaagcaagggagagggaggaggaacauuuguccagaggacagaggacugccucuggauggagaggagacauacauggcacguaagaaaauggcaguuuauaaagguauaaggggaaagaaggcagacauggugcugaagaaggagcugagcguucuauaucugcaggcagcaaggcaauacugugugugucguacuggguguagcuuacacauguaggaccucaaagucugcuuccacagugacacauuuccucuaacaaggccacacauccuccaauaaggucacacauccuccaauaaggccacaccuccuaacagagccauucccuauaggccaaccauucaaagacacaagucuguggggcuuuucaaacuaccacagaugagguguuuaauuuaauuuuaauugggcauuuuaauuaggcaaaccaaaggggcuuuuauuccuggacuggaucuugguagucagccucaagaggaaguagggaacagaccuuaguagcuagcuuuaagaauguaaugugucuuucuauuuuaugaaagaauuugaagaguauugguaagugguaucaucuagaaaauuaucccuuuuaaaaauuucaauuuuguagaguacaggguuuuuuuuucucuuuucuuuucuuuucuuuucuuuucucucuuucuuucuuucuuucucucucucucucucucucucucucucucucucucucuuucuuucuuucuuucuuucuuucuuucuuucuuucuuuuuuugguuuuuagagacaggguuucucgguguagccuuggcuguccugguacucacucuguagaccaggcuagcuucgaacucggaaauccaccugacucugccucccaagugcgccaccacugucuguccaguacagguuuuuaauauaauuaccuaaugauucuuuaaauucccuuggugucuguuguugugccccuuuucauuucugauuuguuaaucuggauuuucucuguccuucuuuuaguuaguuugaguaaggguuugucugucuuguugaucuucucaaauaaccaacuguuuauuuugauguuguuuguuuguuucuauuuuauugauuucagcccuugguuugauuuccugcugucuauuucucuuggguguauuuguuucuuuuuguucuagaaauuucuagcuguuaaguugcuaguaugaaaucucuccaauuuuuuucuuuuuuaagauuuguuuauuuuauguguaugaguacucuaucugcauguacaccuguaugccagaacaugacaucagaucccuuuauauaugguugugaccugcuacaugggagcugggaauugaacucaguuccucuagaagagcaaccaaugcucuuaaccgcugagccaucugucuagccccuccaauuucuucauguagguacuuaagugauaaaaacuuucuucuuagcaguucuuucauuguguccuguaaguuugaguauguuguacauucauuuucauugaauuauacgucuuuaauuucuuuuuaucugucuugacuuagcaguccuugaguaaccucuuaccuuaucuuaucuuaucuuguuaggagggcuuguccucuaggguuagagaaagggaacuuuggggauagugcuuggggugggagcaccaagagaaugaaggaggacuucaggaagccaucuggaguucuuguggcugguguggccucugguccagcaugaaguucacaccugaguuggugccugggauauggcaaugaggagggcaggggauuggagaaaccucaggagggcgcgcagauagaguagaagaggucugaguaggaggcuuacuuagugugggaggugcgcccuccuuuguauuguuaucagcuaaaucccugauuuuauaaauauugccagagcaagugcccuuuaccccaccuucugcauuacgccuuuguucuguuguugggaguguuccaguguuuuauccagaugccaggcuuaaaaaucucaugcauuuucugacucuuuuauacccucuuugugcccacaggccuucaucagugggggaggugagucagacaucuauguggucaugugccgaacuggugagucuggcgccaaagguaucuccugcauaguuguugagaaaggaaccccuggucucagcuuuggcaagaaggagaagaaggugagugucuacucaacuguaagcaacuccagauaagggucucugccaugugcuagaccaacuccugcccuuuuuuuuuuacagaagguuuaugaguagguauguagcaaaacagaagucacugcuaaagaaacagcuuccuggggaaaugacaaguuugccagcugguuucagaaacugcugacuauuuaaauucucuuuuuuucugugccugcuuuugugcuguguuuauuuuccucuugguaugucugugcuauguguuuauaugcagguauuggagaggagaugaugcuugcuagccuccucagguguucaccuuaugcuuuggucagggucuucuuuaauuuuauuuuuacuguuuuaaggcagggucuuacuaugugaaccuggcuauucucacuauguaggugaggauaauuucacuuaaauccuacaugcaggcugugaauaggaaacauguaauaauguaauugcugauaauuuaagacgcauugaggguuuuuuaggugaucaaaacaggaguacaguuguugcccuuagaucaggacuuuuggauauaaggcagguguaaaauaacccuugaauuccuccaaaucuccuggggcuuccucauuguucuuuaugaugcuuucuggcccucacaguugccaauggguugugggucugcacuuuuguagcauagcaggcguuuauuagaugacucaguguucaaagcuagugcugucuucugggaggaugcagaacccuuagucauuccuggcccuguuuggacuuaaaaucacacacagcuuuaucuguauaaaaucucuauagcugggcauggugguguacacaucuagcauucugaaaucuggggcuaagaucacaaguccuagcccugcuugggcuacuuguaauacauacacacccaaacuuacaauaacaacaaaaaauguuugccuaucuacagaagcaaaaaauaaauaaauaaauaaauaaauuguguauagguagggucacacuaagagggaaggagcugaauucuuucgguuaggcuguuaacaauaguuuugagaguauuuagccucccacuuuguauuaacuuuccaggaggauagcuauuuccuuuucuucgauuuaguucuauggaagaauggaggucugaaagugagagcagugugcagaggaguaaaaggucugagcaggacugggcugcaccagagucaaggcuuacacaccuccuuugcccucuccccuggccccuacagcuuuccugggauguuagaauaguucuuuccacauagggacagaaaguagauugcuggugugugggcacgugugcaugcucguguaccugcaucuggagucugagauuagcuuugguguugucuuagugcuuuucuauugcugugaggagucaccacagccaagacaauuuuuaaaagaaagcauuucauuuggggcucacaguuccagagggguuagaguccaugacuaguccaaaggcaagaggcaaagagagggcuaacuaggaaugaccuaggcuuuuagaacuucagggccaaccccccagugacacaccuccuccaccaaggccacaucucuuaauccaacuacuacugaccaagauuuagauaugagucuguggggguuauuaagauucaaaguguucucucucucucucucucucucucucucucucucucucucucucucucugagacaaucucuaacugaaucuaacaacaugaauuagcuggucuggcugggcaaugagccccaggaaucuccuucuuuucaugcuccauuuacacacacguacagacacaaagcaguugcagauguuuguguaguaacaccuggcuuucuauuuggggacuagggauguaaacugaggcccauuugcuuguauaacagguauuuuacccacugaaucaugaagauacuuucuuaaaauaaagacaucacaggugugagaaugcagcagcaauuugaaguuuguuucuuuaaugauuagaauuuuuuuucuagacaggguuucccugcauagcucuaacugcccuggaacucauucuguagaucaaccugaccuccaacucagagcuccaccucccucugccucccuaguacuaggauuaaaggcauggaccaccacugcccaaaaugauuagacauucuuuuuuuuuuuuaauuuuauuuuuuaaauuuuuuuauuagauauuuucuucauuuacauuucaaaugcuaucccaaaaguccccuauacccucccccugcccugcuccccuacccacucacucccacuucuugguccugguguuccccuguacuggggcauauaaaguuugcaagaccaaggggccucucuucccaaugauggccgacuaggccaucuucugcuacauauguagcuagagacaugagcucuggggguacugauuaguucauauuguuguuccaccuauaggguugcagacuccuucagcucuuggguacuuucucuagcuucuacauuggaggcccuguguuccauccuauagaugacugugagcauccacuucuguguuugccagguacuggcaaagccucaugagagaaagcuauauaagggucccuucagcaaaaccuugcugccguaugcaauaguguuugcauuugguggcugauuaugggauggacccccagguagggcaguaugguccauccuuucaucuuagcugcaaacuuugucucugcaacuucuuccauggauauuuuauuccauauucuagggaggaaugaaguauccacacguuggucuucuuucuugauuuucuuuuuuuuuuuggaaauuguaucuugguauucucgguuucuggguuaauaucugcuuaucagugaguacauaucaagugacuucuuuugugauaggguuaccucacucaggaugauauccuccagauacauccauucgcccaagaauuucauaaauucacuguuuuuaauagcugagcaguacuccauuguguaaauguaccacauuuucuguauccauuccucuguugagggacaucuggguucuuuacagcuucuggcuauuauaaauaaggcugcuaugaacauaguagagcauguguccuuauuaccaguuggaacaucuucuggauauaugcccaggagagguauugcuggaauuaccgguaguacuauguccaauuuucugaagaaccaccagacugauuuccagagugguuguacaagcuugcaaucccaccaacaauggaggaguguuccucuuucuccacauccucgccagcaucugcugucaccugaauuuuugaucuuagccauucugacuagugugagguggaaucucaggguuguuuugauuugcauuucccugaugauuaaggauguugaacauuuuuucaagugcuucucagcccuucaguauuccucaggugagaauucuuuguuaagcucugagccccauuuuuuauugggguuauuuggauuucuggaguccagcuucuugagcucuuuuuauauguuggauauuaguccccuaucagauuuaggauugguaaaaauucuuucccaaucuguugguggccuuuuugucuuauugacaguaucuuuugcccuauagaagcuuugcaauuuuaugaggucccauuugucgauucuauuucuuacagcacaggccauucuguucugcuuaggaauuuuuccccugugcccauaucuucgaggcuuuuccccacuuucuccucuauaaguuucagugucucugguuuuauguggaguucuuugauccacuuagacuugagcuuuguacaaggagauaagaauggaucaauucgcauucuucugcaugauaaccgccaguugugccagcaccauuuguugaaaaugcugucuuuuuuccacuggaugguuuuaucucccuugucaaagaucaagugaccauagguguguggguucauuucugaguuuucaauucuauuccauuggucuaccugucugucgcuauaccaguaccaugcaguuuugaucacaauugcucuguaguacagcuuuaggucaggcaugauuccaccagagguucuuuaauuguugagaauaguuuuugcuauccuagauuuuuuuguuauuccagaugaauuuacaaauugcccuuucuaacucagugaagaauugaguuggaauuuugauggggauugcauuggaucuguagauugccuuaggcaagauagccauuuugaguauauuauuaugagcaugggagaucuuuccaucuucugagaucuucucgauuucuuucuucagagauuugaaguucuugucauacagaucuuucacuuucuuaguuagaaucauaccaagguauuuuauauuauuugugacuauugugaaggguguuguuucccuaauuucuuucucaauccauuuaucauuuguguagagaaaggccauugauuuguuugaguuaauuuuauauccaguuacugcaaugaagcuguuuaucagguauaagaguucucugguggaauuuuuagggucacuuacauauacuaucauaucaucugcaaauagugauauuuugacuucuuccuuuccaauuuguauccccuugaucuccuuuuguugucgaauugcuccggcuaggacuucaagaacuauguugacuagguagggagaaagugggcagccuugucuagucccugauguuagugggauugguccagcuucucuccauaugauuaggcauucuuaaggucaggauuucagacacauucuugcuuucaggugucuguguuugauuugacagaaugagaugcagagguagccaucuuacugggcaguacugggaaauugcagguguugggcagagaccgcaaaaauuuaagagagagcaaauuugguugcaguuuauuugguuuugguuuucucagacuggaucucuuuagcccagacugaccucagacuugcuuuguaaugaaugcucaccuugaacgccugauccuccugccaauguguuuucagugguaguuuuguaagcaggcaccaugcuugccuagaaggguuuauguuaggaaaugauguaaaaagcagugauuucuagguuggagggaacucgaguauucuauguaguucacaguuuccacaggcugcuuuguugaaccugaagguccuuugaguuuccaaguaccuuaaugaggagcugaugggcuuuaacuauuuauauaugaaacaucaaagugagacuuagcuaacagauucuacuaacuuucuaguccagcaguuguacuuuauguaaggaaacaaaugucccaaagaagucaagugacuugcccaaagauaauucuaaccagguucuaugucagaggcuacauuucaacuguucugauguuucucugaacuuaaucugacauauccagugauguucuaguaagccaauuuucuuggaguaacaaaacaaaaacucauauuuguggcauuugccaauccauucguggcugauuucacgccacuuuugcaagauuaugggaugcugaguuagaaaaaaacagugcauaauuggcucuugugaguugacaucauagcacuggaucucacugcagcuucguguuagacuagggcucuccaggacauugcaugucauuuaccuugucucauugugguaccuuuuggggacacaaaucuuaugaaagagauaugugguuguuguucacaagaccuuuaaaaguaaaauuuccaaauaauuucucauggaacuuguacucagaggcacugaaaauaaggaccgaucugguccugauccuacaagacgugaguaguauucauagacagagugcacagagugaauuugugcucuauguuugccuguguuagccaggcauggcuguaauccuggcacuugggagccugaggcaggaagaacgcacugcagucagccuggacuagagacgaagaccauguugaaaaaauaaacaaaacauugcacacuugaaauaagcaucuuucuaaguauugacaaaccuguacaucugaacuuuuuccuuuguuuuguguucuuaugggccuaagugucauguugcuuaaaccuacacauuacaagcuucuguccacagggaaggccucccugcuuggggaaucauagggcagccaucaagacccugauuuuugccaggugggguggaacucgcagccaacccgagcagugaucuuugaagacugugcugucccuguggccaacaggauugggaccgaggggcaggguuuucucaucgccaugaaaggacugaaugguggaaggaucaauguuggugaggccagaaaggaguuggggagggaaggcaagggcugaggcuagcaacugucauucaggcucagcugaagucuugacucuugcucuccagcauccugcucucugggagccgcucaugcuucaguuauccuaacccaagaacaccucaagguccgcaagcaguuuggagcaccuuuggccagaagccagguaaguuaccuaggaucugcacuucauuuguauucuguucaugccuucccuggggcccacauucucaauggagucggggagcaugacaggaacaugaaauccagugaagaacuugcuaccaucuuaaucagaauguauauuuugcauguaccugugccaccuuuuucaggaggcaguaauaccaaggcaagcaaaguaggcuuuuuuagaaguggcaagagaauuuugaaguacuuagaaaaggcaccuaauuugagauaucuuugugugugcaugcaugugcuugugggguggggugcaugugugcaugucacagugccuauguagagguuagaggugacuucugucacccauggaucaucuggggguggaacucaauugaucuauuuauauuuaagugccucuaccugcugagccagcucuccagcucaagauggcuuaucaguaguuccagauuaccuccacaugacaugucuaaauccaugugccuauuuuguuuucauucuugccuauggcuacaguaccuccaauuccaguuggcagauauggccaccaagcuaguugcuucccggcugaugauccguacugcagcaguggcuuugcaggaagagcgggaagaugcaguggcccuguguuccauggccaagcucuuugcuacagaggagugcuuugcuguaagugauaagucuucuggccuuccugagacagacaggaagcagcugucuagcuuaggaucuggagggagaugacuccucuguagaacauaauccuccugaggcacugaaggaaucacuuugggccuuaaggauaagaugaaucuguggcaggucuacaugggagcucuuccugcugcuuucguagccuucuccgugcuauuaacugcuucaguaaggcucugucuuucggguguauucgagacguggcacaucuuuguaagguucagaacagcccagugaugcuaccccaaauuuaguacuaauuaccguguucuuuuugucucucacacacacacagcugcuucuaaauugagacuacuuugucacuagguggcaccugagcuuccuaucaucagucagucagagcggcuguaggacagcauuaaaggaagaagcaaaugucucugcugucugacuggcagggaucgacugguucaguaggaugcccuugcgucugaccacuuagaaucuggagcucccucugggcucuguucuuucucucauucauuuguaguaggcugccagcugagguuuggagugucgaggggaagcuaagaagugcacagucuccuggaaccaaagacaucuguguccuccugucucccagcagaucugcaaccaggcuuugcagaugcaugggggcuacggcuaucugaaggacuaugcuguucaacaguauaugcgggacuccaggguccaccagauccuagaagguaaaacuuggcaggaguuacucucuucuguuugauguaagaucugugcuuuuccaagccuaugucaguccuuuugugcgggcuguuccucgggguccugccaggucccugucuuucucgccauucuuccucuccuuagcccugcuuugucacugcucuguggcuacauuugaacgugcucuaggcugggagccccugccucugccuuguccucaugauugaagcauccggccacuccauuucuuuuuguagauuucaaaggcagcucaaaccaagcuaggacgugagaacuuuugaugagaagcacacuggggacaauuuccuucugucauaaaggacuugguccuccaggagcagcagcuuagcggccauauugucuaaaugcuaucugugucaggauugcuaguauacuguuuaguaaaauugccggcauguggcuuucuucuguaauacagacauucugccgggugacugucugagcuguuaguuaggcacaggauggggcuuacacuuggcagucagugggugagucuggaagagauauaacuucuguuccagccagguaggcagccagggcugugacaguacuggggagcgagggacaguaccuucucugugugguuuuuggugaaacaguguagggguauuuuauugggaucacagagaccuucaaaagacucaugucauaccugaguggauaccauaauuucuggaggacuuauuaaagcagguuaugggccccacccucagaguuuccacugggccaagugaaggcuguggucacugguguggaaagguuugaggccugcugucccuaugucugaaucaugaucugcuuucuauccaaacuugaacucuaaucuuuaucuggcuaagucucucgugcuaaucagacuucccagaguuccugaguggggaaugccacuguuguacaaggaaguuguugggaugugguuuucuuugagaucaugugauuauugguuccucaagggcuuuacuuuguaaucuauaugcacugaacgccacgauuaaaaaugagcaaucaauucccuccuucaggggaaauguuuuauuuuauacuuaaguuuucugauauaaaagaaacaaauguuauugaaaauauauaaaauacccaaaaagcaaaagauguuguguuuuucauccaggauguauuuuuuaaauauuuucuuuguuaaacuccugagacuuuuuccuaucuuuuuacaagugucauuaaaauuuaaaaauuagagguauacuauuuuucuucuauaucuuaauuuaauacagucauuuuugucaccagaagagguguuuaaaaauguaaauauuaucacacugagccaacaagaugggucauggguacagguaccuacugccaagccugaaggccugaauuugauucccgggauucacaugguggaaugagcaaaccagucaugcagauuaucuucugacuuucauaugcacaugggcacacucacacagcacacacacaugcauacacaauaaauacaaucuaaaaauauuuaaggcauaaauauugguggguauagugcugcacaccuguaauccuagcacugguggaagcaggaaagaucaggaguugaagguuauccucaauuacauauugaguucaaggccagccugggcuacagcaaacccugucucaagccaaagggcaaugaauguaagaacuauuucuuacgcugccauuucucugucguuacagaagucguaguuguuuaaaucuaugacugcucugucccugcugacucuguuguuccucuugcagguagcaaugaagugaugaggaugcugaucucucgaaaccugcuucaggacuagcucccaagcuggagagccucgccuggagucugugugcagcuggaaucagucuugaugcuccuaugggcugcucaguucaagugaaucaugaaguagaccaaagggcugagcucuucuaaacagacugagcugucagccacgcugcugguucugagacaagaacagaguucuuagcagagcuagaagggcugcucugaggagccaugcccaaagaagaccugcacacugccuuccucauucuggaaagacaagcggucaaagcuguggcuuggauccacacuaugggcauuuuggugauucuuguccuuagggucuggguacuugaaugaagcuuuuccugauuaaacagguaaagucuggggaggccagggcaguggacagaucugccccuuucugguuucuguucugcacuagggguaugucaggacaguacuccuguacucagaucaugaugaaauaaauauuugggaaccuacugcuaagcaaugaguuagggugcaccuuuaacuccaggaaccaugaaauaaaugucaagggcuaagucuguuuuggaauauuuggauuuuuuauuugggauuuauuuccucuggggcccccuucucuuuuuaaguauauuuaauuagucccuugauaagcaaaaucuaugucuuuacugccuccuucaacuauaagacuuaaaacuguauuugagauuuuauauuauauucgauuaaauauuuaauuggauuuuagaacaauuagaaauuucuccuaaggcaguuugucuuuuaaaaaguacauucuuuuaaugauuuugcaaacaaagcauuauuugucaugugugaaugucuaaguauuagguauagucuccugcaguggcaucuuacagcucgucauggagucagcccggcucagucuucucaagaugucccucacagcccccagacaaaaaccaaaaacccagaccaacaaaacaugacguuugugacauucugacuuaguuucuuggugacaccacucaacuugugguauuuuguuacgguauucugagcugaguaauauaaucaaccucacugaugucuuauaaagaagugugaccaaaugcuuucuccaaaagcaaaauagggcugaggcuauggaucagugguacaguguuugccuuguguguuuguuccacagcaucaaaaauaaguuaauaaaucacaguguauuguuucccaauacuaacaauaagaaauuuaaaauaucacaguagucuccaguuuacauuucaguauaaauauaaaguuauacagagccucucuacugaacauaauuaacacuguuacaaaaauuuuaaaguuauagacagaauaccgauauuaacauuaaaguuugccuuuuaguuaauuucagcuaaaaucauugcaguuaaaaauuaaauuuuguguguggcaggggaggugauuguugaaaauagaauaugacaaacuuauucuaaaaguauggaaauacaaaggauauguccaguguugaauauuuacuauugaauauucaauuugauuuugaauauauaaguaaaagaguaaaguugaagaucauuuugaaaaaauuua

SEQ ID NO: 4983 - RNA, 7665 nt, Mus musculus
ugagacgcgucuucuacuaagccuguccgggcacgccagucgccucaaggcucccagaagauuagccuggcagugcuucaaggcguuuggguggugcguugaaugaauggugguggguaaagccgaauuagggagggacucaggagaguuuagagguagauuaggagagaaggaaagggcgcagauaacgagagagggauuagaaugguuuaaucaugacuuuucuucauaagucccaggcccuguaugcuuucuugccuccaucuugcaccaugcagguuuuagaagacaagagcuguuucuuacccguccgguuagcuucagccuccuacagagaggccaugccgagaccccgcaagaggcagacugggacugcugguccaggugaguugaaccgacgcugcaaaaggcagcagguaaagaacguggucuuguagggcgugcuuuauuuccuuuuuccacucccugguuuggagacuuuggggguuguugcuuaucgucuucuuuacucuuucugccagaacuuccacuuucagucccuuccacuuauuuguccaaucaaagaauagugcaaugaagcacugcauacauauacggaacugugguggcccacgcaugugggagacugaggcuguagaauugccuuggguuuaagaccagccugguacuacaugaguacuacauaagcagggcccucucuccaaaguguguguguguguguguguguguguguguguguaaccuugacagcauaggugaaaagagacuucuuuaaaaauuacauuuauuuacuuuuguacaguaugugggaacacacacacacacugaucagaggauaacuugaaggaaucaaucccccgauuccacugugcgaaucucagggauugaacucagguccuuaggcuuugaaaaaaaaaaaaaaaugccuuuuccaacuaagccaccucgccaacccuuugcuuuuaucauugaaugcaauaagccaggcacagaaaggcaugcaugauuucaugugaaauguaaaaaagcugaaagcuagaaaucagagggagaucaggauucaagaucuuccuugacuacguguagaguuugaggccagccuggaccacaggagaccccaccuuucacacacacaguuuucuuuuccuaggucuuuaucuuaucagccugucaauuuggaauugcuaagcaucugaggaugaccugaauuccugaucuuucuguccccacucccaagugcuuugguuauagguuucuuacaucaccaaaaccauuuagacuuacccuuaaauuuccugaacaaugugacuucagaggcuaccaaaaugcuagacauagcuguuaagaaacuuauugcagcuaugcuuacaagccuaaugcucuagggcuucucugugguccuuaucuuguguuuuaucagguuuuacaugugugugcccuggcccugaugcuggugccguggaggggauucuuuuaucauaugugccugaggggauaaagucaggucuuuuggcuuggaagugccuuuaccuacugacacaaugucuggccucuuaaugcuugcucaauuuuauguuaagccccuuuccuguugugagccuguagccuagucuggccuugaauuuguagcaaggcuccaaggagucucaggcucuaaaguucugccaugagccaacacgcccggcuuaaaaucuuaaacucuaauuuggcuucauucucuuugaaauuuuuuccugugguuuaagaaccccagguugugaguuaaacucaggcuguuggaggcagcaguauguccugcugguaaaggcagugcaguguacauuucagagaaguagguacaguagagccaaauaugacaguucauaucuaucaucaagauauucauguguccuaggccagccuggucaauaacaggagacucacagcucuauaacaaauaaaaaggugugaugguuccuaccuguaauccuaaugcuuagggggcugaggcaagaggguggcugcaaaugggaggccagccugggcuacaggguucugagacccuaucucaauauaaaucgaugcuucaggaaguauauucagacagauugaguauuaacguguacauguguggaaacacuguauggcagcuggugccuaguaaauucauacaauucuugauuucuaugucaguuagaauuuaauagaaaaaggcaauuaauugacuaaaagaugagaacagugaagauaagauccagcuccuccucugagggaauccgcaaaccuguaugagugaaagguccugaagauagcuuugugacagcagggaagaggaggccuccagagggaagcagaauuugagcccagucuagcauagguaaaacaaugggcucaggccccaccauuggagcaaagaaaaaucuagguggguuuuuuuuuuaagccacgucuacaugguccugauuaaacuucuuucaagcuucacuugauaaugauuauaaugguuaguuuuucuaaacauuuaugauaagacuuauuuucuaaguccuaguugugugaaauaaucauugaagcaauuucaaauaguacuucauuuccucauuggaaagaauagccuuacuaaaggcacagaagugagguggggcacacuuauuacuaccgguauucugaucuuaacucuacaagggucccuuugucucgcugaguaaucuagaagacauccuuuaaaaauguguucucuuuuauuaauuaaauuuuacaauuucauaaauguacagaaugcaaacaaaccuuuuuuaaguaaaucuuguuuuuugguugguugauuagguuuuugggauaggauuucucuguguagcucaggcuaucuuagaauucgcucuguagacuaggcuggacucaaacucaacgagacaugccugccucugccuccuaagugcugggauugaaggcgugcagcacuaucacccagcagcuuuuuuuuuuuuuuuuuguuuucgagacaggguuuuucucuguauagcccuggcuguccuggaacucacucuguagaccaggcuggccuuaaacucggaaauccgccugccuccgccuccgccuccaccuccgccuccgccuccgccucccaagugcugggauuaaagguguacgccaccacugcccggcaaccccagcagcuuuuaaaagguuuuaguguuuauuuuuuguuuuauacguaugaacguuuuaccugcauguacgucuauguaccaugcucauucaguaccugcagaggccagggaguguuggaucccuugggacuggagauacagacaauugugagccaugucaguacugggaauugaauccaagguuucuggaaucuuaagcagagauauguauccagccccaagaacagucuucccucaccuccuaucucucuacuauauccuacaccucuugccugcaaacuucacacucaucuauucguuuugcuuugugaccuacugaguuuaaccaucuaugaagccuuggguucggagcugucuauuagaggcuggugggcucagcaggggcuacaaaacuccaaacagugauuccccucuccuggaaaguaucaguagccaacaauuuuagcagucaagcuagugccccaugagcucuuccccauucauaagugacuguuauaggaccaaccuugagugggcccagcacagguagcugcaguugaugguuucagugguuguguugagucaagaggaugucauuuuugagccucugacaugcagauauugugcagucuuuauagaggugaaguuacuucucuaugggacuguagugcugcagcuaauguuuuuauagagucuaagcugugaguuuaggcauugacgggaguaaaguuuuuuucauaaugggacacugccucccagcaugaugacaagugucuuccuugcuuuucuacugcagacaggaagaagcuauccgggaaacguacuaaaacugaaaacucagaaaguacaucagucaagcuagagaacuccagccuugagaugacgacaaccuuuaaaaaugguggcaagaauuuaagcaacuacuggcugaugaagucagagccagaaagccggcuagagaaagguauagacaugaaggugagacuagaccuguauucagucaugcuggugagauggguagguggguuaagaaacuuacuguacaagucggaugaccuggaacccauugugaagggagagccaacuccgaaagcuuugcucugaccacacauccucccacacaucauaaacacagauaagugcuacuaaaagaacaguggaugugguuuaucacagaauucagacaccagcuucucucuaaggaaaugguuaaaaauggaguugacauuacugucauuaaccaugguaagguugacuagcccuuauccaaaauucuuggggccagagguguucuagauuuuaaaugugaauaucccuaggcacugcccccaauuuaaauacuuuaauaaaacacaagacguuuugaauguuagaauauuccagaguguuuuggauuucagaucuuaagagucggcauguccuggucuuauuauagcuuguuaagcuguguuugcuugauaucccugggaagcccguucuuuucugagggguggcagaggugggguggaucuggggcagggaggacugcaguuagaauguaacauaugagggaagauuaagugugcccagccuguguuguuuugcugauuuccuaucuaagcaaggguuggcaggcuuucugcaaacagccagagagguuuauggguuuuuauaggcuguguugcagcucugucccuguaacgagaaaguggccacacacaauacauuaaaagguaaaacuuuauuuauaaaaucaggcauuugguucaguuuuccagugucaaucuuaguuugauuuugcuguuacguguuuuuaagacgaucuaacuauguagcccaagcuggccucuuaacuuuugaaguagcccagguugccccuugaauuuaaguuccuccuugcauucagguuuaugagggcuggaguuacaggcgugcacccccacaccuggcccuccuugguugguagauuuuucuuacugguugccgugcucccagacgucucccugacaaguguggccauguauucagguagugaagauuagccaauuuuaguacuagcuugagaaaaauagaaauauuagagaauuaugauauuuuaauaagugaaauacagggaaccagcagacuuuuauuauccugauuauccauucaacuaaauuaauuagcaaagcucacaaugcaaaacccaaggcuacuuacacguucaacaccagugacucccuggaacuaguuuccaguaaccuaccuagcuccuuuacagcuguagcacuuuucaggauuaaggagagaacuuuuuguuuccauagaagcuuaccgacuggccagugaccuuuuaguaaugaauggcuugauuuucuuuugucuaguucagcaucgaggaucucaaagcacagcccaagcagacagcuugcugggaugguguucgcaacuaucagguaaggaaaugagggcagggacccugaagcugaccacacuagguacaugccugccuccuccaucgcagucugcaggagcagggccuuuuagccaguacugcuuuucccugaacucuaucugaaaauguuuucagaaauaucauaaucgcugugacagcaugcagucugcaaaguagcuugguucuggcuaguguccuggaacaaggcuaggacucugaacaaaggaacagauuucauuaugaauggagagaagcugcaaaacagaaauaaacauugaauaaaaacagacuugcuuucuucccagcuguuaaguggguagcccuuguuucuucuuugacacaggcucggaacuuccucagggccaugaaauuggaggaugaagccuucuucuaccauagcaacugcaaacagccuggcauuguuggacuuaugaagguuagacgcacacaucugagccuggauucuucccuuuagggauuugugaaaggccuacagcuuaaauaggcaaaaacgaccucacucggccugucacagucagugaggaaaagugcccugaccaucaccugugugacagagauuagaauaggaaggccuucauuucaggcccuacuacuacuugucacuaucugagguuuccaucaaguagcuccucuucacuaagaauuucaggauaaaacuguguggaguugggagaaaauaaaaaccuguuuccaacaguaacuuaucauugaguuuuagaacauggcugugaaaccuuggaaaauucagcucuccuuccuggcuuugcuuccuuagauuguuauuuccagaguaccagcugucuccauggcaagggaaaaugauuagaauggggggugggggugggauuugaguuagaugcauauuaaaauuugggcaggaggcuggugagauggcucagcaguuaagagcacaggcuguucuucagaggucccgaguccaauucccacaaccauaugguggcucacaaccaucugugaugggaucugaugccuucuucuggugugucugaagacagcuacaaugcacucauauauaaaaauaaauaaaucuuuauuaaaaaaaaaaaaaacuugggcagggauuuaaaaugacuggauugggguuuuuugcuuucagauuguaaaggaggcuuacccagaccacacacaguuugagaaaaguaauccccauuacgauccauccagcaaagaggacgacccuaaauggucgaugguaagaacuguucuuguuucauagggcagaguggacaaaagggggaaaagaaugugggguacuguuaggucagggagcacagcccagcucucagcuagaugaaguuuuacugaauugggauaucagaauauuggcagcccuaauaccaggcaccuccugcaaauagcaaaaacucugggugugcacagaagcaaggcuguacaugcgcuuagcuacucggugggcugaggccugaaaauugauucagcaacaggaauuuaaggacacacuaggcaacacaguggacccaucccuuaaaauugggcagggucuggccgaacguguuucuguucccuucaaaugcugucgaauagguggauguacaguuuguucgaaugaugaagcgcuucaucccucuggaggagcuuaaaaccuaucaccaagcccacaaagcuacuggcggccccuuaaaaagcaugacucucuucacccgccagagacuuuccguucagccucugacucaaggugagaccuaacaugggagaguuggugcccucaccugagccacccacaagcaaggcuaugugcuacacuguccacuguuauauacccaguaccagcuguuccagcuucuuaauagacagcugcccccugcaggagcugcccuucaacuucccuaugcgggacacgauaaacaccucagucucacccucaaccccucuuuuuuguagaagaguuugauuuuauuuugagccuggaggaaacagaaccaaguuaaucagaaggcucuacugauggagugaacaagccaagauuuuauaagacagaaggagaaagcuugcuguauccaccuggggucgugugcacggaugguuuguuaauuuuccuaauaaaagauuuaaugacaaggu

SEQ ID NO: 4984 - RNA, 26041 nt, Mus musculus
caguuaauguuggggucaggacgucacuaguguuuuucuuaccgucauaucguucuuacacggcagggaaccuagaggccagcggggacagcauacuuccuguaguagcggucacauuugccccuuccggugacacugagcgugcaugggaaaggcaccucaucccgucagacagcacgcaagcguugcucguauucaaaugugaagaguagccuggcguuuaucaggcuaagaaggaagagaaaugcaaccggaauauuacaaggaggcacuugcagugcuaggacuugacggaacaucugggcccgaguucuacuggagagaggccagagccgccauguaaacaaagcgcccuuuggcacugcacaugcgcagaugagcgcaccccuugacggccuggaggggguagggaaagcgaggggggggggggggagagaagacgugcgcgugcgcguggcaucaucuucgcauccgggccggaguucuccugccccuucccccgcccggcgccgccguagcacuucggugcguuacgccgcgggaguccaggcaguucugugugugcggcugggcgcuggaccccacccggugggcgacgagacgcgcgugcuuggcgccuuuccucccagggcccuagucgcugcaccgccaggaucugcguugguacugugucuggccucucggugcaucgcugcucugggcgccgcaacccgcagccgaccuccuuccuccgcccugccucaccccaggggcgcaggccaucggcgaucgcccaccgcccagcucagagcgagcggggcugcggugcagcguccagcgcguucccgcagccggcccuccggccugccuuccccgaaggcagcucgcgccugggagggagggagcagucugugccgacaccggcgcggccaggcggggagaugagcuucuucggcuucgggcagagcguggagguggaaaucuugcugaaugaugcggagaguaggaagcgagcggagcacaagacugaggacgggaagaaggagaaauauuuccucuucuacgacggggaaaccgucucggggaaagugagccuaucacugaagaaccccaacaagcgacuagagcaccagggcaucaagaucgaguucauugggcagaucggugagucuauucccugggaccuucccaaaaccgggacgucagccugccccuggacucgagugugggacgggcugggagcagagauuuucagugcccagcuccugcgaggccugcgacagguucuuuucaacuguaaucuaaagccugagauucacccacgagucccgcccgugggcgacucccccaugcauucauuaccuucuuccgugccaaaagugacagcgugcugcuggggagguggggacagccuagauaggguagggagcccucugcuguauggucggaugcucaccuggugcuuggauauccccauugucucugcaguaugcuuccagcuuugcuucuaguaaccgggauuucauagugugguagacaguauccugcagguggguuugacagcuacagcugucagauccaauccaaaguuaagcagugaccccacccaccuauccaucaucccuccucccccuuuaaaauacagugcaguggaccgggcucauaaauuccgucuaucuaucucaccuccauucuguauuacauugcaugugcauguuuugaauaccuguaaccugccucuuucugacugccucuauuucucaaacuuccuuaguaccaugcugguauuuaguugucugauuuucuccuuaaagucaaagaagugaugcugcaaagacuauaauuaaaugaucaaaaauuugcagugcucaauagucaccuucaaauauuguuaguucuaauagaacuagauagacaagggaaggcgguaaaacaaaauauuuggggagccaggugagaggugaguuugguggcacaugccuuaaauugcagcacuugggaggcugagacagguagaucucugaguugaaggccagccugguucacauagugaguucuaggccagcugccauugcauagugagacccuguuucaaaauaaaacaaaaccccacgaagauuuggggagcugcccaucaugacuggcuugucacccagucuaaguauuuggagucuuuugugucaucaaagugcuuggguacuucaaaaaauaaaacauucguaucaugaagucaccaguagguugugcccuguggauaaugaacaccaaucagaaaaucccuacccuguauccccuacugcacauauggacacugauuuuagccacuugcuugggacagcuugcuaaguucacaugcuaagaguugagcauacaucucaucuguuuguucccuuuugccagggcauccccucacacagucgugccuugcgguaucgcuguguaucccaagguggaugaagccaguccuaguaaagaaucacaggucagauuauauacauuauauccauccaaagcacucuauauaagcaugauauaugaagcagucaguacuugccgacugagaauuggcauuuuaaguaggaguuuuaaagugacuacuacaucaguacuuuugcucuguaauaccaguaaaaauagguauguuuugguuuuugucuaucccaucaacucccugauuaugaauaacucaaaagcgucccugccucacuccggcagaugaaaugagccauuguagaaggaaagcaugccuaagucucuuucaguuuaaauacaagguagccaaagaggcaguuugcugcaauugccccaccugcucucuugccuaacuccuucauucccagauugucauaaccucacugaauuuucuugaaaccuuuuauugcuucuugggauaauuuucccugggaccuuggcacucugaccugauggggacucagcuuugucagcuguaaaucaaguaucuuaaagucaccugguaauugagauugggaggccgugucucaugucucagcuagaggguuccuuuauagaggugagagucgucacugccauuucacaaagugaauuugagccagugauucaggcuucccacuaggcuuccuauguucuccccagcuagcuugccauguggacuuguacagagaacaguuuucagccuccaagcauuuacuucugccacgugagcuuucacacagcuagcaguggguguggugcuuaaaguagauaguucaaguuuauucacauucauuauccaugguuacuugacagaauggauaguaacagaauuauaagcaguauauuuucagaaaaacuuuucuaagcagacaugaugguacauacuuauaaugucaggacuccaaggguuaaguaagucaggaagaucuggaauucaagauuagucuggcuacacaucaagacacugucuccaaacaaagcaauaaaggaaaagccuuucuagauauguuugguauaaaaaaaaaucucucuuucuacuuuucccuaccacucuuucuguuccuaaaauugauugcuauuaaggauauaacagcuuauuugcacaaaguacuuuccuugaguuucauguuucuuuauuaucuuugugacuuccccaaagaaucagagcaugacauauugugucaugcaucuaagacaguuauuacaaagugacuucggggcaccagagggagaccaguggguaacuuuguugaaguugugguucugugguuuucuccuuggcugcauucuuugacuauguaucaaguaggugggacuucugucuuguuagaaggucagguuauauggguaacuguagcugcagccaggagaguuacuuaccaucacugaguucuguccuuccugauaacacagguugcauguuuguuuguuuguuuggguuuuggaggaguuggagcuauuguccccugucuuacucuauaaccuguucugacaucucuuccauaucuucauaaucucugugaggaugaacugccaagaggcaauucucauguuguccaucccuuaaaagcuguuuuguuuguuugcuuuuuaccagcuccuuagagggaguauauuuauuuccuuucuggagcuugucccagccugccuuuccagacgucucccuuuaacuucuucuucacugaugauagcuucuucagauaucuucuagucaggcaugguggugcauaccugucaguacaccucuuggaagacugaagcagaaggaucaggaguuccaggccagccugggcuacauagugaaacuuuaucuuuaaaaaaugaacuaaauagggacuggagaaguagcuuacuaguugaaagcacugacuguucuuccagaggucuugaguucaguucccagcacccacauggcagguuacagcagucuauaacuuuagucccauggaauccaacacucucuucuguuacagagacauacauguagacaaaacaccuaaacacauaaauaaauaaaucuuuuuugucuuguauuguuuuguuuuuucaagacaggguuuuucuguauagcacugauuauccuggaacuugcucuguugaucaggcuggccuugaacucauagagcucuaccugccucugccuucccagugcugggaauaaagguaugcaccacuguugccuagcuauaaaucuucuuuuuuuuaaaugaaguaaacaaauaauaaaaaucuucuucugcaugaagcacugguuucaaaccccaguacugacaaacaaacaagcgaacaaaccucuuaaguuucuaaaguuuuggugucuuccccuuguauuuuaacuuuuuuuucuucuggaaaguaugaccugcccaauuaguuaguacucuuucuucaaaaguuugcuaauugcuuccucuccuguucuucuaaguuccaagguaucucuuuucaagcaggcugugucuucauuauuguuguguuuauuuuguuuuguuuuuuucaguugucuuaccuucuuaccccaaggccaaagacugccuccaucccaucaguaguccagugguuaaucucucucuuagucucaguggcuagcucuauccuaauacuaguccagugguuaaucucucucuuagucucaguggcuagcucuaucccaucacuaguccagugguuaaucucucucuuagucucaguggcuagcucuaucccaucacuaguccagugguuaaucucucucuuagucucaguggcuagcacacagaaggugcuacuugauugcuugucaccuggauauuauugguuuagaucuaagauuuuacagaaauuauuuucuggauuuucuuuuuucuuucuuucuuuuucucuccucucuucucuucucuucucuucucuucucuucucuucucuucucuucucuucucuucuuaucuucuuucgaauucaggaacaaacuuaagaaaccacagcuaugccagucaaguauuucaacucugaacuacauccuuagccccuggaauuacuucagugagagaaaggaacagucuagaucaagcagcuagguuccugcacaugcuuguguaggagacaguaaugaacuagcuaggcguucuugcagucaagcccacugaaaacuuaggugguucuugaccaucacgcaugccuuggaacagcaucuucuugagggaucugggacgugagcaauacaucugaugucagcuuacuuguuuuucguuuuuuuuuuuuccaucauauuccuauuucaaguugagauuaccucuuccuguugagggguugccagaccuguggcucacuggguccugcagcaagcacuccacagccuuauaguuugaauauuguuucaagcgaguaaucgguuccuagcucuuaauguagagccuuguuuuagugauccuguuuuucagcugcuuugcuguccucucuguaucuagcacucuucuccugauagcauagucuccauugggacacugccaguaaaccugugguaagggaaguuuuccaggugagacuggugggauugggaagauaaggaguauacaaggagcagugaggccacuacugcacaguuucuagaagagaccauuucccugcugaaauccuuugggaaacacugguaaagguguaagccagacuugggaaccuugaaggcuaaugggguuagacgaauuaaauauaauuagaaggucaaacuugcagagauaggcggacacaaauauccuuaugccccagagccaaauagauaauuuuuaaaaaguguuuaaugagcucaucaauaccaguaaccuguccuuaaaaaacaagaaaacaaaaacaaacaaacaaacaaacaaaaaacaacuccagagacuuuuauuuuagcucauuuacucuugaaauaccaaaugaaagagcaugcagaggauaacuggauugauucuggcagacuuacuaaguugucagcagggcuuagaucugcacagagcagaacugcgcaugcacaacccagagguugcauuguuccugccggggcaggagcuggaugcagcuauagcaagcaggacucuugaucacauaauccgcaaacagaugcucagaaaguaagaugaaaaugaaguucuugcugcuuuguaucucucccaagccuaacaugaagcccagacuguauguggugguagcucagcagcaagucccaggaugugugaaaggcucgccuguaacgucagguuggcccaauuuccuucuacaguggcaaacucccuuuuuggcagauggugacagguauuaccacgaacacauccugaaugcaaaaaugacuuccucuuuuugagugaagagggaaacuaaugcagaaguuacuagaaggaaaucaaaaggauguagugagggguagagcuucucccucucagcugaagggcuguggugcuugggaugacccuagcugcugcuuuggggcgggagaggaacuuuuuaaaauauucucuuuagggcauaaggcucuugcuagaacacuuggauuuucugccuuaauuuauuuaagaugaaaccaacccucuggcaaauagcaguguaaagcuacuauucugccacuuuggccgcaguguuugcggacacauuccaagcugcuuauagcauuacaaaucaaaaaggccauuucaagcuagaugugauggcauacaccuguguucuuagcaauggagaggaugaaccaggagaaugaucccauuuuaaagccaguuugggcuauguagcaagaccugucuuaagaaaauaaaauagcaaaaggcuguucuugcuuuccucagaccacaguguucccucauggaauuucuuguaggcaaugaggcugauguguuacaggaagaaaagcacuggagagaaugggaugcuguacagaaaaggucuuuuacccgagcccccugcugggccaggcuagggacuucugcaccuuugcuaggauccuuaaauacugcagucugagcauacuuggaaccaucucuguuucuuauuucucauguugccuuugggcuguaugaucguugcuuuuguguguuuucuuccuucucuuuccacuuuccccuuuaugcugcaguuuuuccacuggaaguuuauggaaauuagggcaaugugcuucuuauaugaauucacuggaccaaacuccaaugccugggagcugaguacaggguucccaaguuagggguucgguucucacaugagucagcaccauuuaccaggcuggguagcaagauugaguggaagauuuccugugauccaugauggccugcccaguccugcccuguccuucuuugcauguccugacuuuacuaagagcauaguuagucacuggguuauucacugucuccugcagaguuuggaagugccaucucccuucagugauuuguggauuaucagucagugccacucaugccacccacugcugacagccacagccaccucaucuuuagacaaagaaguaggcuauuuguaauaaaagacugaugaccgggcaugguggcacauguuuuuaauaccuagcacucaaggcaguggcagguggaucucugugaguucaagaccagccuagucuuguuccaggacaaguuccaggacagcuauugcuacagagaguguaucaaaaagcacaccaaaccaaaccaaaccaacaacaacaacaaaaaacauugaucaaaaauauaacuagguaggaaauaagccacguauauuaaccacaggauacacuguaaauuuguauggaaauagugacacuagaguggaauuaucuauacuauuaccauauucaugaaagacagacagaaagaaaggcauacuaaaacuaaacaaaaaaguaaacaaaacucaaaaagcaguuaucugucuuucucucucccucucucucucccuaaugcuggugucaaacacagggccaccucaugcaugacagacaaguacucaaccaccaaacuauaccccuaguucaaguuagguaaaccuuccaacagcccacucugcuuccaaacgcccccaagcuauggaaaagcucccgugggaugagcauggaguguuguggggauuuugcagucagguuaagauuaacagcugagauuguuucucuuugucaggagguggucuucccagcaguaggacaggguugaagacugcagugggucuagaaaggcagaguaucugguuucuugagcccaguaagguuuugaucccaaugaagucuucagaucuuauacuguuggagcucuacccagagcaaguacacugcucugagcagucacaucaccccugagaaagagagaaaugaugaugccccagagauccugagaacgaggaccaggcuugaaagacagaggaccagucuuucaaccagcugcuccauuuucccgguucaucucccuccugugggguauagcuuagcacagugcuugaacucaaggauauuugagggaugacacuugagcuaucauggggcuauguaucaucacaggcagacuucagugcuuccaucuaggguccaggaagcuggggcuaugggcuucaucuuuguugccuucaguccaaaguagaaaaaaagaccauguauauaucaacuuaacaacuuaauucuuguauauauuguuacauauacauauauacaugcacgauauauauuguauauauauacugaauauuguauauguacauauacaauauuuuguuuuauauaauaaaaaauuuuaaguuguagacuacaaaagacauaaaauaauauaggucugcugauaacaugagcuuucgugaagaaauaccagcugggcaugggcucaugucauaaucccagaauuugggaggauaagacagaaggauugcugugaguuugaggcuagccugugcuacacagugaauucugggccaaacgagacuguggaauuagaaagccugaucuacucaucuugcaggauuauuguaaggaugauauaaugaaguaaccaugcauauccugcagaagucaggaauuguggggaauugcaggcuggucuccagucgaguugaggucugaaccccaauggucauaauucaccuucaugacacgguagggguucccucaugcuccuggaacucuggccccugccuaaguuaccgcccccacagcccccacaagagaagcauggucaguagucacguuagcaauggccaagcuucugaccuucaggcuaaacuccuucccaguuaucuagcaacaauaaagaccauaaaagggcuguucagcccccaccuugcucucuuacucccacucuuuuguucucuuaccucucacucucacccuuucucucccuucuccccucucugucuucucuccucucuccucuuuguccucuccucucucccucuuuuucucuagauuucucucucucucucucucucucucucucucucucucucuccucucucucuucucuuucucucucucucucucucucucucucucucucucucucucucucucucucucucucucucucucugccuucucucuuucucccugcauuucuauaauaaagcucuuaaaccauagagagucucugcuccaucaagaucugcugugcauucuggucaguguugggaaccuuuucccucaucccugucuccuauaaccccggggcuacaggguguggcccuggggcccccagguugggggcugccccuucuccacccccccaguugagugggccagaggcuaugccuaccuggggcugaguggaaagcguccgguagccccccccccccccccaugccugcguccgccugcccagagcacaggaaacucugaccagacguggacccuauccuccccuuccccagggucuuccccugguccccucuuuuuuguucucaacaaggaauguuagcaagguacucuguuuuuauguugauucuuuugauacaugcugaauagcuguucucagaauuuucuuaccuuuauugguacguaguuagcggauugcuaacaggagcaauggcccgaagcaucacauuggcauuuauuuauuuauuuauuuauuuauuuauuuauuuuuaagguuucuuuauuugagauauaugaguauuuugccuacauguauauaugugcaccacauacaugccuggugccuauagaggucaggcaaggacacugaaccacugucuaguuacagauggcugugugcuaccauguggguacuaggaaaugaacccaggcucuuguaagagcaacaagugcucuuaaccagagacuuuucucuccauuguuggggcuuucuuuguaccauggauucuccauaugugaagcagaaguguagggcugggcaugaugguacacaccuacuguucuuguuauuugagacuggggcaagagaauucuuauguccaagaaugaguagccaacccaggcaauaugguaacacuuugucucagacaaacaaaaacaggaaggcaucuuugggaaggcaugugugugaggaagccauuggaggggcugguuucuggggaaaagagaccccagaacaaggccaccagucuggcuugagggcuucagaagagaacagugcccccccccccccugcagugcccucucuagguccauggagguucauguaaaagguuuuguuguccuuccagaacucuacuaugaccgugggaaccaccaugaguuugugucuuuggugaaggaccuggcucggccaggagagaucacccaaucgcaggccuucgacuuugaguucacccauguggaaaagccguaugaauccuacacaggacagaaugugaagcuccggugagugucucugcuguuccuguugggguccugguccugucucacagggcagggucucaagcuccguggcuuuuaaaggucucugugcagcaacuaaggaagagcacgggcagcuucagugugcuaguccguguuaccacugggcuccccuggggaaagccugcugacugaacuucccauggccgcccucagaccugaacgcagccaccuuaccguuaccaucacacggagucccucaagaccaagggccucacagaguuagggagaugaggacgaagcaaagugauuuuuagaauauacugcccucuuagcuaaguuguuuauuuguaaguuuauauaauuuaaauaauagauuuuuuggacaaccauuucuuaaaauucuuuugaaaauucacagauuggcuuucauuugugagguggcugcuggcagacaccccagcuugguuucuaggggaauugacuccuuccaaucuagcucuccugcagaacaucaaugccauuuuggauucuguaacuuaacguacuuggaaaauagauaaguuuaggauucuaacucuagaucugucuucuccauuuuuuggaagagauaagaaaacaauguuuccauguacaacagaagucuuuaaaaauguugcucaguauaacagagucuuuaaaaauuggacacagggcugagccuuugucuuaguguucacuugccuagcaguacaucaucugggacccauucuagggguccugaaccaaaaagcuaaugugccuaggaagaucugacauuauucuuacuauuguagucuuggaaacugaggaaggagagagaugccugggccucuuguauuagaaaauaaaaacccacagcagcucuagacgcauagguuaugugacaucacuggaauacagcagacucuccugucaucugaucaccugaccccaagucuugaucucacaagcucaacuuguuuucuccgucugcuagccugggucuaggauggugaagacugcagcaauaccaaauucccuuuucuuucucccaguuucccuccacccaucagagcuggucauagagucuuugaaauauuugcaccagauucccacuaaagauagugauucagccuaucacucuggaggaagagccagugaggauuaucuagcacucacuuaguuugacuaugcuuuaaaagaaaaaacccaccucagcacaagcucuugucauguacuguaggcugacuucaaacucucagucccccugccucaaccucccaaguacugggauuacaggugucugucacuggagugaucagugacccccaagaccaaguucuuagcacaaaggagauucauuugccucagagggucaaaggacagggaauaagagacggaggaagagggagagggcaaagggaacagggaaggggucagggguauuugucccaggggacaaaggacugccucuggauagagaagagacagaaguggcccauaggcaaauggcaauuuauaaagguacaagaggaaacccguguuaggaugagguguuuaauuuucuuugugcauguuuaauagggcagccaaagggagcuuuuuuuuuuuuuuuuuuuuuuuagguuuuucgagacaggguuucucuguguagcccuggcuguccuggaacucgcuuuguagaccaggcuggccucgaacucagaaauccgccugccucugccucccaagugcugggauuaaaggcgugcgccaccacugcccggccaaagggagcuuuugaaugcuggauuuuaauacuuugauauguggaccuugguggucagccucaggaggaggaaguggccaaauacgggaauagacuuugguggcuagcuuuaggaauguaucugaggguuuuuuagcaaagcagagggaacuggggagaaaggcaagccaccaugcuugguaauucccaccccuacccuaguuauuugccuuagugcuuuuuauguagaaagguaugguaggaagaaagucaaacaauaggguggcuccucacaagcaagcaggcaagcaggcaagcaagcaggcaggcaagcagaggccucaaaguguagcucaguguggagucacauaggcacagauuugacaaauuaauaugaggcacuggcucaguccucaacaacacacagacauauuuaaacagaaucacagugauccagccguuuaauucagcaguagaucccaaauaacuggacacugagucuggaacagagaaucuaacacagcagucauggcggcauaugccuugaggcgaucucugugacuucaggccaggcagggcuaauuuugagacccuaucucaaaaaaaaaaaaaaaaaaaaaaaggcuacauucaaccaacaugguggucugugcauuugggaaccagaggcagauggaucacuauguuugaggccagccuggucuuacagaccacccagagcuauauagugaagcccugucucaaaaacacuuugaaggacaaaacuauguucagucaguggcauaccaguggaucaggaucucaguccuuuccccuuccccucuauguuguguugaagcaaaacagugguuuuuguuuuguuguuuuggaggugugggggaccgucugugacagaaagucucugugagggagggguaaagaugugcuuaggccccaaauagaaacagcauaaagcagaaaagaauuagaaagcuugacuugaaucuuuaguaaagugcaguccucuacaggcagugagauggaucugagauccgagcaggacugccuggaagcugucggugccccacugauguggcucacuugcagggcuguuagcauuccaaucgugcuuaacaggcacuggacuaucagaggaugacucagaagaaacuauaacuaaggggauucguccucucucagggggucuguauacuauuauauccagggaacugggaugcuggagaaggcagugcugaugggcuguuaaaccuuuagggucuacuuacuuaucuucuuucauaccuaugcccuacccugaaacugccuccucugaugaaaucagagauuucuuugcuacuuuguuguguuacaugaagucacuuuuacacucauaaacccaaucauaguuuuugaauuacucuuucccugucuugauuuuuuuuguuguuuguuuauuucccuccagauugugagcuucaguuagcuguaagcuuaguuaggguuuccauugcugugaagagacaccaugaccgaggcaacuccuagagcaucaucauggugggaagcauggcagugugcaggcuggcaauggcuugggaaaagcugagaguucuacauuuucauccaaaugaagccaggagcagaggcuuuggcacuggguggagcuucagagcucacccacauagugaugcacuuccuccaacaaggccacaccucuuacuagugucacuucccaugggccaagcauauucaagccaccacagcuucucuugagauuuuauuauacuuuucccaugccagcagaggcuaagcuaagaaagacagcugaagugaauacauggcuugcuuucuccauguccugcuccucacuuguauugaucagcuacuguuuacuggagaggcauggaagugugugggcuagaucucugugccuaaauagccaggaguuagauacuaaacaguaagugguaggggacauaaaaaccaugcuguuggaguggaaaguaaagaaaccacuuuuaccaagacaagguucuuaguucacagucagucaugagcucccaaaaggauuugaagaaaggcuuugaucugccuaaaauuguaauuguagaaaucugugcauauauauaauuuuuuucuaagaaaagggcccauaaauucucaaagggauaugaagcgucaagggcuaaaccuuacuaacugugggguucucugaggugagcugcuuugguguggcaccucugcagcaucuagagacuggggggauucacggaggaugacgccaucucuuacagcuauuuccuucgagccaccaucagccgccgccucaaugauguuguuaaagagauggacauuguaguucacacacuuagcacauaccccgagcugaacucauccaucaagauggaaguuggcauugaggauugccugcacauugaauuugaguacaacaaauccaaguaaguauccugagacccaggcuugugugauuguuaaguauggaguuuaagagaaaucugaguugcgugucuacugagagccucaucauaaugugcugcugggggagaccacaaaaguaguacacuagauguuaggcuagguagagauagauuggccaggaaauagaaacuucauaggucaguauauuaaauuauuuaugaucacaucuguaaacaaacacagaugccuuucacagucaagcuaaaguccuuuuagguuguuuguuuuggaugcuagacaaagcuccuuccuuccauggcugagaacaaccauggaauacaaugccacugucauuuuuuuuuuccucccugccuuagaaauuaaagugaggaaaccaugcaccggcaauggccugcuuccuuccugaaccaaaaugaguuacaguacagaauaccugauguauuuuuauaaaugucuuaaaaaaaacuuuuaccugccaaguuggaaagcuguguuuuaauuuguguuuacuauuagaacaucaaaauauuucauuguuuguaaggcgcagaauuuucuggcagccauacauuuuugaauauaaucuguuccugagaguauuuggagaucaauccaaaacuggaagcaacaucuucuaaguccuccauacucuccuuacuacaguggucuuccccaggugggcuaccaaccacaggcuaggcauuaaggagagccaggucacguacuaaggguuuaggaacaagagaaagacucagcuacauagaccaggcuggccucaaacuugugaucccauucuuaucucaaaagugcugggauuacaggcuugugcuaccgugccugacuggaacaauuuuuaaaccaggagcauaacuugacuccaagaauaauugugaaacaaagugacacgguucuaucuucccugacuuggaaccuagugaggccccaauaaaaugaccauugugaccuagagccauuccugcuuggccuggcccaccuguugguuagggaauaagugcuaggaaggagcgccacccucccuugcagucuucuuacucagcuugguccuguuuguuaacccccaacccucugaucaagguggcgccuagcagcagugcuaucuguaaaagccugaagcagccacuagucagcaguuuucugaaaaacaaaaaccaaaaaagguguuuuacagucagauaccugcaggcagggauagauacuccuagucuuugccucuccuuguauaauaggcuguacuguaagggaacaagaaauauguaucuuauauggguguguuccuguguaaaguuucauuauaguaaaugagugaaugcuucauuauuauaagaguauagaaaaccucagcauccaugcauggucuauaaauauccccacgaaaggcagcugguggcccccuguguugucugcaugcauggggucaccuauucauagucugcagcuuuuccuguggacuguaugcaacaguguuggaacaguggguaacaaaagccuggaaacuaggaauugccuauuugaagucucucucagucaguugaaugacugagucuugcaacuucuuuuuucccacuugccaggacaggaggcccaguucugaaguuccugccaggggucucaugcugaguucuagcuuuagcuggaagagugcacugucuuuugggcaccccgauacagggcugucuagccugaggcaaacuauuugcugggaacuguuaaggcgcaguucccugaaggcauuguauggagaguaaaguggaaggaaaagacuuuuucugugcuugucagacuggccuaacaccuuagaaaagcacauacauuaaaaaauacuaaugguacaguugggcaagguggugcacaacuuuaaucccagcacucaggaggcagagacggguuggaggccagccugguccacgaagugaguacucugccagccaggagaaccguguugaacagagaaacccuguuuuggaaaaacaaaacaaagcuaaaggugcauccuguggagauagagaaauuaauguugaaauaaaauguaucucuuuugagcaagauguggaaaaggaaagucacacagauuccaauaagcuuguaucaggaaacuguucccauagugagguugaacauacacguccauuaucccugucaccaacaggggcauccuagauagcuugcuccaugcugaaacacagagcggcuagccacuccaccaccaucuuccucccguaccuucucuucuucagauaccacuugaaagaugucauuguagggaagauauacuuccugcuggugagaaucaagaucaagcacauggagauagacaucaucaaacgagagacaacaggcacgggucccaacguguaccacgagaacgacacaauagcgaaguaugagaucauggacggggcaccaguccgaggugagccuccuggccuagggccacugucacuuugcucucagaccacgugcucaguuucagcauuggggaagggcucaaauuuugaaguaaaaucucuuuuuuauuuuaucuauuuauuuauuuuuugagagaaggucuuccuuguagccccgguugguguggacugcaugggaggucccagcacucaggcaggagggggagggaagagcugaguccuuggagcuccagcuuccuaccccaucuauagcuccgacagccccacacugaccuuuuauauauacuuaggguuccaucucagguggccugccugcacaugccgguuaucucacccccuugguagguggaggaguucaaccucauccuuggcuagagaggauaaggucgucuuaaaguauuccugcaugcaacccuacauaucaaaacaaaaacugaaaacuguuuuaagauuuauuugaauauggaauugcucuuuccucugggcauuuggauauguuuuguggcugagggcaagaggaccaugcacccuagucauuuucauugcuuaguucuagcuacaguaaagggauucacaccaggaacucauuucugugccgugagagugcacuacuagauugcuggccaugcuccaacagcuucagacaacaccagaaaccaccggaacugguccuccucgagcaacacagggucucuaggaugaguaggcugaaagcucauugcuguuugggaaucuggaugguuccuggggaugggcaaauugaaaucauuuacguuugucauuggcuuuauagcaacugagaugaagguggucucauuucccuuugaaguacgugguaguacauucccaauggguauuccacgaggaaggaagaugucacacugggcauuacauagcacuggagacaacagauucuuaaguguuuacucugucagacccuugacaguguuggaggccagcugucuuaacucugauguuccauuuugaccaguugugcaaguagaggcaaccgucauuucugcuguacaaaugaaauggggcccagaagagcagauaauuaaagguucauuuauauuuagcuugagguuggccuuucucaguagaauagcugcccucauuuuguuccuccuuaggcugugcuaggaccuauaaaaugugucccuggauucucuggucuccagagaaagcuuccgaugcauucagaaguaaacuggugacugagaacaggguccaggaugaguuguccacuuucuaggccacucuacugcagaucacuacugcaguggagaugcaugcugcggcauaaacugaccaguuucaagggagggauaccuguuggggagauagcuccguccgugguuaggagcacuuacugcuuuuguagagacaagaguuuggguccuagcacucaaaucagguagcucugucagaauaacuccagcuuucuucuagcugccucagauaucugagcauacauguacguacucacauauggaugcaaauauacacgucaauaaaaauaaaucuuuaaaagaaaaagguuuuggguuuuuuuguuuuuguuuuguuuuuuugguuuuucgagacaggguuucuuuguguagccuuggcuguccuggaacucacucugcagaccaggcuggccucgaacucagaaauccaccugccucugccucccgagugcugggauuaaaggugugugccaccacucccggcagaaaauguuuauaaagaaaaagaaacccaguaauuuaacugacuuauugggucacaccucuaauuccagcacuuggaaggcugaggggaguuggggguggggauugcugugcauucaaagccaggcagaacuauauaaagaucacauuucaaauaaacaaggcuuccccccacccggcccccaucaaacaaggcacauugcaccuuggugccuaaugguuucucugugcuguucugcggcuuucacugcuuucugcaaugggaggguaugcucagaaagcauacacacuggaauggggcuggauaauccuguuuacuucaggaaacuacugagaagccagguguaacaccucaaagggcagaagccuuugcuccgugucccuugccuugcucagcuggagucugaccugcugcggccagagcgagcgagcgggugcuguaggaagguguggugccucuuggugccucucgugucccuugcccugaucuuugccucuccccuuacaggugaguccauccccaucaggcucuuccuggcaggguaugagcucacacccaccaugcgugacauaaauaagaaguucucugugcgcuauuaccucaacuuggugcugauagaugaggaggaacggcgcuacuucaagcagcaggugggugccucguccaggacccuggguccccuugggcacaacacagaaaggccaccauucccacagagugccaucuugcuaccaccucggccccuccagcaggagugcaaauucccaguucauacccaggagcugcuuucucaggccuaaccccgcccuaguggcucacacagggacuuggguauuagcagccagugcuuuggugagagaugaacaaaggagguuauuccugguggagauucccugggacccaggugggaaccccugagaaaagcauccccgagccucucucaaguacuguuuugcccuuucuuccaacucuguaggaagugguguuguggcggaagggugacaucguacggaagagcaugucccaccaggcagccauugccucacagcgcuucgagggcacaaccucccugggugaggugcggaccccuggccaacugucugacaacaacagcaggcaguaggccccuggggccaagaaguugcugggcuuccaccacagaacccccaucugccgaauaccagccacugcgggagggggaggauggugugagguucaacuggcuguuacuugcaaccuuggaaacaaaucauguuuuuuacuuaaauuuuuuucucugaagaaccuaaggggcuuggguugggcagcagucuccccgggaugcugcagccuagguagggauaaggagaggaaacauucuggaagcuaaucucuuccuugggaaugagcucugugucaaggcugucucaagccuuaaagcagaguugagagcacacauccuuggcuccagguucucugggcuuccugauacagaagcugagugugucccuggcauuuaccugccaccagggcucuggguagucgugucuuauacucccugugacuguucugagauagugacagaagggccugucucaucuaacuuggaagaacacucaagaacaggaagcuaccucucgggguguccgggacguggugcucucgaguuucuacagucaccucuggccucucacuacugggaccagacccuucucuucuucaucuucucuagcuugucaagaacuauacaggagcagaagcuuaaggaagggucugugucugacuccucuuacuugugagaaacaggcacagagaagcccugauucggugucacacauggauggcaaggggcugaacuaggucuccugagggggaaaaagaaacaucaggcaaggcaaccgucugccuucaccacaugacuccucuuggcaacccagugucuggguuguuguagggaauuacuuuaaguuauccaacaagcccuaagcagagggucuguuuccuuuagccuagauccuagaagaggcugggcuccacuugccuccuaaagcaguuuguccuacuccuugucuucugcuugauuucuggaacugggcuuuguuucaagcauguauaaguuuuguccuuacucccacccaaacccuuucaucccaccaucuacaaauuaggggaggaaggaccucugcacagggcucugcuacugugacuagaguaauucugcuugccaaaugacaucuaucuucaccaauucacugacucaaguuuaggaccacuauuuuguuuuguuuugaauuuaaaaacaaaauaggacaacugugguggauguuguuauacuagagaagagguaguucuuccuccugcucuaugcuuggccugcaaguagaaaagggguugacugucuuucuaccuugucuggaaaugacuagaauuaccaucuccuguuggcuguccuccccugucugagaaagaucaagcagaccugauguucaacaaguaguguucgcuggucuguguuccuuguaauuuggaaaguaaaggauuuguuccugugucaucuuucaguucauguagaaaaugggacucuugcaaucucuggcuuugacagggcgggccguuggaugaaagacucuuggaaugacuggggguagcagagcuaaggaaaguaaaguuuucuccaugcacaaccccagguuuaggugugacauacaauccccaugggaacagguucacccauccagcuguccuuggcuaucaaggcugggcccuagcauaugagggaguuggguucugggcucuugcccuuuucaggauaugagacuagacucugccgugccuccuuuuaauaucucauuaaaaagcauuugucaauuucucugccucccagccgacaacacaaaauuauuuuccaacuuuugcuaauaucauaagccuuucuucugggagaacuagaagguagaauaugcuguuucucucaggagcugugcacaagccaaguauguuuucucugccugucccccguucuccuuucucugccaacugugaaaguaugggaagguucccauccccauccuuuaagguucccaaaccuggagugcauagguacuaaaccaagcagugcaacuuguaauuaagaagcugcaguguuuacauguuucuuaauguguugucuuuucaauggcuguauuuuaaaagaacauuuguuuuaaugaugucucuaauuaaaggaagcccuauggcuuuggaggcauugugcccgugauccaccagauucuguggucuuuccuucuuaacacugucucaucucugacacaguaugcagcaugccuuuaacacugccuucuuuuccaguggaugguaaacaguaaugagcacuguacuaaccacccauuauaggcaaacauggcccaguucuggccacacugucuggcaaugugccugaaaccccguuuuccaccguggugggacaaagaagacuaaaaguagcauggaaagaucaagacauagauuuacugaguguucaaagaacaagagacucaguccuacauuuugcuguuuacugcguaacuacagagguaggggcaggugaaaguagaggugccuacaucuucuagcugaccaaaggaaccaggcugggauaugacaccuccaguggaggauccuucuacacacaacacagguuuagaagaaaacacuuccaaccuugucauuaaaucuuuuauuaggaaaauuaacaaaccauccgugcacacgaccccagguggauacagcaagcuuucuccuucugucuuauaaaaucuuggcuuguucacuccaucaguagagccuucugauuaacuugguucuguuuccuccaggcucaaaauaaaaucaaacucuucuacaaaaaagagggguugagggugagacugagguguuuaucgugucccgcauagggaaguugaagggcagcuccugcagggggcagcugucuauuaagaagcuggaacagcugguacuggguauauaacaguggacaguguagcacauagccuugcuuguggguggcucaggugagggcaccaacucucccauguuaggucucaccuugagucagaggcugaacggaaagucucuggcgggugaagagagucaugcuuuuuaaggggccgccaguagcuuugugggcuuggugauagguuuuaagcuccuccagagggaugaagcgcuucaucauucgaacaaacuguacauccaccuauucgacagcauuugaagggaacagaaacacguucggccagacccugcccaauuuuaagggauggguccacuguguugccuaguguguccuuaaauuccuguugcugaaucaauuuucaggccucagcccaccgaguagcuaagcgcauguacagccuugcuucugugcacacccagaguuuuugcuauuugcaggaggugccugguauuagggcugccaauauucugauaucccaauucaguaaaacuucaucuagcugagagcugggcugugcucccugaccuaacaguaccccacauucuuuucccccuuuuguccacucugcccuaugaaacaagaacaguucuuaccaucgaccauuuagggucguccucuuugcuggauggaucguaauggggauuacuuuucucaaacuguguguggucuggguaagccuccuuuacaaucugaaagcaaaaaaccccaauccagucauuuuaaaucccugcccaaguuuuuuuuuuuuuuaauaaagauuuauuuauuuuuauauaugagugcauuguagcugucuucagacacaccagaagaaggcaucagaucccaucacagaugguugugagccaccauaugguugugggaauuggacucgggaccucugaagaacagccugugcucuuaacugcugagccaucucaccagccuccugcccaaauuuuaauaugcaucuaacucaaaucccacccccaccccccauucuaaucauuuucccuugccauggagacagcugguacucuggaaauaacaaucuaaggaagcaaagccaggaaggagagcugaauuuuccaagguuucacagccauguucuaaaacucaaugauaaguuacuguuggaaacagguuuuuauuuucucccaacuccacacaguuuuauccugaaauucuuagugaagaggagcuacuugauggaaaccucagauagugacaaguaguaguagggccugaaaugaaggccuuccuauucuaaucucugucacacaggugauggucagggcacuuuuccucacugacugugacaggccgagugaggucguuuuugccuauuuaagcuguaggccuuucacaaaucccuaaagggaagaauccaggcucagaugugugcgucuaaccuucauaaguccaacaaugccaggcuguuugcaguugcuaugguagaagaaggcuucauccuccaauuucauggcccugaggaaguuccgagccugugucaaagaagaaacaagggcuacccacuuaacagcugggaagaaagcaagucuguuuuuauucaauguuuauuucuguuuugcagcuucucuccauucauaaugaaaucuguuccuuuguucagaguccuagccuuguuccaggacacuagccagaaccaagcuacuuugcagacugcaugcugucacagcgauuaugauauuucugaaaacauuuucagauagaguucagggaaaagcaguacuggcuaaaaggcccugcuccugcagacugcgauggaggaggcaggcauguaccuaguguggucagcuucagggucccugcccucauuuccuuaccugauaguugcgaacaccaucccagcaagcugucugcuugggcugugcuuugagauccucgaugcugaacuagacaaaagaaaaucaagccauucauuacuaaaaggucacuggccagucgguaagcuucuauggaaacaaaaaguucucuccuuaauccugaaaagugcuacagcuguaaaggagcuagguagguuacuggaaacuaguuccagggagucacugguguugaacguguaaguagccuuggguuuugcauugugagcuuugcuaauuaauuuaguugaauggauaaucaggauaauaaaagucugcugguucccuguauuucacuuauuaaaauaucauaauucucuaauauuucuauuuuucucaagcuaguacuaaaauuggcuaaucuucacuaccugaauacauggccacacuugucagggagacgucugggagcacggcaaccaguaagaaaaaucuaccaaccaaggagggccaggugugggggugcacgccuguaacuccagcccucauaaaccugaaugcaaggaggaacuuaaauucaaggggcaaccugggcuacuucaaaaguuaagaggccagcuugggcuacauaguuagaucgucuuaaaaacacguaacagcaaaaucaaacuaagauugacacuggaaaacugaaccaaaugccugauuuuauaaauaaaguuuuaccuuuuaauguau

SEQ ID NO: 4985 - RNA, 5994 nt, Mus musculus
caacuacugggccacaugguggcuacauggugaguuuuugagacggcuuuccaaaggagcgucaccauauauauauauuuauauauauauauauuuuuuuuuaaauuuugugucuuuugccugcauaugucugugcacuguaucugcaugcugagugugcagaggucagaagagggcauuggcucccauggaauuggaguuauguaugguugugaacccacauagguugcugggaaccaaaccuggauccucuaaaagcaguaauugacuuaaucacugagcaagccaugugcccagcccuggcuucuccauuuacacucacgcuucggugcuuccaccauagucacacacacacuugugaucauuugaccuuuauuuuaauagucuuagaggguauaagguauccaaguggaguuucaucucuccaugugcaaagugggcagugucuugggagaaaccugaucaacuguuaggugcauuuccacugaguuguagagucauacauugcagaggcaaguccuuuuucugacguggcuugcagagucguccguaccccugguacagacgguguagauugcuuucucggcugcuuacuuccuuuaaagcagagccgcuguugacuugauggaauguaguauaacccccaguuuuugugcuugugucuuuguugucguaucuaaggaaccaucaccgaagccacggucaugaagauuaugccuucugagauggcucaguggauagggcacuggcugcucuugcagaggaccuggguuugauuccacagacaucaggcauauaucugcuguacagacauacaugcaggcaaaacacucauccauauaaaggaaacaaaucuaaaaacuuuugcuaauauugcccaggcuggccuccaguuaacuguguugccuaggcuaaccucaaacuccauuccuauaaacuuauaguguugcaaauaaaugcccagcucuuguucaacucuaguggguauuuguugacuagggaggcagccaggggucagcuuucuucuuuuucauguggauagccacaacauccuuuguagacuuuguuuuguaaauauuuauuugguuuuccuuucuuaacuuuuccuugaauuaauuuucuccuccugggaauaauaaggagaaauaagguuccuggcuuuaucuuaacuaccagauacuaguucugaugcucagguugcacaugggaagaagucaguggccugguccccaugaagaucacgucuuucauacagggagggacaggacaaacagcacuguacugcagucuucuugcucugccaucaaguccagccccacagucuuccagugucuaggaucuugugucuucuuuuuuauaggagaccuggcaggucgcacagauguguuuggaaaaacuucccugaggaucuggaaugugacacgaucggauucagccaucuaucgcugugaggucguugcucuaaaugaccgaaaagaaguugaugagauuaccauugaguuaauugugcaagguaggccccauuaauguguagcaucucuacuggccagcccuaugagucagcccuuagcucuagaauaagagacuagcucauauuucgauucauuccuccagggcuguguuccuggggcuaucugcaguuuggaaggggggccacugaggcugucuagaguugggcugggaugaugagaacacgcaucugcuguguuccuuaccggccucagggaucugccuuugcagccuccuuuucagcuuacuccugaagguggaagaacuggagacugugagauuggacacacgggcuggaaugaacucagagugagcagggugcaggcaguggaugggcuguggccuucggagcugcuuuauuacgcuagguuuugguaugaugggcuugugcugagauuuuaaacaccaacccguauuuugccugcagugaagccagugaccccugucugcagaauuccagccgcuguaccuguaggcaagacggcaacacugcagugccaagagagcgagggcuauccccggccucacuacagcugguaccgcaaugaugugccacugccuacagauuccagagccaaucccagguuccagaauuccucuuuccaugugaacucggagacaggcacucugguaagagcccuuccaaggugaggaagcagaugcguuuguuggaaccuaggaugccuggaaggagagccagggaggcuccuuuucaaggcagaggcaaaaucuagaacaucagaaacacuacaggaaagguggcuucggcuuucauauaaacaaguguuaaggguaaaacaaaauggaaaccuguacaucugcaugagaacagggggcagguaaacaaguggguucauguuauuagaauccuaguuugaauaaucaacggaacauaugcaccacgugaaggaaaugugcuuacugggcagguguuugauauuaagccauuaucaacagaauugugauuauaguucuuaaguccuuaucauaaagagauauggauuaaauaugucuugaauuugcuucagaauaacuccuggugccugguggugguuggcaucacgugccuuuagucccagcacucaggaggcaggcggauuucugugaguuugaggccaucuuggucuacagagugaguuucaggucagccaaggcuauacagagaaacucugucucaaaacaacaacaacaaaaaacaauuaaaaaaaaaagaaaaagaaaaaaggcuaacccacugggagguaggaggucacaugggagcgagaagaaaaugcaacagcauggcuuggccaucugcaaaggacaugcuggcuuugaggcacucagcagggaggguggcguccugguuugugaaauacccaacuucagggagugauugggugaaucgugacucauucuaggguauugguauuugucuaaggagagcugcuaggaucccuugaacuucagagggacagugaagugggcugcuugcagccuagcuuugcccagcuuugcucucucugcaucccgaagggaguuccuugugaagcucugaugcaggagggaaauggugaggacaguagagcugcuggugagcggacugcuuuguggcuucaguggggcgucuguguggugucacccuugaugucugucacucaguuuguccuguugagugaaguaacacuuugucauuucuaaaacagguuuucaaugcuguccacaaggacgacucugggcaguacuacugcauugcuuccaaugacgcaggugcagccaggugugaggggcaggacauggaagucugugagucacuugaaaagauuacacugaagacaagagugaauagaacauuuaaguugaauguuaguucugcagcugacaggggacucaucagauccucggggagccuguugggaguauaaaagagcaugaggucuaaaugagaagauccgcaaagcagcuuccugggggcuuggguaucgggaacauguuggcauagaacuugcaccagguguaacacauuuuuuugguaaaugauugaagcaucaaaaacauucgcguagggagcccugacgggaaucuagcagcuauuuuugcagggaacucaaagccucauucuuuucuccugugaugucaucagguagugggcucuuggggagguguugggaggaaguggauagggugagcuaagccacuggguuccuuccuucauucucaguuguggucacuccagagcaguguuucccuagccuguuggaggacuguugccuacaucaugcaggggccacuggaacuugccacagugucuguguccaugucgcauucuaaugcaugucagcaguccaguuuggagaauuacuguaggguaauucacugcuguaggaaggugugcagagagggagaaaaccauuagagccucugccuggaagagugcaggggguuauaugagggccaaggacaggcagcagcugaaguagaaggucaaguuugcauuuaacgguauuuaugguuaagauuugaagcuuucuuuugcucaagucaucuccagcaaggcuggcuguauaaauuaggaagguuacuuuacuuagggcuccuggcucuugaugcuauauagaaauauagccauuucuccauaaauaauauuuacaagacuuuaaagccuuuuauacacugguaagcaucucucaguggcuuugaguguaacugcuuuuguucuaugauaucaggggcuaugguagcuuguauuuucuuacccagagagauguuaaugggucaguuuccucuucuggcuagagugggcaggaguagacagagggguaaaugggucagcagagggguuggaaagguaagcuaacggggccaagguccuuugauggaccacaccaucucugucuacgaacuuuuucuacagaugauuugaacauugcugggauuauugggggaguccuuguuguccuuauuguucuugcugugauuacgaugggcaucugcugugcguacagacgaggcugcuucaucagcaguaaacaagauggagaaagguacgccugucucgucugagguucagacuuguauuagcaguguagcugcacuacugagcuguccucuuguguucacagcuauaagagcccagggaagcaugacgguguuaacuacauccggacgagugaggagguaagagcagaaacccuagugcucuguaucuaccaggaaaacuacuacugcuuggaaacucuguggcucucaggguuuggggauuaaguguacucccugaccuucuuggcccucaugguaacuccuuccucaccagcucaugagugcuaauagagguuacugcugcagagcaaggauguaauucaucucucaguuuugcuccugguuucauuuuuaggggacaagauuagcuuacaugugauuugaccaauguaugucaaccaccacccaacaaagcccccugaacugauucuuuuugcugccuuugcagggugacuucagacacaaaucguccuuuguuaucugacaccugucggcugggagagcacaugcaaguaccucuguuggaagcuggucacagggcugcugugagcccagagcuccugacaaagccacccgggcagaagcuuuuuguuuuggccaaaguugaugacuccuuccuuccuuccuuccucuuuaacaagccacaagaauaaaaggaagccuccugaagauggauguagacacagacuguugcuagccugaccucauuauggggauuagggugaucuucaaggccuuucuggucuccguucucccaugcagggcaauuuggacuguuuuugccccaggcuguuuagcugccaggacaacacuggcagagagaggcugaggcgcugggcugcaguagcagcaggcaacagccugaugccugugacagugccccaggaagguuuucaggcagugccuugcucccuggacccugacccaccguguugccucuguugauuggccaguacugucauuuccauccuggagaauguguuuggaaucagcauuuuauaaaaaacccaaaucagaaaggugaaauugcuugcugggaagagggcucugacccaggaaacucuccuucccaagagaugccaggagauaggagaaccugucugucuuaagucugaaaugguacugaagucuccuuuucuauuggucuugcuuauuuuauaaaaauuuaacauucuaaauuuugcuagagauguauuuugauuacugaaaauuucuauauaaacuguaaauauauugccauacaguguuucaaaacguauuuuuuuauaaugaguucaacuuaagguagaaggcuugggcugcuaguguuuaauuggaaaauaccaguaguaaagucuuuuaaggaguuuucuuaaggaggcuggcugaauauuccuuuguucaaaagaaguuuuagcauuuuucauaagaaaacuuacucugucugaccacuguugcuuaggaaaccauuaaagaauuccaaucuag

SEQ ID NO: 4986 - RNA, 2273 nt, Mus musculus
agcaauuacacgcgcgcgcacacacacacacacacacacacacagagggguuggggagagagggggggauagaggcagagagagacagagacagagagaggcacagacugaguuccaggcaagccugagcuacauaagcccagacuguuauuuguuagcaaaagaaagaacaaaacaaacacagaagugcuuuaauuaaaccgugguggccaaagaaagagaagcagcugucugagggucggcuccauccaccauaagcuugaggacagcugcgagguugcaccucauucuaaagacagggauguccacugggcaggaacaaaugacaggcacacgggcgaugggcacacggucggguaacuuucugcuucccaugaaagcaaccugcccuccuuacucucaucaccuuagagaaucauucccucccccaagcccuagucccaucccccuacuccccaucccagcccgggagcucagcggcuggcacagggcagugcucaaagugcagcaacagcaagccaggcaaucacucgggcucuuuuguuugucccuaaugaugggggcagggcagguacuucagucccccuuaaccauuuguugacgccacagcuguucuccuacccaaagccaauggcaauuaaucgcugaaaugugucacaaagaauacaugagcaaacaacugaacuccagggacauuccuccuucauccaauucggugcugcugugaagaaacuagauaaaggcagaggcuacuuguauuaaacaaaucagguuuucccuuuacuaaugucaaaucuaaaaucccaguacuguaacuaugagaaaucaaaacaaaacacaacuuuuaaaaaauuauauaucuauauaaaaaagaacaaaacucauuaaagacuucaaaaauaaagcaaaaggaugaggaagggaaggcacaaagccaagagcgagcagcccagggcacugcuguuuagaaacaaccuaucaaugaucucuacauuuuccccugguguuuuacauaacuguaaucacaaauuguaguagucgcagccuguguccuuuaaagcgccugauaaacauuucuccacauuuuuccucuuaacuuugcagcuacacagaguagaugacagaaaauaccauuuccuuccacgacaacuacuacaguaaaaacugagacuacccugucguuccugcagccgcugaacuaaaauaagaucuacuaaaaaugccuagccacgcagagugguuaaaaauguuaacuggcuuucaagugacacagacagacgacaggcaagacuuacuagagccaucucuguccugggucaguuucuucuuuaacaucacugcuaacuguccucacaccaacggccaaaagcccagugugaguggucauacacgcauacuggcucuucaaggcuaggcuucuuacucauugugugcccgugcuguggugaacaguaccugacauaauggaggagacaugcuaacacgcugguuggaaugauuacuacgauuaugauuauucagacaggaaagaugacugugaguugaaguuaccagacacaacagacgauaugacuggcagaauuugacuuuaacaauaauuguagaaacaaaguaaaccagcguagacugggauacucgacagaugaaagacauaaaggcuggaaagagcucagcauuuaagggcauuugcuacccuugcagaggacccaguucugggcccagccccuacacagagguaacuccaagccaucuguuaauuccagcucugggggaucuaacacccucuucuggccucucugggcgugugcauacauacaguacacauacagacaaacaaguacguauucaugcaaauaaaguuauggggacugaauaguucagugguuaagggcacugguuuucuuccagaagacuugaguuugauucccaauacuuaccuggcagcucacaagcaucuguaaccucagucucagagaagcugaugccuucuucuggccuccuugggcacuccacacacauggagcacagauaaacaugcaggcaaaaccccaguacauaugugugcugguuugagugcgaauggccccuauggcucauacauuugaaugcuugguucccaguuggucaagcuguuugggaaggauggggacguguggccugguuggaggaggugugucacuggagaugggcuuugagguuucaaaagcccaugucauucccaauuagcucuuuccuucucuuuucuuccucccuccuucuuacagauuaagaua

SEQ ID NO: 4987 - RNA, 2459 nt, Mus musculus
uccuuuagggggaaaacuccagauccuguuugcuuccuguauaguaucacaggagaaugggauuggguuacuggggaugcuauggaggaggaacugccuguaacgaugcucauguccucuccuucuacugucccuccuaugguuggaagaaugaugacuuaaaugaaaggggguaauccaaacccacaacauguuauagccacagcgugagcauuccaguagacgccauauuuuuagcugucuuuuagacuucuacauauuaugguguagaaauagcccaccugugccagcaacuuaccacagaauccuuuagccuugagcaggcacagaacaccuagguguacagacucaucccugggggccaagaauucuugaacauacuucccauacuguagccuuuggcaaaauaagaaauuauugaggugugauggugacauauuucgggggacaguucacagagaaggcuaucacccagauccugaguucuguggaacaaacaucaugcagagcagcaagccuccuuuuuguguuccugaaugaagccagaaaaauauggcaugugucuuccuugaggguguuugaagcuggcuuguaacacugagaaagaagaagagaagcauuauaaugguugaggaugcuagaaacccaaguuauagaugccugauuucugauuucuuccuccccuucccuucccuccccucuccuccccuccuccuccuccuccuccuccuccuccuucaccuccuccuccuccuucaccuccuccuccuccuucuccuccuccuccuccuccuccuccucuuccuccuccuccuucuucuucuucuucuuucucucucucucucucucucucucucucucucucucucucucucucucucucucccuuuucucuuuuggacaggcaagaaauggaccuggcuaaucuaaaguuccaggaauugcuuuuuacuacacugcuacaaacacauguuuaagaacugugacuuuagguucaccauacaagaacuauuuguacaccugguuauaccuguugugcacaugugaggugugugacaguguucuaugcaacugugaugugugcaacacucaccaacucuguccaagguagaacagugaagcagcaaugaaauggaugggcuucuggcagacccuccucuugggcuuugggcucaucugcuuggcacaacucagaguagucgcuugauggucaggacaggcaaguuuuacguagaccaccuaacuacucugugaccuugagggcugagugcaguugaggagcacaacucuggguauccagggagacuugagucauaaucaagcuugagaauauagagaaauauagagaaaaguugucaagaagacaaaaccuuguauuugaagaggcaaagauggaccgguagaaugacaacucugguccguagaaggaacugaccagaagcuacagugcaagagacaaguggauaguggaagagaaggaagccaaaaaaggcacauguaguguuguucuguuugcauuuuagugaaaugggcaugccuuauaagcugaggguuugagaagcuugcagaacuuuucuucaaccaccugcaccaaauaccuuaagauuagauauuagaagaccaauuuauuuuauguugaguuccuccuccucccucccuccccuccucucccucucccuucucuucucucacuuccuuucccuccucucuucuucuucccucccacuccuugacuccccccaccccuuuucuuuucuucccgagacagacaaggugucacuauauagcccuggucggcuuccuaccgacagaaaucuaccugucuuugccucccaaaugcuagaauuacaggcaugcuccaccaggcuuugguaccaagucuucuaaaacauucucucuguuguauuucgaaaaaacaaggaagcaccauugucuucucaaacuggcuaggauuuugcaagugucaaggguaagucccugggacuaagaaacauuguagcaguuugaauuaaaaugagaacauucuuagacccagauauuguaugccaaacuccuuugugaugguuaauuuuaggcaucagcucuaguggacaaaagcagugguucucaaccuucugaacacugcaccccuucacaauaguuccucaugcugugguggcccccaaccauaaaauuauuucauugcaacuucacaauuaauguagcuacuguuaugaaucgaaauguagaugucugauauguaggcuaucugauaugcaacccccaaaguggucauggcccacagguugagaacuguuggucuaaaggggacuuagagagcagguaaagugucugggaggguauuucccaaaggaauuaggacuggggcuguaggcugaguguuugccugcaccacugcgaaugggcauugcauaaccugcuaagagcaagaccgaagaacaagggugaguugccuuuuu

SEQ ID NO: 4988 - RNA, 40846 nt, Mus musculus
uauuaaacacugguuagguaaguuuauuaaaaauguuuggguaguaggcaacuaaccauuugugcauucauaguauauucaaaucugucacuaagguuggcuacaagcuuugccacuagggauaaaaauccacagggagguguguccuucacagggaggcugccagggcuguccuaacacacgacucuuaggauagaguagacucaaacacuuucaaucaaaacaaucuaaaaagaauucuucaaaucaauucaucucugauuuauucucauuucuuucuuccuuuuacuuuuuucuagcucuuaacaacaaaacaaaacaaaacaaaaaacaaaaaaaccaagacaaaacaacccaauuuagaaccaagaacauuuaccauacuaaaauaggauucuagugaguuuuaggauuucuuuauuacuaggcacaguuuucaaagaucauguaugauaaaaaaauaaaaaugacugacuuuccuaguugguuuuucugaaagcuacccaccuaugcuugggagcaaucagccaugagucagguaaaaaacaacugggacucagggugggggugugaccagugacagggcacgugcgcaucauauacaaaguccugggugcaauucucaguaucaagaagaaaaaagaacagagauagaaauuaaauuucagccgggcgugguggcgcacgccuuuaaucccagaauuugggaggcagaggcaggcggauuucugaguucgaggccagccuggucuacaaagugaguuccaggacagccagggcuacacagagaaacccugucuuggaaaaaaaaaaaaaaaaaaaaaaaaaaaaagaacccaaaaacaaaacaaaaccaaaaaaccuacaaaaaaccagaaauuaaauugcagaauuaauaaauuuuaaagaaacaaauuacuauaauauaaaaaguaaguaagguuuggcauugggauaaaagucagaucagguguuugacuaagacuauagucugaucuggguguggugaugugugucuauaauauauaaugguagcaaagguuguugggaaacugaggcaagaggaugaugaguucuggaccaaccuggacuaccuaugauccugucacaaaacaaaagagaguguccaaagucaaacaaacaaacaaacaaacaaacaaaauguuguuuuuaucuucuaaccccaucaggggcuaucauaacgauaaacauuggggcuauuuucuauauaaaaaauuacacaaaaguucauuacucguggcuucauaaauauuuuagaucaaagaggcuuuaauggcaaaagauaaaaaaguauaucccaaucuagaauaucauauaaauguuaucgucugaguagcaaaguuuuuaagauucuggucuuaacaaucccucccuccaugucugagucacagaugaucacucacaaccucgucguaucuuuuacauuauugcuuacaucucgugaaagcuuuuaacaaacuuggcaauaccucaaaauauuuuggaauaaggacauuauauuguugucauaugugaccuuguaaacaaucuuaauuggguuaagaauguagccucaaaacagaauucuuuuauuuuguccaaaacagcacagcaucgacauccucaacaauacauaaaccuauauauaaaauauagaauaucuucacuauuucuccuuuauauggcagcacaauaguauaugcaaaugaaagugcuguuggugggacacgaggacacuucucugagcaaugcccuaguuagccaggugucagcauucaaugaccaggaagagaaagucucaggagaguuucugcaaagcuggguauacguaccucguucugcacccugccauuccacaugcagccugacucuucucaaccacaccucuuagccucuggaguggugcuauaaagguacaggaaauaccugccugauacuaauuuuucacuaugaaaauucaaaauggcuuaaaaaagaauauacuggauuucagaaguuauuuaccuucaucugaaaaaaacaaaaacaaaaacaaacccaccacaaauacuuccaaaacuacaggguuuauaacacccugcacuuaggaguacacauuuacuuaggccuugucaaacuguuuaauaacuucucauuagcccucuucucucaggaaggucaaccacagccugaguucuuuuguaucugcugcugcccacuuuuaacaaugggaggaagaacugccauguucuaagucagcugcuuuuccuuaagucucaaaguuuauguucuguuucaauguuaccuuauuguauacauacagaagcaaucucucagcuaugaaaaaacaaaacaaaacauagaacccuccaguuuuaggguuuacaaagggaacccuucuuuaaaaauuaaauuaaauuuaaacauaugagaccaagcacaggcacuuuccaaaaaaccaaaccccaggccaaucacagaauuacucaauaguuauagcaggcagcucugccuuaggggggucaucccugggcgccucagcaggagcacuggucuuuggcugcucaugcaguuccuccuccuucucuguaagcccaccaagagagcccaggggaaaagugcuuucacaauucuggguugaggagaccugugaaaucacaggcauuugaacagaagaguugcuuucaaaaguauguucuccaagaucauacugaacaagggucucuucuugcuccugguuuaaguaguccgguacuaagaaaucacuaaaugagaggcaaaggauaaaauacaaaauuaauuuucaaacuauaauaaagagauaucaucuauaauacaagucuggggcuuuucauuucacuaauuauucaaugaaguuaauauaaauaagcuuucccaaauaucaacugaagccauucaguagaaccaaugugcaucccaccucccuaugggcaauaaaaaagauuaaugaucacuuccagugauucucuggacacuucaaaggccuuucuggaucuacauauaggagucuguauauaaugugaguggcauuucacuaaagcaagcaucaugugacuaagccgaguaagagguuuauauagaccuagcucuguauuucuuuuguaauaccucuuuguagagguuagcuaagaagcucagucuuuaugcaugcaugaccuuacauacauuuacuauaggaaguugagagauguagaaauuaaguuuucaccuuacuauguauggaaaaaguaguacacuuuacuaagaauuuggaaagaaucuccuaucacaccuggagugaccacuuaauaauuugaauauucaguaguaauggacaaauuaaaaucugucugucugcaaaguaacuucuaaugucuuguguauauuuccuaaaaagucuucaaggguuagagaagaguaguguaagauacaggguccuauaugggaaagacacacaggagugguaaaacuggacuauuuaauuccucaacaacuaugucuaguaaguauuagcuagcuuuaaugauauaaccauacauucagaaucagcacucauuaaguagaaugagcaccuggucuggagggaaaaguaaaaucuuauacaucaauaguuuagaacugaaaugauauuuuuauuuuuucaaaaaaaguuaguauaaaacuaagaguuuagaaggauuuuauguuuugagaaacuaaggauuccuacagaggugaaauucuaaugaaguauuaaaaagcacacauaauagaguuuuaugucuacagagaacuuagauaucugacaugcucaaucagcagcaggacuagcaagagaacuguauuuacuuggauaaccuauaaaucacuaauauauuauuauuacagugaaccagugaugcuaaaaagccagagcacuaaacuaauaaacaggagacgugcuggaccuaaccaccuccaugucaacaggugccaaacaugcuuucugauauguggacacuccuuuacauaaggcuuauuuauuuauuguuuucccagauuugguuucucuguguagcacuggcuguccuauagagcagccuggaacucagagaucugcccgccucugggauuaaaaacaugcaccaccaagccuggauauauaaauuuuaaagagaacucugcuaacauuuauagucugaccuauacucuacuaagauauacgugacgugguauauuugguaauaagauuuaguuaaaccuaguauauuauauauacgauauauaguauauagaaauucauuuaacuccauaaaaacaaaaacccaagaggacaaauagucuucuguggggauauuuuuccuauuuauuuuguaggagauauuuuaaauacaauauaguaugacuuuauaacuuaggagaccuaccaaacuuucaucagaugaggagaucagaguaugcgcaguggcaauuuaaaaugacugugacuaacuaacuaccuggcaaccugacaauaacacagcaggcugcccuaaaagcaggagaguucagaaagcaguuuuuccugaugggguuuucgcugugcaccucaccugcucuggaaguaguuugcuagcucugaugcuucaugguucagacuccucaggugcacgauuaaauuuccagaguuggugaacauggcgccacauguuuugcacucguaaauccgaggcuugcggauaaugugccgggaaacccucaugugguguuuauacuccccgaaggaagugaaaguggcacuacauaucuggcaccggaaacagcguuuaccuucgugcuuuaggcgaugcaucuuuagcgaguaagcccugguaaacuuuuuuccacagcagucacacugaaaugguuuaauuccuauaaaacagaacaacaaaauaccaucugaaaaauaaaauagacugacaggucauaaaaucacacauuccugaacaacaauuuuauaacgauaguuaagagaaaaaaaugccaauaaaacagacucgauguuguuucagaggugguucaggauaugugaagucacuacuguuuuaaaaagggcaagacagggaagaggcaaugagggaagauauacugaauuauuuucugaauguucuucuaaaugauguacuuuccagacuucaaaaauuaauuauccuaguuagcuuuaagugucaccaugacaacagccuagaguuguaucagaauggagucucaacugaggaccugccagaggucagauuagccugaaucuguuggggacugucuggauugcuagucgguguaggagagcccagcccacugcgggcagugcugcucuccggcaggugguugugggcuauaugagaaaacuagggaagugcgagcugugaccgaaccagcaagcagcauuccuccaugguuuugugucagucuauguucagauuucccuacauaauggauugugaccugugcgacuaauaaaccugcucucccuuaaguuuuaucacagcaaugcagaggaaauuagaaaauuaauuauuucauuuguuuguggaccugggaugcacuuuagagccuaugcguacuacgcaaggguccuaccacugaaccaaaucgcuagcuguaaagcacaccuaacccucacuauuuauuuauacaccccaaguccccaauaacaacauguauuucacuggagagguuuacccuaaguguaaccaucaccugguugugaugguuagugcugucaauucaacaaaauguagaaucaccugcaagaugggucucuggguuuaucuuuauuacguuagcugaugugggaagauuccauuaauugcuacugggcucuuucccugggcagggaauucuggaugauaucaacaagagggcaagaagaagacgcccaugcaugcauuagucacugcucucugcucuugacuggguugauaugacugguccuuucaaguuccugugcugugugacagucuugccauggaggacucacuguaacuuggcauugugaggcacacaaaccccuucuccuuuaaggggcgucucuuaggauaguuuauuacagcaacagaaaacuaugauaccauuuuagacagaaauuaaaaaagaaaaagaaaaauucuaacaucucuguauguaacaaucaugacaggcucauuaaauaauaacuggcuugaguauuuaauauuguuagguauuaauaagggaguuacaaagaauauuaaaaguuucauuauaguuacuaucacacuuuguggggaaggaggcuacaacugcagaacacaacacaacguguggauuuaacaaggucacagggaaguggcacugggacagagacuccgagaccacagagagccagagacaagaugcaacugacagcaucagucacagacucucagccuucagguugggguuuuacuguugaccuguguagcaucacuacacacaaacaucacugaaauuuccuacacguucaucuagcauauuuuuuuccuaucaaaacaacaacaacaacaaaaaaaacaaaaaacaaaaacaaaccaaaacaacaaccaaaacacuacaaaguugacuaaucuuuuaaaagcagauacugagagaauuaaaacaaaauaugaaauccuuuaagcagguuuuuuaauuugacggagauuucaaacuuacagagaaguucaaagaaucaccuauguacaauuuuaaacucuauuuguacuugugaaacauauaccuaauauauacaguaccuagcuuauacauuuaccauacauaucugccucuacguuuuaaucagaauacuagauacccgugguaaaauauucuagucuuccaacauuucaaaaagagaccacaguuagccaaucuugucucaucugacuugucaggacugcacauuccuuuccuguucugcaguguaccucccucaucccacccagccuccacuccucuucccacucccuaagccccuuccccucgcuuagaugcaauggagucuuucuauuauacaguccaggcuggccucagauucuagaucugccugccuuagacuugaguggugggauuaaaggcacuuggcacuaugucuggccuggcacaaagucuuuuguauuuuaagcaggauugcaaagcacaacguuuuugccugccugccugcaaccccccgugccgccccccccccccauacaacaacccugaaggugacauuaccugaguggauaagcaugugcuguuuuagauucugaauacgggugaagcggaccccacagguuggacacugaaacggucugucuggaccauuuggacuuggccgcucuguacugcugguagaaggagcaauguagaguugauagggauacugaacauuuuccaaucuaaaaaaauaaaccaaagaagguaacgaggcucugauguuuaaguugaauacacauuucuguaguccaacucuuaaaugaacaaaggaagcaacaaagacuuuuaaaaacagauuuucacuuagaaaaauguauaaagcaauguaauugucuaaauguccagcaucuuuaguguggacauaaaacacaaaacagaucccaggcugcuuuuuagaugcccuucaccucuuuaauucccuccuuucuucugcuuuaacuuagacccuuauuucacccuuuaaaaccugugacaacugucuucuuguagaauaaauucucaacucccacaaaaagugucuaaaacuacucauauaggaauuuucucuucccaguccaauuucugaucauacucuccacgccucaaaauauacuuuauacuaaauaauuccucuagugugcuuuuaugcuguguuuuuacccacugaauguccucuaugagccuaccuucuuugcuuaaguuguauccauucauuuuauaaaaugagcugaucuccucuuccuacaagccugaacuggccuacugcuuagguagguaauggaggcaacccccugcagauuacccuaucuaccuucaaccucucuacuucccugaaaauuaauggugcucucaagagaaaagacuuuuuauuucauuucuauacucccaugacuuagcaaaguauuuaauaaagaacagacuauuuaacaaauuuaaauggaggaauaagggcacgaaugcuuauuuaugccuuugcuaauguauacaagugauuuugguucauaauaucccaggguuaucuacuuaagaauaauacaucuuugaauccuucaaguuuucagcaaguacagguauauguacagacuacucugcacucuggggagcaauucuuccaguggaaucuauauucaguaacgagagacaaacaauaaauaauuggggacagagagaggguagagaauucaauuaggaagaccccuacaaugacugagugcugguuuaaacugguagucaaggcaggucucaucaacaguugacacuaagucaacgaucugaaggucagaggcagaggggcaggagaaacguuucaggaggcucucucuuccagggccuggguuugagucccagcacccccaaugucucacaaccauuucaaacuccagucccagaggaucuaaugcccucuaauagcuugugcacgcaccuugcagaggugugguacacaguacacaaacacguguaggcaaaacaccuguacacauuaaauuauuaaaaaaaaaaaaaucuuaugaacuagaaaggcccgaagggaggaacaaaucuggagugcuguaggaacugaugagaguuggcaaacuuggaucauguagaacauuauaaaaaguaaggaauuuagauuuuguuuguuuuuugagacaagguuucucuguauaguccugcuguccuggaacucauuuuguagaucgggauauccgccugccucugccuuucaacugcugggaucaaagguaugugccagcacugccuugcaggaauuuagauuucaaguaaaaaccaugacaucuuaguuaaaaauaaaacgaucugguaguauacagagaauggacuuaagaagcagaagaaugaaaucagggaccaauaauuuccaaaguacuagaguagucaggagaaagacggcagugacuuaaaccaguguagcaguaguacagaggaaaagugaacuagggauucugaacacagaauugaaaggauuuaaagauuagauucggggcgaucaagugagaagcgaugaaggaaaagggaaaauguauaguucucaggggcugaaugaagacaagaccuuggaaaucacggguggcaucaagaacuacacuuggcaaagaugagagcaaucaucccaucuauaagaauaggggauuaggcaguuuuggaaaugugcaaaacuguacucaaguuucaaucaauuccuuauacaaguuugaauugagagcuauaagcagucuucacaagaaaaggacauagcacgcuggcacuaaccugucaucgucaucugcaugagcauuggugcuagaggugcucugaaguguaggcaauccuucagugacuccuucaucuacugagccugcaaaaggaauuguuaaaagggacaguuguuaauguuuggugcaaauaacccaagaugcuaacugcaagucacauauccaaccucuaacuuaucuaguguucacaucuuauuaaaguguaguaauguuuuacacacacacacacacacacacacacacauuuuuuugagucaggguuucucuguguaggccuggauguccuggaacucaugcuguagaccaggcuggucuugaacucacagagaacugacugccucugccucccaaguacuaggauuaaaagugugccaccaccaccuggcuauaaaccaccugguuauauuuuauuuuugauuaaauguucaugugauuuaaaaguaaaucauauagggccagcaagaugauuuaauaaauguaacuucaauauuuaaaaauuucagguauauuucuuucauaggaaccuugggaaaauaaacagaacaauuuaaauccaaacuggaauccacagaaaauuaaaugauguugauacuuauuuaagaaagcauuguuaagcugggugugguggcacaugccuuuaaucccagcacuugggaggcagaggcagguggauuucugaguucaaggccagccuggucuacaaagugaguuccaggacagccagggcuauagagaaacccugucuggaaaaaccaaaaaagaagaaaaaaaaaaaaaaaaaagaaagcauuguuaauuuguacccuuuaagaguuacuuuauugucacaauuuuuacagucaauuuaaagaacaagggucaggucugagagauggcucaucaguuaaagaacacuagcugcucuuccagaaguccuggguucaauucccaauacuaacaugguggcucuaaacuacaguuuagcauuaucuaguuauaaacuugaauuaugcauucauacauauucauauucuuuauauauucuugcagcuucuucauauacuacuggcacgcauuguuauaauuaguuuauuuucacuguuauagaauuuuuuauaacccauuuccuugugagggaaguaugggauuuucuacgaacucugcugcugagaaugcucuuacagaaguaacuuaaugcacauguguagaacucaaaucucugcucuauuggauuagaaauuauauacuucccuauguuuuuaaugaccaguuaucuuaaucauuucacauacccugggcugggauguagcuuggugguaaaccuaacaugcagaaagccuugaguucugucccuagcaauuccuucucccagcuccuggggcaggauauaacuucccaaagucuagccaaaaccuucacaacucuccacauaacacaaggauggcuuacagccuguacuuccuuuccuacuggcuuugaucauauagcaaauuuucugguauuuuguuugauuaggccugcagacauuacugcucuguuguguagacaaugcugauuuauauuuuuccaggcuuugccgguuugaccuuaaauaggagacuuauuuaugauuaguuuugccugauggaggucauccuugagauuuucuaguaaggauuuaguuaauuugaaaaaaaaaacaaacugcccaccugaaaacaucuucacuuuauuuuuuugagucagggucucauggagcaggagguggcacagaccuauacccaagcccucagaaggugaaggcaggagugucacaacuuucuaucuuuuugauacuugaacccucuguauccugagcugcccuugaacuuauaugcguaccuguaccuccugaguacugggauuacagaguaggccacuaugccugguuuucugcagaaguggugauuaaacucguaugguaggcaagcacucuaccaauugaacuacauucugauccuucguuuucccuauugaacucucuguauguagcaaucuagauuggcuuuuacuuuucuuaggacaacaucccacagggcucagauguucucuccuuuauauauucguauguuuucccacacccugcuuuuucuaauauagucucuauuuuuccugucucuucaacaaaauauuaaaaugauuucuuagacucucaguucuuuuuuugcuaaauuuaaucugcugccaaauauucacuaagauuuuaauuuuguuuuuagcuagaauuuuucuucuaaaccugcuguuacuuuguguauaauuuacugcucuccagucauuguuuaaaccuauuaacuguguugaguaagcauauuugcuagacaauguccaauggcuuucuggucccuucuacuccagguuucugucaucuuuuccuugucaguaugucucuguugccuuguucccuucuuacucugguuguuuguggccuuguuuucugucuuuuaaaaucauuuauaaggaaccaauuuacuggggcugaaguaaauaugaucucuuccaaagguuuaugcuugcuucugcuagguucuugaaugugacuuguaacugacugguuuguccacaugcuguauaaccaagaugauuuuaugugcaaucaggaagugucccccccccaccaccaccuuuuucuuggcuauacauguaaauaccaaagguagacaccgcauuccuccuugaauguacucuauuauauaaugaacucagcaaggucucacuugaaaccaaaacucaccaauucaacuaguguaguuagccagcuugcucuggaggucugugggggagaguguccugucuucuaagcaauuacauauaugccucuaugcugguuuuaugugggugcuggggggaucuaaacucuggcaaaugcuuuacucacugaacuaucuccccaguucccuccuugcuuuuugucugcccacugccaaaggacuguuauauagucuccucgaguuucaaggacaaguagcagguuuaguucuaguguucuagucuugagaugagaaaucuaagacugaaaaacuugcuuguacagaaaucugguuucuauauauacccuuuucucuguguuuggcaaguccucaacacucgcacaccaccuacagagucuauugcuaguugugauuuacuauauuauuauaaggcccugucaguguggauuuguuugagauagggaucucaucuggcuccugcuggccuugaguuccuuauguaguaaaggcuggccuuuaacaucugagcuuccugcccccaccucuucagugcugggaguacaggcauguugcugccaugcccagcugaaaaucugcucauuuuaaacucucaacagcaaguuucgauuugcaauagaagaccucacuuaaucucuccugagaaaggaaaaaaggaggagcagaaaggagcccggagaacuuguggagagcuagaaaggcuucuggagaaagcuucagaaauaaccucucccagaacagaaccaccaggcacacugucugccuggugcuucuuacaaggaacaaaaaucaaauaaugguaaaaccuucaaauggagcugcuucaacuuucccuguuucccauuuaggauucuaaaccuuuucagaauaaccacagcccaauguaccauuucuauaagcacaauggaaguaugguaugaacacagcaagggagguuugucauggcagacaccaggcuuucaugguuauuguacagcagguucuuauguccagguauucuuucaugaucaacaguagguuauuuggaagauugcuuuugagaauuaaaaaugagggcuggagagauggcucagagcaccuacggcucuuccagagguccugaguucaauucucagcaacuacaugguggcucacaaccaugggaucugaugccuucuucuagugugucucaagagagcaauggaauacucauauacauaaaauguauagauacuacaacacagacagguaaggucagggaucauaaaguaagggagaaacaggacugugaugcucaagcaggcacccgagcagaaucuaaggcuucugaguucuagacaucagcacuucucacugguuauauuccuugccgucauuagacaguugggaacuaagaacuguaguacucuuggcaaccuuacgguucagccauggccuuaauggccagcagaucuguaugaaugaguucgaggccagccuggucuacagagugaguuccaggauagccagggccacgcagagacccugucucaaaacccaaacuuucucacccccaaaccaacaaugacaacaacaacaagaaaaaccaaaacaaaccaaaaccaaacaaacauaagaacccgaaggaagggaagaagggagggaggaaggcaggaaggacuaaauaguaacaguuccauuugucuugguaacaacuggaaaagccccugaucacuagugaagaugguauuaguguuuauaggcagaaauuugcaaaacaaagacaaaaccagguaugauaagggcaggccuggauguguauacagaucuguguaucaaggccaggguaggcaccuccucccucugacugcccuagggcuuccgccuggcuugguucuccccacaguugauagcccauuugacugcccauccaccuggccccauuuaaaccuaccuguuguagcuuugccuuuucacccugcaguggacucaacucuguguuucugccuucaagucucuagacuguggaaguggguucuuccccauggcugcuuggguucuuacuuuacuaguacagacucuaacagucuacuucugaaaucucuucaacucuguuguaaccuacuauaaucacucuguaaaucacacacacacaaacauacauuuacugugugcugagugauaugaguggagauauuaaugauuaaaacuggaauaaaagaacauguauuuaccuuaucaguuaccaguguaggugaggccauuugguaaauugcugccaaugaagcugcuguaucucgugacacuaucguuauuugauaaauucugacacugucuuuaguacaguguguuaagcccaagagggcugaagaucuagugguagaaaacuuuugcaugccuagugucaaaaugagcaaaggaaaaaggggagggaaagaaaaacaagcagccuuaaagcucaggaccagcucagacccucucaggagcaggccuagaacccuuagcuagcccacaguauucuguuagacauaccuucacaagguaucaacaucacagcuacaaugcaagaacaggguggaaaauucuaccuugcagacagaacaagaugacuagagucacaaagauauccacagccuucuccuuucuuagccaguaaguuauggacauuguagacucguuuuaaucugcacuuuuagaagauauuuauugaguuccgucauaaaauuaugccuguuuucugguauccaugguacuaagcaaacucugcuuccuggaacacucccuaaaauuaccuaccucaggcuuaaauccucugcuaacuccuaaaaguaucaucuuaccaaaaaccaaaacucuaaaaagcacuguggugugaucuccguuggugcacaggagcagugaagugaacggcucacuccagcuggucugugugacaggacucugacagauucucuaguugccaugcacuggaucuuugagauacugaagauugcagaucccuuuugggauacaaccugcccuugccuggaagguaaaaaaaugugagccaagcacuucaaugacugcccuuugcuguuggguuuuguuuccuguaaauaaggucuuuuaggaguauuuuggcuauuuaaucagauacaaauuguucuuugguaaaacuguucuguagucuuuccaaagacuuuuauuaaaguaagauagccaguuacaauuggggauuuaacuuagagucuuaugagcagcucuuacaagcugauauaaagaccugcacgcugccuaaacucugucacaaacagggaaggagcugcuuucaauaagaaaaagcagcuuuggaaauauuuuacaaaguaguuuuuuucaaaguaguuauuuuguuccucugaaaaagaugaccgaguaaauuugcccaugaacauuuauauguuaauuuugagaaagagggagaaaaagccugcaagauuugccucaagauuuguauaagaaaaagccuuuuuuuaaucagagagguuccagggcucaaacuuagguucucagauguuagcaaaugaccuuacucacuuaaaaaagaacaaaacaacaaguggaucccccaccccacacacagggucuaacguagcucagaccuugacuauguagcugagaaugguaguguguguuacuauucuccuggcuagugcuaggauuacagacuacaccauuaguuuaaaaagugccuagcuucuuuaaguagauuuucaaagucugacuuguuaucccagcaccacccaggugucugagguaagaggaucaccaguucaaggccaaccuggauuacaaugcaagaccuuuucuaucucuuucuuucugucuuucuccuuuucuuucucucucucuuucuuucuucccucucuuccccucuuucuuucucucucuuuuuuaaaugauuuauuuuuuauuauauauaaguacacuguagcugucuucagacacaccagaagagggcaacagaucucauuacagaagguugugagucaccaugugguggcugggauuugaacucaggaccucuggaacagcagucagugcucuuuaccacugagccaucucuccagcccaagacucuguuucuuuaaacaaacaaaagguaauucacaauuuuuauuucuacuuuugucccuuauauccuauugagcuuuguucuuucucaauguguaacuuguuauacacauacauaaaacuuacagugcugagccgggcgugguggcgcacgccuuuaaucccagcacuugggaggcagaggcaggcggauuucugaguucgaggccugccuggucuacaaagugagucccaggacagccagagcuacagugcugagccgggcgugguggcucacgccuuuaaucccagcacuuaggaggcagaggcaggcggauuucugaguucgaggccaaccuggucuacagagauagccagagcuauacagagaaacccugucucgaaaaaaacaaaacaaaacaaaacaaaacaaaacaaaaaaaccuuacagugcugauacuguuuugaaaaaaaaacaaaaacaaaaacccaggggcuggagagauggcucagugguuaagagcacugacugcucuucccaagguccugaguucaaaucccagcaaccacaugguggcucacaaccauucguaaugagaucugacacccucuucuggugugucugaagacagugcuacaguggacuuauuuauaauaauaaauaaaucuuugggcacgagugagcgggauugacuggagugggcagagguccuaaauucaauucccaacaaccacaugaaggucaaaaccguguacucagauacauaaaauaaaaaaaucuaaaaacaaaaaaccaaaaaccaaaaaaccccaaaucaucagccaggugugguggcucaugccuuuaaucccaguacucugcaagcagagguagguuggaccucucugaaaccuggcucuaaaaaacaaacaaacaaacaaacaaacaaacaaacaaauucaauuaugcuuuaacuccacuuuaaaaaugauuucuauaggacugagcacauaaaauaaaagcugaaaucuuugaauugaccauaaaaagcuuaagaaaacagaaagcauuauaccuauagaggaagacuguggacugaucagaagguccucuugaacugguucacuuccgggcacugucugcugaucacucagugagcucugagaugcacuaacaggcugggacacuuccucauggaccuccucaucacuuaaucuuucuacuuugacccggacaucuucuucuguaccuagaggcaagguggguuuugugcucucacaagucacauagucagccacucuucuaccugccucggaugggccaggcaauucuaaaguccggguauuuucugccugcuuugcuuucucaggcugaauccuucgaucuauuccaaaagggaaaguccaaggaaaagcuaaagaagagucaacuggcugacuucuauuuucugcauaggaagcugaagaauucaguaccuggggggaacuuguuugggugcuacauuucacgggacucucgggagacauaacaauguagcuuuugcgcuuccuccgggacucucggcagacaggaaugguccucuccacagcacugcacucugaagacacuggagaaaugcuuccaucucgagaaguaaaauugcaguuggagcuauuuucuuguccagcaucuagacucuuuucugguuggcuauuagguguauuccacaaaauacuugacuucaugaacucugagcauguacuagcaacacuaaacauuugcauauagcuggcugccgcuagaacaucaauaauauuuuccguguuaauugacagaguggcuguguaagcguauucuaaaagagguauaaagccagucacuguaacaugaugcagauccaacacauuuuuguucucaucuucuguuuggccaacaaguuugguucgaaagaaaucacugcaagcugcuaguacuaccuugugagcccggaagauuuuguccuggacacgaauagugauaucacaaaaauguccaucauuucggagcauauuuaguuuccccagcauuuccuggcugugggaagaggagcugugaguaaauguuuucacacccaucuuuuuuuucccucuucuauugaugcucuucaaggaugcaaugaaucugaauuauccuaaaaaaaccaaaaacaaaagcagaaaacaaaacaucaaacgacagcguaauaguugaaaugaacuauuuauacuauuuucauguaggcacugugccaaauaaaaagccuaaaguaagauauggagagagaaaaacuucaggcauggaauguauuaaaaauacauuuucugcucuguugucaaauuccuacaauccuaguaccaugaagguuaaggcagcaggcugccacaaguucaaggaccuccuaugcuauacaguaagucugagaccggcuugggcuauaggguaagaucccgugucauauaaauaaaaugaaggcacuaauaaaaauauauucucuaaaccaucaaccaguggucuauaaauuacuauauuaaugagaggcauuuuagggggcuggugagauggcucagcagguaagagcacccaacugcucuuccaaagguccugaguucaaaucccagcaaccacaugguggcucacaaccauccguaacaagaucugacucccucuucuggagugucugaagacagcuacaguguacuuacauauaauaaauaaauaaucuaaaaaauaaaaaaaaaagagaaaaugagaggcauuuuaaaacaucaguuaaaugacaauuauagagugcuuuuaugugccaguaacuacuguaaauauuuaacacaugauaaucuuuugacugucauugacaccuuggucaauagguauuuaauuauuccugcuuccaaaugugaacaagcagcaaauuuuguuaugcaagcauuacauaauaauucugucaaauauuuuacucagauaaauguacagagggaaacgggaagagaaaaagaaagagaagauuucaagauuuucaaacagucugacuaaucuaauggcaggagacaaaacugcuccuguuugacaucaugauaaaggauaccaugagauggauccuaugccaagaaaguaagagaaaugaugccauagaaauaauggcauugaccaaauucgaaccagcucuaggaacacuuauucuguuauauggauuaaaggagaaaacauugucaauuaagacuguuaaagacaacaaccaaagaaagccugcuccacauauucuuaaauacaaguaaucacaggcauacauaguagugcaugucugugauccuagcuagcauucuggagcaguagcauuaggaaaaucacaaguucaaggcuagccugacauacaugaugaguuccagccaaacagggguacauagcaagauucugucucaaaaacccaaaauaacaacacccccaaacccaaacuuaaaaacaaacaaacaaaaucccaaaguaaucacaaagagauaauauaguuaggacugaucuaggcacaaaauaauuuaauggauuugauaauuuuucucucacacaaacaggccauggcuguaugucaguaaacuggcuacuucuuuuaaagcuaguccaucaagagagugcuuugauuucagucacaugauugagagcagaaugacuucagagcaaaugacacuuaugacccagggacaaucugcaugacacacaggcauuaaaacaauaggaaaguaaacaucgccgggcgugguggugcacgccuuuaaucccagcacuugggaggcagaggcaggcggauuucugaguucaaggccagccuggucuacaaagugaguuccaggacagccagggcuauacagagaaacccugucucgaaaaacaaaaaaacaaaaacaaaaacaaaaaaaaaacaaaaaaaacaaggaaaguaaacaucauaguuugaaaacgugucucacaaugcuaaaaugagacacuucaaacaugauuuggguggaugcccugguacuguaucagccuuccaaguaaguacaaggcuauauuuucuuaaggagggaguggaaaacuuuuccaaccugguguaaccuccauuuuccagaaucaaagagcuagaaauuagaaaaggaguuuugccaauaaucaguacguuuugcaugccaacuccauucaacucuuuucuucuuuuuuaaaaggaaaaacuagugauugcccucacccacaugaucccaaucacaguaagcacucucgauggcacaaccuaaaaagcagaggccugcuuuaucuuuauccugggccuguuauacuuggacgagcucuaaaggacaugaguccgauuugaaagccagccaagaugaggagauauaccacuauuuuccaacagaagauaacagcaagggcggagugauuaaaaguauaggauggaaccacaauacuggacuggcaucugguagugauaugaacuuuaaccuuuguauuuuaauuucugcagcaguacaacaggaauaauagaaccuauauugggcuggagagauggcucaguaguuaagagcauugacugcucuuuuagagguccugaguucaauucucagcaaccacgugguggaucacaaccaucugcaaugagaucugaugcccucuucuggugugucugaacacagcuauaguguacucacauaaaauaaguaaaucuuuaaaacaaaaaaaaaaaaaucuuaaaaaaaaaaaaagaaccuauaucacagaauacugaggauaaucaaauacacguuucagaugguaacuagcaacagugaaauucaguaguuggaacaguaguagucucucccaauucuaacagguccagaaaggacaacuagcuccuugggauccucagcccugagaucacagguacaugacaccaugaccgacauuuuauguggguguugguaaggaacucagaugcucacgcuugcuuaauaagcacuucucuuuuucuguuucuaucuugauuaagaauccgguguacgggauuggucugaugcuguuuguaaucaaaugcuaaauucuguacuccaaggucugguugcuccaagacaagaggauucucauguauaccaacuuuuguugggugaaccuugcucuccaaguuaauuggucaauaaaagcuaaacccgguaauuggucaauacagagagguaggcagguuuucaguuaccugacugaaggucuuaggcagagaggaguggaagaagaaaggacaaggaguaaagggagucuccaugaggggagauggaccaugagcaaauggccaagagacacagcaagaaacaagcaauguguaucuagauaguaaguuagaauagcuccaaaaccuguccaauuuaggcuuacagcuuguaaauaaaaugcuuggauugugugucuuuuuaaaaaaagauuuauuuauuuuuauuuauaugaguacacugcagcugucuucagacacacaccagaagaguacauaggaugguuuugagugguugcugggaauugaacucaggaucaggaccucuggaagagcaguuagugcuauuaaccacugagccauccuccaguccccagaucguuuaccuuuuauacagccuggcuagaaaguauaauucauuuacaauacaguguuauagacaaucucauacaugcuguguguggacauagguuuuuaguuuuuguagguauauauacuuaacuucaaacaacaucuccccauaagacauaaugccuuuacuagaguucacauccuggaaaaagguagaagacuuaacaucuauacggacuccuaacaugucuuccacauccuguauucacaucuagcagcaaucuagaagagaacuuuuuuucaaaaauuuauuuuuuuauuggauacuauauuuauuuacauuucaaauguuauccccuuuuccaguuucucuucuggaaacucccuaucccaccccuacuccauuucuaugagggugcucucccacccacccacucccaccucacugcccuggcauuccccuauaaugggccaucaagccuucacaggaucaagagcuucuccuucccgaugccagacaaggccauccuuugcuacauaugcggcuggagacaugggucccuccauggguacuauuuguuuggugguuuagucccugggagcucugggcucugguugguugauauuguuguucuuccugugggguugcaaaccccuucaguccuuccccuagcuccugcauuggagguccccaugcucaguccaaugguuggcugcgagcaucuacaucugcauuugucaggcucuggcagacaagcuauaucaggcuccugucagcaaguacuucuuggcauaugcaacagugucuggguuuggugucuguauaugggauagauucccaggugggguagucucuggauggccuuuccuucagucucugcucugcucuuuguccccauauuuccuuuagauagcaauucuggauuaaaaauuuggagaccaguggguggcuccaucccucaacuggggaccuugucuaacaucuggauauggucucuacagguucucccucccuuuuguugggcauuucaacuaaucucauccccuuuggguccugggagccucuugcuuuccugguagcugggacuuucugguggcuacccccagcuccccauuccccacugguacaccucuguucaauuucccugucuccucccauaccugauccucccucucuuuucccccuaccccuucucucuuccucccaaaucccucucacccucuaccuccugugaguauuuuguucccccuucuaagaaggacugaagcauccacacuuuggucuuccuucuucuugagcuucauauggucugugaguuguauaagagguauuccuagcuuuuugccuaauauccacuuaacagugcguacauaccaugugcauucuuuugugaccggguuaccucacucaggaugcuauuuucucguuccauccauuugccugugaauuucaugaagucauuguuucuaauagcugaguacuccauuguguaaauguaccacauuuucuguauccauuccucuguugaagaacagcuggguucuuucuagcuuauaaauaagguugcugugaacauagugaagcauguguucuuauuauuugcuggagcaucuuuuggguauaugcccaggagugguauagcuagguccucagguaguguacuaugcccaauuuucugaggaaccgccagacugauuuccagaguggcuguaccagcuugcaaucccaccaacaauggaggaguguuccuuuuucuccacauccucaccagcaucugcugucaccugguuuuuuuuuuuuuuuguuuuuguuuuuguuuuuccgagacaggguuucucuguguagcccuggcuguccuggaacuuuguagaccaggcuggccucgaacucagaaauccgccugccucugccucccaagugcugggauuaaaggcguucgccaucaugcccagcuugagguuuuuaucuuagccauuuauguauaugagcacacuguugcugucuucagacacaccagaagagagcaucagaucacauuucagaugguugugagcuaccaugugguugaugggaaaugaacucaggaccucuggcagagcagucagugugcucuuaccugcugagccaucucuccagcccuagaagaggacuuuuaacugaggcugcccaaaccccaagccaggcuacaguuaucuacugcacagaacaccaagaaacaugcuuuagaaacacugcaaaauaacagaauggacuaaacacacacacacacacacacacacacacacacacacacacacucacacacacaggcaagcagggaaagcuguccuuuuaccagcagccccugagagccuggcuauucauuuccucagucauuccugaguauggcuaaaaagauuaggagggaccaauaaauagcagaagaaguuaauaaagaaugauucuggcuuuccuuacaaggaagaaauauccuuccuuccagucaacaaaggaaccaucuuaucagacuacacaauucuucuauguagggugcaugccucuucacaaucucuauauuccuuuuauccacuucucaaaccaugaauuaaauuauaaaccuucaguaaaaacugcucuauuggaaggccuauagucaucaagaauaucacaggucaaccucuuccuuauucauucaguugaguggauacuuaucuggauagacuuggcaaaucgacucacucaucucaauacaaacaauacaaguguuuuuucagcguuacugacaccuuuuggugcugccuagaagucuuuucccaugaaacaaaaaauacuucagaaaucaaccaugaauuccuacaagagauaauccacagaccuguccacuacccaaaacuucucuccaaaguuauaaugguuuauagucucuguuuccaaaauaauccaacaggucucacaaggcuuuggauaucaccuuuauauucuguguauaacccucaaucuucagaaaaaauuggaaagcuccacucuaccuuaaaacaucuuaucaagccaucucugcagguucaacaagaggggcccuaacucaaugccuuacgcuccuccucccucucucucucucccucucccucugugugugugugugugugugugugugugugugugugugugugugugugugaaguucagcucacuguggacgacagcauucccuaguuguugggacuguacaaauaaaugaaaaaaggacacugggcaacagcacacauucuuuguccugauucuugauuguagaugguauguuacuagcugcuucaagcuccuguuaccuaaccaucccuguuaugacuggcuauacucuugaacuguaagccgaauaaacccuuugucacuuaaguugcuuuuauaguaauaguaauuugucacagcaacaggaaagaaaauaaagauaaugagcaccuuugugcuuaaguccuuucaaauuauucuaccacaggcuuuuucucaacacuagacucuuaguuaggguuuuacugcugugagcagacaccaagaccaaagcaaccuuuuuuuuuuucuuuucuuaaaagauuuauuuauuguuguauguaaguacacuguagcuguccucagacacaccagaagagggugucagaucuuaugacagaugguugugagcuaccauguaguugcugggauuugaacucaggaccuucagaguugucagugcucuuaaccacugagcccucucuccagcccaaggcaacucuuauaaggacaauauuuaauuggggcuggcuuacagguucagagguucaauccauuaucaucaaggcagaaguauggcacaguccaagcaagcauggugcaagaggagcugagaguucuauaucuuccucugaaggcugcuaguggaagacugacuuccaggcagcucaggaugagggucuuaagcccuugcccacagugacacaccuacuccaacaaggccacaucuccuuauagugucacuaccugggccaaacauauauaaaucacaacugguuucuguaccaaaccaccugccuggucuuuguagcuugauucuugaacgccugaucagaguucuaagcuggucaacauuuucuggcacccuccucauaucucacccaagaucuuauaaucaaaccuuaagacuguauccucuuaaaggaccuacaaagacaaccagccuuuccaacugagaaggguuagguuagccucacugcagcuaugcuuucaggauuccugucucagaccucucaaccgaaguuaaccuuucacacuauaccaacaaaucuacagaugaccugcuccucuucaaaaagguaaaaagccccuaugucugaaagagcaggaaggucuaaagagaccuuccacuugggcauuacucuaaauacuucaauaaucugcccauggaucagacuauucagaaugcccuaacucuagccuggaacaaauaucuucaggggcauuucuaagauuaaguauacuuccaagaaauuuaaccuuguauuuaaaaacugcugaguggguuggagugauuucucagcuguuacaagcacuggcuguacuuccauaaaaccuggguuuuguccccaggacccacauacagcucacacuuucaguaacuccagucccaaaggaccagauguccucuucuagccuccugcaugcauuuagcgcacacucauauaaguagguaauagcugggcaugguggugcacgccuuuaaucccagcacuugggaggcagaggcaggcggauuucugaguucgaggccagccuggucuacagggugaguuccaugacagccagggauacacagagaaacccugucucgaaaaaaaaaaaaaaaaaaaccaaaaaaaaacaaaaacaaaaacaaaaacaaaacaaaacaaaaaaaagaaaaagaaaaaaaagaaaguagguaauaugcccacacaugaagaacaaaauaauaaaaaauaaaaacuaugacuauaauguuuaaauucuaaacaguccuucucuuuugcuuuccuuguuuuucuucugggucaguauaucagagcuuuuaucuccagcugugugguagucauucuuuuuucuuauuuucuuuuaaaaauguguuauauguaaguauacuguagcugucuucagacacuccagaagaaggcgucaggucuuguuacagaugauuguaaacuaccauguggauucgaacucagaaccuuuggaagaacagugcucuuaaccgcugagccaucucuccagccccauuucuuuuacuuagacugugacuuugugaucucuaucaacugcccugaacuucuuuuauucacuguaggaacugcaugcccuuuguuaccacaaguuacucuacucuguacuacaaaacuaauaaccaaaaaggcauaaaagcaugaacuacacaaaaucacucuaguuccagauuguugaauuuaugugcucacaucccugucuacaagacucaugcugggcuggagaaauggcucagcaaucaagagcacuugucauucuuagagaggauccagguucaguucccagaaccuacacuguagcuuacaaccaaccaucuguaacuguaguuccaagggauccaauaccuucuucugguuuucuugggcaucaggcaggcaugugguauauacccauagauacguguaagcaaacacuuaugcacauaaaauaaacaucuuuuuuuaaaaguguaaaaaaaaaaggcaucucaucauaacaaacguuuuugacuggguaacuauucacacuaucuuucacauucaaacaacauucauugacaucauuguuauucauguaaaggaucaaauucucaaugguaaaucccuaccaauauucagaccaauaaucugaacuaaaauaaauucaagcacagaauuuacggguaaguugguggauugagaauuccaccaguaagacucaaugaaagaaauagucacaauaaaaacacaauaaucuuuauuccuguaagagacaguaccuaguaccuguaaauuaauuuguuaguuccaauggaaugcaggcaggaguggcugggaaucaacugacccaagaggcuccaaugagggugguagaaacugcugggguagugcuucuccuccacacauaccaagccgggggggggggggggucagcugcaggagcaaaggcugaacaucuacugaugugaagcuggauacccaagaagcuggagccaagguggaagauuaagcaaagucccugagagcccccagacuuaacaaccccuaccccaggccagcuucauagaacacucaaggguagaacugcaguagaagcaagagcuggcugggacccuaggcucuacauagcugcccugguuguggaaacggggacugaagugaguuacucugacaagacuggugguccuuaacaccaucaagagcuccugcucaugccuggcccuaacaucgucaucuagagaacaccaaggaggaaacagaaucacacacucaacgcaguacagcugugccagaaacuuacuugaaagcuuaccuggucuaaauucgcuggugcaguacacaccccaaagcugguuuuaugaguuugaacugggauugcaaacugaacaccuccaugacucaaaacuuaucccccaacgaagaacacuaaugcaaaaaaccuaauauauuauuacacuuuaccucuugguuuaguauucuuacauuugucuuuuuaaaagacaauuuaaaacuucacuauugcauaucucacaauacucuugcuuuaguuuaaaaucacuuggcucuauccagucucuaguugggcaucuccauuccuaugcacaacucauauauucuuucuuauuccuaaccuaucuuucuuuauacuuuugaaccaaaaacucccauaguuuuaacaaucuguaaaaucuguagaucagaacaggaucuuaagcuuccucugcaagcuugucucccucuuugauuuuuuuuuucaaaguugaucuacuauauuacuuaucucuauccucacauucacucauccuucuuucucccucuaugaaucuuaguaacugaaguccuauuauacaucauacuauccuuauccuuguuccuuuagccuccaacuguuuaaaaaagggguggugguggugggaaggacuacuguuguuuucaaguuaguauggcaacuguauaacuguguaacugugaauaguuaagagcugugguugucccugcaguuaaaauucuaccuuaggagaagauauacaggaaaugccaaacacucugggcccuugaucugagauuauaacuucugaaccauuaacuaucucaacucuucuacaaccuagccccacuugaacauugcaaauauuucaacugaaggaauacaguuaauaaaaauucuggucaauaaaauaauccuaacacaauaauacgaaaaacaagaaaaacuaagaaaacuaaauuccucccaaaguuacuaauccugugguauuggcauccaucugagagugaauuagaugaaauccgaaguaacaauaaaauauaauuauagaccuggguaacagcagugagcaaguaaccaugccacauacucugaauacuacuuacuaccuuugcacugaaauuaacucuaacaacuaucugaaacucacuacuuuaaaauucagccuaaaaauuucaggccacagugaaggccugauugcuccaucaugcacuaauauaaccugaauggcaucuagcucacuucccaauggagaccuuguuccucucugaaacucugagcuggaugucuacacuuauuucuuuuagcauucuaguuuuuuaaacuccaaccagaaugacccauuaucuucugcauucuagcaauuuucuagucccaaauuuuaaacucuuccacauuccugaugcucagaccuccaugugcauacccacugcacucaugugcacacaacacacauacacacagugcaaaaaaaaaaaaaaaaaaaaaaaaaaaaaaaaaaaaaaaaaagaagaagaaaaagaaaccucacaaggacaguaauagcaauuuauauugaugcuagguuuuuucacuauauauacaagcuaucagcuccaaucuccuuuuagauguuuuuaggcuuccacuucucccucauacucuaauauaaauucuacuucaguaaaaccaauucuggauccuuauucuuuaaauacaacuucugacauccuuuuuggaaguuauacuugaaugcucucacuagguuaaauucuauucuuuugcucucuauaccccacauuagugcaaugucuucuauuucugugucauuugccauuuauaaugugucuuagucacuguucuacugcuaugaagaaacaccaugaccaagacaacuuauaaaaggauauauuuaauuggggucuuauuuacagcuucagagguuuacuccaugcucaucauggagggagcauguuggcaggcaggcaggcaaaaugcuggagcaguagcugaguaauagcaucugaucugaaaguugcaggggacgggauggggguuagggguggggauagggacuggggccugggccuggcguggacuuuugcaaccucaccuccagggcuggagagaugguucagcaaguuagagcacugacugcucuuucagagguccuaaguucaauuuccagcaaccacaugguagcucacaaccaucuguaaugagaucugguacccucuucuggugugucugaagauaacuacaauguacuuacauacaaaaauaaauaaauaaaucuuaaaaaaaaaguauaccuccagugacauaccuccuucaacaagcucacacucccgaacccuucucacacaguccuacuaacugggaacaagcauucaaacacauggggaccaaucucuuucaaaccaccaaacaauguguuuucaaauuauccacaucuuaaaaaccuuuuaacaucacugugaaacaaucaaacugagaacuuugucuuucaauuaaauuccaccuuaauuuuacuacuaggcuauugcuuucucucuacagaacuccugagacaguuguaucuggauuauggguguaacauaauaucaauguaguuuaccaguucuguccucuccacagauaauuaugaucaaucauauauauguucccagcauagauuccuuuaaaaccauuuucuaagugcuuuaguuggguauaauugauaagacaaugagguacuccuacuugaaauauacaauuuaagauugguaugguggaccuauaagaauaccagcagagguuuucauuuagaaaaaagaaagaaagaaauuauuucuuauuuucugacuuucuggaacaaggucucacuauguagcccuuggcugcccuggagcucacuauguagaccaggcuagccucaaacgcauagagaucugacugcuucugcuuccugagugcuuagauaaaggcucaugccaucaugucugguucaaaacugguacuuuuuuucauuuccuucuuuucauuaccuucagguaaacagaucaaagauaauuuaguaaugaggguagaaauaaaagaaaaaccugggaaaaguuguaaccagauacugugacauuccagaggucaagcagauuguauacuucaaagagugauuaauacaauugucuuagucgggguuuuuauuccuggacaaaacaucacgaccaagaagcaaauuggggaggaaaggguuuauucaccuuauacuuccacaagaagucaggacuggaacucaagcugggcaggaagcaggagcgaugcagaggccaaggagggauguuacuuacuggcuuacuuccucugccuugcucagccugcucucuuauagaauccaaggcuaccagcccagagauggucccacccacaaggggccuuuccccuugaucacuaauugagaaaaugccucacaccuggaucucauggaggcaguuccucagcugaagcuccuuucucugugauaacuccagcuugugucaacuugacauacaaaaccagccagugcaacaaucagaugcugaaagggcaaagauauaaagcaaggguuuuuugcagacagcaagguugguggcaugcaucuguaaucccacaguaaugugugugguggaaacagaugacuaccugaagauccuuggccaaguggucuagauaaacuagugagcucuagauccagugagagaaccugucucaaaacucaggacaaagggauagcucagcaguucagagcccuugcucuugcagaagaucagguucaacucacgguauccacacggcagcucacaaugggccaggacaucuaauacccauuucugauuuacagggguaccaugcacacacaugguaagacauccuugcaagagaaacagggagacaugcaggugccugcaaucccaacacuugggagguugaauaggagugcugcauaugucagcauggacuagacugaaacugucuccaacccaucaaccaacagaccaauccaaaccagaaggauggcaaggagccacugacaacucaauugaaaucagagaucaaaacugguagcaagaaugaccuaaggcuuuuugaguuacacuuaagauacauuucauaaacuuaagaaaugauuuuuuauugaaaacaguaacaauaaucacuaauaacaagugccuagugauguuuaaauuauuuuuucacauuauaggauuucauuucacauaaccaugagauacacauuauuuagaaucuuaauuuuguugguaaagaaaaugaaguguaccaagaaaaaaaaaagagccuugggaguacuuguugcucuuuccaaggguccaaguucaguucuuagcauucacauagcucacacugccuauacuuccagcucuaagggauucgacacccacuucuggccucuugggcaccaggaucgacuccagaauaaguaaaucuucuggccaagaacaucuaagacacuaauauuaaauaaagaaguuaauguagcuuucaagcaagaauauaauucaaacuuaauguuucuuucuauuuguauuuauuuauuuauucauucacuccacauccugaucauagacucccaaccuccucuccucccaguuccauccucacaauucccucccgccacuacccucucacagaacuaagugcauccuccuucacugaggccugccuaguugucaguccagcuagugagagggaucaaugacaggauucaagguaagagauaucccuugcuccaauuguuaggagacccacaugaagacuaagggcacagcugcuucaaauguauaggggaccuagguccagccccuauacacucuuugguggaugguucugauucugugagaccccaugggcucagguuaaguugacuuuguaggucuucuguggugcucuugaccccucuagcuugcucaauucuaucuccaacucuucuacaagacaccucccuacccccaccccugccccccacuguggcccgcucugcagguagcagugggacucugcaaauguuuccaucagcagaagaggccucuuuguauuuuuaaaggcaaacauaggugcagucacuaaugacuaaacuaaacaguggcauaacaccugcaaucucaacccuggggaaacugagguaggacugccgaguucguggcuacauacugaguuucaaaauagucuauauauacuacacaaugaaacccaaucucaacaaaccagcaguaauaccaucaacccacccauggcuaagacuaaagauuuucagcuccugauguaaaaugaaguauuuuuaauauaaagaacaauaacgaacaacuucuccaagauuuucaguuuaaccuagguaacuuuuagucaauccuuauuuagugggauaacgguuucauaaugaaucuagaggcauuuaaaacaaaaacauuucauaaaacuuacaugaacuguguucuauaagaugucaguaaaccacagggagaaauuauuuuugauacauguaauaguuguaaggguauuaaaauuacuuuuaggagcuuaauugucucuuaaauaaugaggaaaacucccuuuacgagucuaggagagggccagaagagggucggugguuaagagaccucuuaacuccugcugcuugagaaccugaguuugauuccuaccacaauggcagguggcucacaaccaccuguaacuauauucacaugcucauaugcccuucccccaauaucaauuuuuaaaaacuuaaaaaaaaaucuuagaaagaugagcuagaaguccagaggauuauuguacgcaaagacaguauaauuuauugguguuuaaucaguugucaguacuuuuaauucuuugagaacuucauguauuuugaucacauucucccuaacucuucccauauccaccaucaucucccuacccaccacccaacuuucaguuuucuuuuucuccuucuuuuuccaugaauccaguuuauguugcccaacuuacucucagaaaugagaccugcccuguaguauggucaacuuaccaagagucuuaacauuaaagaaaaccacucaacagcugucaaauaucacaacuccucagguaguggugggauucugccugguuuaaucuuguguuuaaucuuaaguuuacaggaguaacuauccugcuguguccagaaaguacuacuuccuugaagucagccaccaucuuugguuggcucuuacaauuuuucuguacccucuucguagaagaucccaagcuuugagagguaaaaauauauacaucucacuuaggguugaguaugucauaucucuuacucucuguacacugacugcuugaggauaucuguuagcugccauaauacuggaggaguggaggugguuguucugaaggacucaaacuuuauugcaguuuugcaacaggaccucaugcaacaacucaggguggccaaaacuagcuuaggucuaggauggccuuaauccucuugcuuccaacucuagagugcugacauuacagguuucugccugucacuaccucacuacacagugcaacuaccucacaugcugggacaguacucuucuccacugagcuacagccccuguaauacugguucuuaauuaagaauagcuauuuaaucauccccccucacauaguacugugaaaaauuucaaauauagagaaaaaaauuuaaaacacuuauaguuaauuaucuaaauagccauccaggccuagcuauacucuguaauauacuuuuuuuucuauuuaucaauccaucuugauuucugauacagggucaggccucccacauuccucagaaggggaaaaucuaaggauuuauaauagauaugacaaguacuugugacuucuagaauacaauuucaguguuccuauagaauaauguuagucaugcaguucuuuauguauagugacugaaaauaagcucucacggucaugccuugcuacacucaguugugagauacauaaaguagguaagaauuuugaagauacacuugaauuuaaaacccgaguaugccacucacuagcagugacaucuaagacauaccauuuaauucucuagaagagaauauauagaauaucaguuuucuuacuugcaaaauaaaaucuaaguguuaaaaugagcuuuuaagugagaugauucacaaaauguuuaauguagcugguauacaggaaggguacaacaaaugcuagcaacuauaaucuuauuagcccacuuaaacauacaauaggcugucguugcugcaugacuacauagaccuacuuuagacaaucacugagcucucugaaaacuaugugagcacaguauuuuagaucauauaguuauggauuuuuacuaaauuugucuaauccaaauaaaaugugcuaucuucaccaaucacauguccaaaaguccuuuauaucugcagacagcauauaaaugccaguuuuacuguguaguauaaaagcaaauauucauaaaaccucuaucaauuacauucagcuuuaaagaugauuggguguggguguaaggaaggucaaaguuuccugccuaccaucgucucuuucuuggagaccaucuacuggcuagacuggcugucuaccaagucucagcaauccugcuaccuuuacccauguaccaaauccagggcucccagcucuccaugcacuggugcuagggcucuugaacccaggauggcauacuugcuacacuuuaccaugaagccaauacucaucccauagaacaggauuuuuuuaaguaagaguugcaguuuuucuuucauaaauuguuacuuaaauuaugacaccugcaaaagcaagcuucaaaaguacuucucugaaaauuuucaaaaauuagccaaaggaaucuggauguaacuguaauacuuaaaaguacuacuauguggcuucagccuacccuacuguaacucucuggcacuugggccaauauguauauauggauguacauauauauguauuggauaguacugaggucucaacuuaggcccuugagugaaauaucuugaguacagguuuguuuguuuguuuguuuguuuuuuaagauuuauuuaauguauaugaguacacuguaacuguguucagacacaccaaaagaggacauuagauucccaugugguugcugggaauagugcucuuaaccacugagccaucucucuagccuuugaguaaagucuuuaaaaggcauaguuuuuguaacauuauuuugaaguauguauguauuuuauauauucaaaacuaaaacucuaggauagagagacggcuuagcaaugaagaguacuuaccauccaugcagaggacccaguaccccauaugggagcucaccaaccaacuguaacuuuaguuccagggauucaaauacccucuucuggucucugagggcacuagguccacaugaggcacacagacacauaugcagguaaaacauccauacacauaaaaauucuuaaaucuuaaaaagaauuccuuaagucuccaacuuuaauaaaaaucuguaguauugguacugcaauuaaaaaaaaaaugauuuagaguagaacacaaauaaacauacucuuguuagcaagaucuucauuuuuugacaaaagaaucaaagaugauaaagucuguccagguaauuucaauuggacaucucuaucacacuaugaacucaugauuaaacaaaugcaaaaguggcuaagugugguggcccacaucuuuaauuccagcacuggagaggcagcaggaggauuucugugacuuccagagcagccagggcuauagugagacccugucuaaguaaauaaauuuuuaguucuagccuuucaagaaacaguaauacggggcuggugagauggcucagcgguuaagagcauugacugcucuuccaaaggucuugaauucaaaucccagcaaccacauggcgacucacaaccauccauaacaagaucugacgcccucuucaugugucugaaacaacuacagaguacuuacauauaguaaauaaauaaauagaacuuaaaaggguagacaugauuaugccaaacuuucagaucuuuguuuguauaaagcauuuuucacggaaauaagccaagacucccuagauaaacagcccuuuccacagcaaaagcauccuaggauacccuguaccagaaagugcugauauaguggacaaccugccuaaguaucaaaagacauuucagucaguuugaaaagauuuccacugggcuggagagauggcucagugguuaagagcacugacugcucuuccagaggccuugcgcucaguucccagcaaccacauggugguucacaaucaucuguaaugagauuugaugcccucuccugguguguccgaagacagcgacaguguacucuucaaauauacauguauauaguaaauaaguaaaaucuauaaaaaaagauucucaucuacaaacugggaaccaauguggcccucaaaaagggccuacuugguuauaaaaugaauaaauuaaaagucccuaguaguacuaucaccccaaaucuaauguucauaauggcuaucacaaucccccuaaaaugaaaaaaaaaaaucaacuuguuuaacaauuuccccaucucuuuaaaaaucaauauuagccaugcagugguggcacacaccuuugaucccagcacuugggaggcagaggcuggcggauuucugaguucgaggccagccuggucuacagagugaguuccaggauagccaaggcuauacagagaaacacugucuuggaaaaaaaaaagaaaaaaaaaucaguauuaaacugaucaagcauuuaaucugcauuuuuaggaagaacuuuagagccgagcagugguggugcaugccuuuaaucccagcacuugggaggcagauuucugaguucgaggccaaccuggucuacagagugaguuccaggacagccagggcuauacagagaaauccuguaaaaaaaaaagaaaagaaaaagaaaaaaagaaaaggaagaacuuuaggauacaucaucaucauaauaucuaauaaagaaaaauauuucagggaacuucaauaaaguaacugauuaagagcuaaaaaaucacuaagcaaaguauagucagaaguuacuugcuucucaucagaguacuguaagaccacauauaaucaaacucucaaacaacaccuucauaaaagaccuuguaguuaccacuuuaaccacgcagucacauuuaacauuaccaacuguguggugucccaacacuauaaaccuccuaauauauacaauuaugagauacaggguaucauccauuuaaauacucuugccaaguaagguuucccuuaaacaaaugaaaucuuuguuccagggaugcccaaucuuuugacaagaugcuaucaccauuaucuacaaaguuuucaaagaaaucgugcaauucaugaaguuauaagcgcgcgugcacacacacacacacacaaacuaguauuuucaguuuauaacuuuguguugggauguauucacagauauccuugccuuuggauacaaccauggaccagcaguuggacaggucuagaaccaaacuuuuacuuaacaagaacaguaagugaauugacacucaaagacaaggucaaaguucaaauauguagccagauucuacagaacaauuggucaguuaagugcccagaaaauggaaaaguggucuggguaccacccuuuuuaacaaaagguaugacuaaguauaugcaaucaccacaugcaacacuauaaccuugauugacuacagcuguggaaacacuuaggaacaacagaguaaaucugaauacacauauuuuaauggacauuguuaauuugacuugguauuuuuaggaaauaaaagaaucaaacauggagccugguggugguggccacauugcaagccuaguguuugggaggcagaggcaggcguugugaucacuugaguuuaaggcuaggcagucuacagagugaguuccaggccagccagggcuacacacagaaauccuguuucaaaaaacaaaacaacaaacaaacaaaaucaaacauggugggggaaaaaaaaucuaaucccaaccagcacuuaggaggaagaggcagacugucucaacaacagcaacaguagcaaccacaagaaaaacuggcaacaaugcagagaaaaagguugaccaccagucugguaucuauguucacugcauuuucccugacaacuucugugaaacugaaaacuuccaggccauaaaagaaauuuauauuacuacugagaaguacagcggaaaaagccaucuuacccaggaaugucucuggguucaauugucaauugggcaaccuggggcaaguuacaauuaauauuacuaaguuucugucaauucuauaaaacucaaaaguaacuauaucaccagguucuaagaauaagacuauagcucuaacaaagcaaagcauuguugcacaaaguaaguaaaccugguuuuuguaauuaauaaauacaaaucaucacaaaauacaaauggauuaagaaaacacuccuuuuuauauuccauggggagaacuacaaagacauaaacgaauauuauaaaucaacuggaaaucaaaguaaauaggaacaaaaaaaucaagaucuauguaguacuuuuuaaaucaagaauuaccaaaaaggcaaaaggaaauaucaaaucuuuauccagccucuguugucuauuauaugguauaguucgcuuuggguauuaacuuaucucugcaaaaaaaugcuaauaagcggaaguugagaauuuuucugaaaacacacauucaacagauuaguaugcuuauaugcuuaaaaaaguaguuuuggucuuaauuucuguaaguuccgugaaaguacguaaacaucgcgguuuucaauagauucugguuaagguuuacaaaaaccaaacugaugcgauuuccuuuaaucaguuguaacuuaguugucauuucacuugcagguaaccccuagcuuuuuguuaggccgacaguaaaaagaccagcuacagagugauccucagguaggugggaggggguuagaaguguuugcauucucuauuucuuuuuaagaaaagugccguuccgacgcgggcgaguagggcagccugggagaggaaggaauaaacaagucuagggcucgcgcguagaccaggugagcggguaauaaauggcccggcagcacagcauuuguuauugggcggauuuucuggccgauaggcuccccuggaagaucugggugacggcuucagguccgcugggaccaaggccagucccccucuaaggauuaaucgccaaugagggggacccugugggugccucccagcacgaaucagggugacaaaccagguuuccucucccucccgcguccaggugggugacaaguggugucaguccccaggccggcccgccgucuccccacuggcccuccccucccguuaccugcgggcggcggugccgaggcccggaggccugcaacugcuccuccucuuccccgccaggcuggggcggcgagguggcgguggcuguggcgguggcggaggcagcggcgguggcggcaacccggggggagggggcggagcgcgcgacuggcuccucuccucccccgggaggcucaggggacccuaucucgggccgccgcuccuaggccagugugcagccugggacugggcgcgcauggcggcgccacucacccgcguggccgcgaggugcgagagugcgaggcgcgaggagagcgccgggcgcccgugggccugag

SEQ ID NO: 4989 - RNA, 4284 nt, Mus musculus
aauauuuaaaguuuauuuaaaguugauuuaagagaggaaugccuagauguauacuuuucaccagaacauauggaaaacauugaagagaugaaagccaguuacgaucccgucauagaaaucaccaggguaacuaaacagagaaucauucuuguuuagaauauuuaaagguagcuaucuuuuguaaggccaacaaggguaccuuugugauauuuaaagggcuuaaauuuuagaaugcuagauaaauuacuuuuuaaaaaacaaagcauuuuauauaagaaaagcuuuguuuucaguuuuuuuuuuuuuuuuccaacuaccaaauagauaggaugugcuuuagaagcaaagcucuucccguguugucaggagucguagcuccucgugucagucuuugcauuuccaaacucuagccuucagaguguaaugucaggaaaucacuaacucagaaacagaaauuugacaguaaccuuuacuuuaugcguuuaaauuuuucaagaaauggauguagauaaauguuaauauccacuucccuuaauuggccauuuuaaacaauccuaauuuuuauuuucaguuuaauuucaaguuuaaccacaguucauuauauuaauagguuuuauuuuggguuuuuguggaguguuuguuuuuuuuuuaaguucacaguuuugcuaagacaaagugugcuaagcuguuuagguuugaccguuuggagucccaauagauaaacaggauccguguuaagauacauucccuuugcuauaaaaaacaaacaaacaaacaugcuuguguuuguuaaacuguuuuacuaagagugaaguagucagggccucugauucgcugagucacugguaacucagcuuccuucuaacugcugagccaggcucuccugucuuauaacucaucccuguuccuuuggaagcuauguuaagucuuucacuccuuuaaaaaacaaaacaaaaaccucuuauuuuauucucuuagucuaauuacuagaagccacuuuugcagagcgcguguccauuuucagauuaagcuuuagccuguuagcuuuggagucccugcaaggugcgugaccauacagugcuaugcagguggcuucucuaccaggaucacagagaaugauuucuuaugauggcaaaugaaugcucgguccucaauuuuaacugaagagauuuugauuuguagauguaaugaacaggugaauuggaaacuugcauuguccugcaucacucaucugccccaagggccuucaagcucggaaguauacaucuucgugaaggagugauuuuugaguucuuaacuaggggugggggaaggaccuaggaaagcucacauggagcaaacagccccaagguaggggaggaaggugaguuuucacugcacugcuaaguguugccaucagaugucuuuuuguauuuugauaguagaaaccagaaggcaauggacaaaagugagggaguggagagaugguauuguuguaaacacagccaugaggaauauuuauaacuaaauacauguuuuaaaugagaucaucaaaguuaagauuucuuauuuugcuuauacuaguauuuaucccucuuucguuuuugacagaauguggugacauaggauaguuuuuaugugaaagucuucaacaaaacaaauuuaccaaaauagcaaugguucagauaaacaaugaaguggaaucgagccaguccucaggcugguuaagaaguaggcuauagauguuucacucuggauuauacauaaauugagauuuuugcugcaaccuagaaacaugaauuauguugaacagggaaugauacuguuacuaccgggaguuagacuguuauuaauguauacuaaagugaugagcgagacgcuuucccgauaucauaaauguauuuuuacaauagaaacaauaguuccuggguuuggaaguagucacuguagagucagacagugcugcuggaaccuugcuuuggcagugucugaacagugcugcugcuuuaacggcuucugcagcuuaguagugcucccucugagugagacccaggccggcuccagcagacacaggcuuccucuguacacaacaaaaaacguaggaguucagaccaugauugaaaaacauuagaauuaauguuuuuauuaaaaaugaaagaaaaauuaaguuuuuaagugccuaauuuauauucuuguuuucuaaguuuauuaagcuuugcuaagccuaaaagcccugacucaguugugaugauuuccuaguaaaaucaccaagaaucacuugaggagcuagagugucaugacuuuuacugaauuccuuguuuucuuaaaugccagucugacuacaccuagagguugacaggucauccugugaaugagcguucauuaccaaagcgcaucgcccacccgcugaggagucagccucuagcugccccaggaggggugguaguguuggcuucgagauggggaagcauuuucugcaguucuguuuuccagagagacccuuuucugugauuagugcgcuuccugugguuugucauguuagguagcaguucccggguugacagcugauauggaaggucuuauauauugagaaugcauuacaguugaagguugcacugcuuuucugcccccgagagugaguggcauuggguauuuagaagugagguaauaaacuuauuauuuuguuuauacaaaaugauggcuucugaugcuuauauaugaagguauugcuuaaagaaacaacagucucugguaggguaaaaucuaguuuugacucaaguuccagugauguauuuaguuuauggauacuggugucuccuguugcaucagcuagauauugccugccucuuuguuaaggcacccuuguggcaccuuacguucaacuugaaggaugguauguggccucuuugugccucuacugucuuuucaaaagccauuuuauaaaaaaucuuagguauuuuaauauuuaaauauauauauauauuugugaaagauacuuuuagaacgaacuuuuuuuuuaacguuaaaauuccuguauucccauuuuuaagaguaaacuaaagauuuuccaggcuuaggacuaucuuuuuuucagaaccaugauaagaaagucagauugagguaauaaaccagagaguucggugauggggaaagagaugucuggugagaggagacugauuuaaaggugaaaacaaugacuuugauguaacaaauuaacuuuuuaaauaaagugugguuuugcuccugugauuucguauuugcugcuauaguagcucacuauuuuauagggcuaacauauaaaucuggccccauuuaaaacugagguccuuucuaauacaagcagccuagaaagagacugcgccacggucugccgccgguggccaggcguuccuguagcugaugcaugcuuuacuaguugccugcggcuggcagcacggaggucagggaagcuuccuccccugccagguagagcauuguaacucaugggggcuggcaucugggagacaggccaaagagggaaccgcugaggagagaauguggaagcaguuccauggagggcuguccccuguucuccaccgcucuccuacaacaguacuacuccaacugugccaguccccacgucaccagccuggaccaguugucaucucauucaaguauagcuuuacuuggugacaguggccauagcuaaauuacuuggcauguuugacuuucuacaaugacaaaaauggucuuaaauuuuuguuuugauuuccuuaaaaaaaauguauacagugucauaacuucauguuuuauaaacuaguaucuggcuauuaguauuuuacagaaaccaugguucuuggugacuacauaauauauauauauauauauauauauauuuuugugacuuuuuuguaaacuaagugccguuucaacguuacaaucauuuuuagaguuauuguaaucaaugugaauaucauguuuuuucaaaucuguucugagccuaguguuugcuuugugaacauauguguauuguauauauucuguauaguuauacuguacugaaauauuagcuuguuugauaugagaaaaaguauguauugaguaccuuuuugcuagccugauugcuuaaucuuuuuaaaaaaagguuuaaauuuuuuuuuaaucuuuaagcuggccuuuauuaauggucacaaaguugcaguuagaagggauggacagggagaaucuagucuugagugucuuuggauagaaacaugagacuaagauuuguuuuuguuuuguuuuguuuucucauuaaaauaucuuacugauguuuuaugaaauaag

SEQ ID NO: 4990 - RNA, 1861 nt, Mus musculus
cccugauaagaaaucagcaagugucuuuggaguuuacuaaaugagaggggaauauaaagcauuuagaacuugggccacaaucacagaagucaacaaaaagccaacuaacaugaugcaugccacaaaucccagugaguuggaggcugcaacaggagaguuacuuaagcccaagaguucugagagcaaucugggcaacacccccagacccugucuuuguugugacccucagcauacuuccuccuccuccucggcaauuagaacccucagcaaggacacacaccaguuggaaucucuucacagagcaggccgacuccuccagcucucggauguucuuugaagacuccagcacugggaauggugucaagagaugcuuugcuuaugcugggcgugccauaucuucagcuucccuaguaaaugagcagagagacuggaaaagcaagccuaaaugugucagauuuauuuaaccuuugagaagaaacgcuuuagggagcgaagguuuccagauauguugaauagaauggaauccaagcagugcccacccugaacugagagacacuuccaggcggccacaggaaaaggaaggucccauugacuggcucagcagguaaaggcauuucccauggagaaugaccccagugugaaaggagagaguggacuccugaaaguugucauuccaacugaaucaaaauguauuuuguuuuguuuuguuuuguuuuguuuucgagacaggguuucucuguauagcccuggcuguccuggaacucacuccgcaggccaggcuggccucgaacucagaaauccgccugccucugccuccaccucccaagugcugggauuaaaaaaggcuugcgccaccacugcccagcucaaaccgugcuugauggaagcagauacagagacccacagccaaaucggaaguucucaaggagcugagggaaccuugaagaagggggcaaaaaggacuguaggagccagagaggucaaggauaccaggagaacucaacucccagaaucagcuccugggagcucacagacugaagcggccaaucacugagccugcgugggucugcacuugguccucuguauguuauacuugucgcgugguguuccuaugggaauccuaacaacgggauggggggcggaagggggggggugucucugaucccuuugccaacuucuuagggcccuuuuccuccuauucaguuguccagccuuaauaugaggaggguuugugccuagucuuaauuguacaucguuaaugcuguguuuagcugaugccccuuagaggccugcucuaagaugaauuaaaacaaccaaacagaaagaaagaaauuuuaaaaaugcuuaagucccccauagcugugaccaugcacccacuuuccuggccucccagacuaacgccaaccaaggcaucagccaaggaagcuuguaucuuucuuuguuguuuguucuaagacagagccucacuguguggcuggauccaaacacacagagauccaccuuccaccuuccuuugcaugccaagugcugaaauuaaagaucucuaucacugcacccagcccgagccugcaacuccaacccuuaccugccucugucacagcagggaaucuccuuccacaugagcaguguuggaggcucaggagucacugggccuuaaaaggagucugcccgguuuccugcugcacugccugcgccccaauucccuuaagggcugaaccuacagcauaggaacgcugaugcagccggucauggaaggccaccuucccaaugacacacaacaaguacaaugucgcccuuugugggaacauagguggucaacuuccguggaugcuaugauugcuugggcggaggcuuccuucug

SEQ ID NO: 4991 - RNA, 1173 nt, Mus musculus
ugugccuugagcuuugugcacuuugcagcuaugugaccaugucaucaaucucacaaugcuuccugaagaaguugaugucucagaccggcucaccaaagccucugguauggcuuuguguuuguagcagaaccugauugagaaaauggaagcacuagaggcuggucagaauuuacccugcugucccagcucucauggggaccaacucuuacugagugguuuccauucugcuacugccucacccgauaucagccucgaguggaguggagcccugguuucaggcuaugauacuguagagacugccaacagugggagcuacucccuggaucccucuugggccgaguaguuuuuaaagccaaguauggugaauaguucuuggcccaucucauuuuaaugggugcauuuaauacauacaaaaggucagcuccacucuguaucuuguaaacaucauguuugauauuugaaugcaccagggagagugugcuguuugaaggcuccgguaaagcuauauuaccuguuucgcuacaccaacagugcaacaaaacaacaguucuucgcaaaagucugaagcuuauuuaguugugucucaauaauaaacaaaacuagacauggcaagggaaaaguauuuuccuucucaguuuugcuugaaugugaagugagcguuggcuuugugcuaccaggcuccaucugacagugaugcugaccauucagagaaugccuccccccaagcuacugcuaccaucucagugggcagcagaguuagaaauggaauaccagggacaagaacauuacccaguagcaguccuguguuuguaaacaauguuccaggggaagaacaguuaaaagcugauagcuugaaucuuucagguacuugucugcaguugguagaauuuauggggggggggggggcuaauuggcuucauuccauuuggguuauauugaagaaucugaguagggacaaguggacucuucauauggucuguacagccuuuucugcucuaaugucgaggggaaaguuuucauuuuaucaaaaagcccaguuuacuuuucugauggaaugcucaccacagaguuguaaauaucauuuugaacugguuucuucuacacagcuuuaauauuuuugacaauaguaaaguuggaacacuucuugaaacauaaaaaaaaaaaaaaaaaaaa

SEQ ID NO: 4992 - RNA, 806 nt, Mus musculus
uaguuaauuaaaauuauuuuuaaaagacugauuugagacagaggcauagcucuguaacagagcacuucucuguaguacacagaggucccagaauuugggccauagcccugcaauaguaaacaaagcauacagaaaugucuuguauugcuguugucuuauuugcaacguaaauggaaaaugccauuuuuuuucuuuacauuaaaaaacaacacagugcaacagaaagauaaucaagguggcguaggaagcagacugggucaggugucuggagagcagacacugagccaccgauugauugcgcuaguuuagggaagcugugagggaggucugcuguuacaaggcaucaugccaugcucugugggaagacggagcugaacaagaugcagccccuggaguccaggaugaaugggagagaaugccagguauggagagacauggauaacagaagaugggcuuuuauuaaaaauccugguauauauaaaauuccaggaaggggacauuuuugcuucauccuuucaaccugugucguuuuucauggcuuucuagaaucaguuugaagcccagacuccgguguuaugacaaaucauacaaaccaagacgucaggagcgacgcgcgcagaggcugccuggacuuguuagcaggugcgauuucagagacugcuugcugacuccgagggaagagggaaguaaaacucuccuccagguuugcggcugcccaaacaacucugcaagacugucagaguccgcgguggugggagccucuaccguggccagcuugcucaugcuaagucuagacugaagucuca

SEQ ID NO: 4993 - RNA, 3029 nt, Mus musculus
accuugagucaauugacucuucaaacccuugggauuucugccauggaaugcagcucuuucaggggaaaguuaacuucuagauggaggaacuugcgccuuugcucuugagcugguuguuuguuuuguuuuuguuuuugaacacacugacaagccuuacuugcccuucguggaaaugcucaguggcugguauuauguucauaccaaagguggagacaggauguaccaaguccguggccacuggacuucugauauccaagcuauggcaucaaaagagaaggaacauuuauuuuaugggugugauuaggucaggaccgcuauaucucaugcauugaguuuucaguaauuuuaacaaaggcagcuagcuuauuggggggaaaauuaaaauaagauaaagguuugaugguggugcucugaacgaaacugccaucuacauuuuucuuauugcugaucucucucuuucucucucucucucuuuccuauauggggucuuacucugcugcccaguauagcccugagcuuaugggcuaaugggauccuccugccuuagcugcccacguagcugggaccacagucaggcacuaucauggcaguuguuuuuaaacuaucuuguuucagaaaaccugaaaccugggcagcagcaguccucccuacaaaugcuguccccaggccgaucuggccucacgguccacaagcagacucccuggaagacaaaaggacgcaugaucugaacaggaguugagccccuuuguuaaagcucugccuccaggcuuuggguauauauagcuguguuuaagaaggagauauaguucuacgaaaaauauauaaauuauauauauauguauagacauauauauacaaauacauacauacuuaaggagagagagagagagagagaaagagagagagagagagagaaugaaugagaacugaagacuuggccugccuugcgggauccacauacacauauuguccacuuauaaaggauggguuccuuacucuacauacauaaacucagguguuuauguauaacacuuuugugugugaugcuagaaaucagacccagggccucuugcaugcuaggcagguuucccaccacugagcuacaacuccagcccccaccucgcacucugguucccagcauugggcguauuuuaguacuuucgaucuuucgaugcugucuuaaaaaugaagauucuuuaagguuggguagaaagguggccuuucuuacuucuaagcauuuuaaacuuuaagccugucauuaacucacccagaccuugauauaagauaaccaacuucccacugagggcaaaaaugaaaauaaagggaccauuguaauaggcugagauaaagggaugggugugaaggaauauuaaugcaguuaguucugagaggagcaguuguuugugugauaguggucuucuauguguuccuguuugggagucguauuugcuguggaucuaguggggaggugucgcccuuuuuuuuacgacgcauuccaguuguacccauaagacaucuucaaagccuguauuuuaacaacuuuugugacauauuuaaaaauaauuauuguagagugaauuuaucacuccagaucagggacaccuaaguuaauuucaaaugaaguuaacuaauuuauuuuauuuacauuucuaaggaaaaacugggucugugguuuaagauauagaguaacuuuugggugguaaagacgcccuccugaaaaguaaucauuugguuugaagucacuuuauuuauuacguagauccugugcuucccucuugggaucucauucauagaccaugucugaagauuugggcaugaaaagaaccugggaaaauuaccucaaaaaauguguggaaacugaaaauggacucuguaucuuugccaacaaaaagguaacaguaauuucaacaugaaauguugacuccagucacgaaaugcaagacucuguucccccaaguccugugguguaaugacuguaacugucucggguuuuccaaaaagccuguaguguuguaacuaucccagggucuuauccagagagacuuaggagguaaggagcgguagaccaucucaaagguacaguuggaguuuuuguaauuuauauuugcccugcuggagcugggcgugggagugcacaccuuuaaucccgcgcuuggaagguugagacaggauucucuuugaguuggaggccggccgcuccuacaaagaguucaaggacugcuagggcuauacacagagaaccccugacuugaaaaaacuacacaaguaaauaaauaaauuugaucuguuggauucucuuuaaugugagccagcaagguaucuccccucuucucaggaauaacccagugauuaaaauaaagccaaucacugaaggaauguugguuuuaugccaguuauuuuuaacuuuuaaaauauacagaggaaaauacucuugaaggaccuuuucaucucuuucucuuuuuuugguccuuauaugaaauaaguagaucucagaacauacaccaucacuauucuaagaucagguauuuuaugaauuuaucccgaggugacagaagagauggcagaguauaaucccucugacagcccaaucugggaaacauguggccaagguuucuauggugaucucucccucccagacacauugacacuguagacugcauucauuacagcgggaauauuuugaaguggguuggauguauauuuuuuuuuuuacauuuuuauuguuuaguuugugcccagaaaaaugguuauuucaucauguaacauuccuauuuuucuggaaagacuuuucuguuuugauguucuugaauuauuuucugaccuggaauuauccuuucaaaaaaaauucuuaaaagauguagagcuaaaaaguaccuaaugagaagcugaagcuggcccauugguugaaaguauugauucuaucuuguuauuuaaaugugaacauuuauuguauauucagugaguuauaguguuaauagucuugugcuacacagcagguguaaaaaauuaauaaauauuuuuuuaauaag

SEQ ID NO: 4994 - RNA, 3029 nt, Mus musculus
cuuauuaaaaaaauauuuauuaauuuuuuacaccugcuguguagcacaagacuauuaacacuauaacucacugaauauacaauaaauguucacauuuaaauaacaagauagaaucaauacuuucaaccaaugggccagcuucagcuucucauuagguacuuuuuagcucuacaucuuuuaagaauuuuuuuugaaaggauaauuccaggucagaaaauaauucaagaacaucaaaacagaaaagucuuuccagaaaaauaggaauguuacaugaugaaauaaccauuuuucugggcacaaacuaaacaauaaaaauguaaaaaaaaaaauauacauccaacccacuucaaaauauucccgcuguaaugaaugcagucuacagugucaaugugucugggagggagagaucaccauagaaaccuuggccacauguuucccagauugggcugucagagggauuauacucugccaucucuucugucaccucgggauaaauucauaaaauaccugaucuuagaauagugaugguguauguucugagaucuacuuauuucauauaaggaccaaaaaaagagaaagagaugaaaagguccuucaagaguauuuuccucuguauauuuuaaaaguuaaaaauaacuggcauaaaaccaacauuccuucagugauuggcuuuauuuuaaucacuggguuauuccugagaagaggggagauaccuugcuggcucacauuaaagagaauccaacagaucaaauuuauuuauuuacuuguguaguuuuuucaagucagggguucucuguguauagcccuagcaguccuugaacucuuuguaggagcggccggccuccaacucaaagagaauccugucucaaccuuccaagcgcgggauuaaaggugugcacucccacgcccagcuccagcagggcaaauauaaauuacaaaaacuccaacuguaccuuugagauggucuaccgcuccuuaccuccuaagucucucuggauaagacccugggauaguuacaacacuacaggcuuuuuggaaaacccgagacaguuacagucauuacaccacaggacuugggggaacagagucuugcauuucgugacuggagucaacauuucauguugaaauuacuguuaccuuuuuguuggcaaagauacagaguccauuuucaguuuccacacauuuuuugagguaauuuucccagguucuuuucaugcccaaaucuucagacauggucuaugaaugagaucccaagagggaagcacaggaucuacguaauaaauaaagugacuucaaaccaaaugauuacuuuucaggagggcgucuuuaccacccaaaaguuacucuauaucuuaaaccacagacccaguuuuuccuuagaaauguaaauaaaauaaauuaguuaacuucauuugaaauuaacuuaggugucccugaucuggagugauaaauucacucuacaauaauuauuuuuaaauaugucacaaaaguuguuaaaauacaggcuuugaagaugucuuauggguacaacuggaaugcgucguaaaaaaaagggcgacaccuccccacuagauccacagcaaauacgacucccaaacaggaacacauagaagaccacuaucacacaaacaacugcuccucucagaacuaacugcauuaauauuccuucacacccaucccuuuaucucagccuauuacaauggucccuuuauuuucauuuuugcccucagugggaaguugguuaucuuauaucaaggucugggugaguuaaugacaggcuuaaaguuuaaaaugcuuagaaguaagaaaggccaccuuucuacccaaccuuaaagaaucuucauuuuuaagacagcaucgaaagaucgaaaguacuaaaauacgcccaaugcugggaaccagagugcgaggugggggcuggaguuguagcucaguggugggaaaccugccuagcaugcaagaggcccugggucugauuucuagcaucacacacaaaaguguuauacauaaacaccugaguuuauguauguagaguaaggaacccauccuuuauaaguggacaauauguguauguggaucccgcaaggcaggccaagucuucaguucucauucauucucucucucucucucucuuucucucucucucucucucuccuuaaguauguauguauuuguauauauaugucuauacauauauauauaauuuauauauuuuucguagaacuauaucuccuucuuaaacacagcuauauauacccaaagccuggaggcagagcuuuaacaaaggggcucaacuccuguucagaucaugcguccuuuugucuuccagggagucugcuuguggaccgugaggccagaucggccuggggacagcauuuguagggaggacugcugcugcccagguuucagguuuucugaaacaagauaguuuaaaaacaacugccaugauagugccugacuguggucccagcuacgugggcagcuaaggcaggaggaucccauuagcccauaagcucagggcuauacugggcagcagaguaagaccccauauaggaaagagagagagagagaaagagagagaucagcaauaagaaaaauguagauggcaguuucguucagagcaccaccaucaaaccuuuaucuuauuuuaauuuuccccccaauaagcuagcugccuuuguuaaaauuacugaaaacucaaugcaugagauauagcgguccugaccuaaucacacccauaaaauaaauguuccuucucuuuugaugccauagcuuggauaucagaaguccaguggccacggacuugguacauccugucuccaccuuugguaugaacauaauaccagccacugagcauuuccacgaagggcaaguaaggcuugucaguguguucaaaaacaaaaacaaaacaaacaaccagcucaagagcaaaggcgcaaguuccuccaucuagaaguuaacuuuccccugaaagagcugcauuccauggcagaaaucccaaggguuugaagagucaauugacucaaggu

SEQ ID NO: 4995 - RNA, 83974 nt, Mus musculus
cauuuaugaccgccgauucucccagcucacagagcuuccccgcucugacguccugaaggacaguccugagguaaccauuuagaacccugcagaaguaguaacacauaugaguuagcugaagcuuuugucaggguggaauacaagagcacauaggaucuuuccugagauugcuuauuucaggagagauucuuucuagggugcagaaguaaacaagugucaguggcuguucauaaggcuuggagccucgugaugauggcaaugugcacagccaauauuaugugguauuauguaugcacuagcagaucauccuuccagggaauccgaaaaugugaaagccaaagagacaaaaagugugcacugcaagugugcucugcugucacugcgcuccugggcugucuuugaugugggcugggucugagcauagccauaaaggcugauugugggcugaguagaagucuuacacagcaacacugaguaaacagagcacuugugggcagagggggccucugaaaguaagacuguuuacuucggagggagcaucagcccaugaaacaagagcauaguuuuauaaaauaaaauaaucagaucuuggaaauaaaauaccauguacauuaauaauagcagaccugaauaacuggaugauuacauaaagagagagcuacagagaguuagugagcugggauaucacgucauaagcauauagccccugaaaggaguuauaggagaagauggaaugaaagggaauaauuuaaaaugaauauaauaaacuucuuugagcuaaagaaagcaauguuuucaguuucaaggaguuuguuaaacuuuaccauacaaagguucguguuuuagucacuauuccguuucuguaacaggauccccuaaaggaagcagccuaagagagaaaggguuuacuuaggcuuccccuuucauagauacagcuugucaugccaaggagacauggcagcauggcaggagcaaggggcuggcuggucacacugcauucagagggugagcaggagguagaucuggguuauaaagccucacagccagcucacaguaguaagacuccacccccugaagguuccacaagcuuuccagauagcaccaccaucugggaaucaaguuuuaaaacgcauuagaauauggcagacaguucacauuuaagccaacaacauucugcccuuggccccguaguuucauaaucaucucucuaugaaaaauuuauuuggucuaaauugagaagucccccaucauauccuuucacaggaccaacauuuuucaaaugcccaguuuauuuucugagacucauagcauucucuuaaugagaugcccuguaaauuguaaaaucaaaacucaaauugucaucauucuaacauacaaugccacagaguaacauaucuaucucacaggggaggaaugggaccgaacaaagaaagacuugacuagagcaagaacuaaacuccagcagagaaaaucucaaauccuguagcucaguaucuagguaaugggaucaccguaguuacagaggaguuaggcagccccacucuuccagcuuugcugccugcagcaggcauaucucuucuccuaagcuagcucucuacaucgugaaugcagguuucuuaaguggagagcccaugguucugaauugucagcauauauuguauaggauagaacauauacauagccuuuguuuuccuuucuccuuccucauacccuccaaaacauaccccuccugguccucuuuugggaacucacuaaguccacucagugcugccugugugcacgugaguguggccauccacuggagcauuggaagccuaccauugaccacacccucccagcagaaugaccccccacccucaccacuaagucuaacaaaugcaguuguucucaguaaagacuggggccuggacauugucuacacuaccugugcuggaguuuuggguaguuugauuuugcccgagucuuguacaaguaaccacaccuaguguggugagugcagugaccauuuccuaucuggaggccaguauuucauugcacuccucucuguccucuagcauugacacucugucugguuccucuuccaagcuuugcucugggccuucgagggcaugggguagggguacuugauaaagaugugucccuuagugcugaacagucugaugcagcuucuuaacacuuagaccacugucugcauugacuacugcccacugccccccaagccccccaaguucuguaaucaaugucaaaagcucugcccucacucaugguauucacauaaauauuuagaaggcaauuugacagauguccugacuauuuggcaaaauagccacaacacauucuaucucagggccagagacuuucuaagccauguguggacuuuugacacaggauugcucuaccacacacaaaauucucuccuguggagagcacaucaaaucuaaucaaaaagugccuaguuauuccauaauaucuguuucacuauugaacuaaugggcaccacuuacauggaauguugguauuguuucauguaaagaccagcucugaauaagaccaguaauaucuuuucuccauuaaucucacacaccaccccaggccuguguagcacuuuccagcacuuaugaaaguuagccaauaaggaagagaguuccugguugguuucaaauugguuuauacaugucagcccccacuguucagcagcuuccaugggcugacucuguggaagcucuuccuagguaguugccuuccacgguuagaaacuccauuggcuuuuggagcuuaggcucaguuuuucuuuuuuucucccucccucccucccucccuccgucuuucuuucuuucuuucuuucuuucuuucuuucuuucuuucuuucuuucuuucuuucuuucuuucuuucuuucuuucuuucccucuuucuuucuuucuuucuuucuuucuuucuuucuuucuuucuuuccacaacaggguuucucuauguagcccuggcuguccuggaacucacuuuguagaccaggcuggccucgaacucagaaaucuaccugccucugccucccgaggucugggauuaaaggcgugcaugugccuccgccaccugacaggcucaauuugucuaaagaauggcauuuucacaguuaguaccuuuggugagugggaucuugcccucaggguaguuugcuacuguauauccggagcaggaaguuucucuuuaaagggugcuaauuccuuaucaguuauagaccuucaucauucauacucccauggcucaagcuuuaagcuugcucacacagccugccuugggaaaccaccucuuguaaugucuuuguucucuacuuguuacugccugacacuguagaucugaaugagauccgugagcaagaaucacaauguagccuuacaguuggcuugccgucauauuuccucggcccauggaagagacuguugcuuuugaagucagcccugggcuuuugagaggcagaacacagcuggacucuaugcaggaauaucauccaaauggcuucgaggccaguucucacaggcucgcugaaaccuugggcugggcuuucaguuuacaaacaacagcaccacacacacacacucacacacacacacacacacucacacacacggagaaaggaacuauuguggcuuacauuuacagagagauuuuguucaucguggcgggaaguguaaggcaucagaaaggaaagcagggagccagcaacagcagcuuguuccuccacauugccuuugaacucaggaagaggagggugggcaggcauaaagacuugguucugugucaugguuccugcucagauugucaugucacacuguggcguaggaucacaggaauuaguccacuccugugcagcuauaugcauggagauuacagccaaaggcaguaaagggaagcaagggaaaauuuggcagaaaagccacagaugugucuuuuaauaaacacauuuuguauuuucaguacaaagguacaaaacgaaaguccugaaauuagaagcuguagaauacggccucauacgaugagguauuaaaagcuaaaauccccacauuaggcaguagcugaauuccucugugaaaagugccaucauuucagagguaaucuuccauacccucagugaugaggucucuagagcuauuauuauuauuauuauuauuauuauuauuauuauuugguguuggcgauggggggucucacuuuacaguucugguuaaacugggauccuccugcccuugccuccugacuguugggauuaaagguguuugccacuaucucuaccugauguaauuauuaagugccuaaggaucucuagguuucuuuuuuucccucuuagaaaaaaaccaaucuauaugagacuuuguaaagcaaagaguugcucuucccucugguuauggugagucucucuuuuucagucgguuacucagaugcuuacagcuuaccugucacgccuuucaacuaucgcuggcaacaagaucaacugugggccugcccuuaccuggauggagguaucugucugaucagcucugaugaaaucuuauucuaaaauuauuugcuuaaggcauuuauuaguaauuugauuauagaugaguuucacaaauaaagaaacaaagaauguacucauaauccaggaggauugguaacugauauuuuuaauuuuaaccugaaugcguauggguguuuuaccuccaugaaugucugugugcucuuuaugugccugcugccccaaauggccacaagagggcuucagaugcccuggaccugaaguuauacaugguaugagccacccuguggcucugggaaucaguucuucuaagagcagccacugcucuuaaaugcugagucaucucuccagagugacuggauuuuuggauagaaaaucuuucucuuuauuuuucaaaaaaauaauuuuaucaucucuauaaaucuggagauuguuagacauuguuauaccuauuguuauacauauacagcguaagcuacuuguuuuuucauuugcuuaauaauugaaaauauuuuuuaguaauuuaugagccaauaaaccacccuuuuaaagguaccaauuugagaaugccucaggauauuuauuguuaauuuguguauguuaacuuguguauguuaauuuggggauguaaagaauuauauauauucuuuucucccaguaaaaguugagacacugccaagaggguaagaggagccaggucuacuugcacuaagaccaugacuuugccauuauugcuugagugaucuuaguaaaguaauuuaauuucucuaaaauuacauaacuuucuccagguugucuucuuuaccuuuagguaaagguaaugauagcacauuuugggauuaugagaguuaaauuaagucguauacauuauaugcacagcauacuuacugcccuauauuagcuaccuaauaagugauaggguuuuaaaggguuuugcuacauuuuggggguggggcauguuagagcccauguggauguuagaagacaacuuuuagcaguugcuucucuccuuuaacuagguggguccaaagggauccggcuuaccucaucaggcuuguugcauuuguuuaccugcugagcugucuugcuguucccaaaaaugacaguuuauuuuaaaagacuuuuggggcuuaccaccugucuaaauugaguuuuuauuuguggauagacagauccgugucuuuggacacuccauggugcuugauuuuuauuguagaucgacaauaagggaaaccaucuucuaguucacgaggagucguccaucaacacuccugcugucggugcugcccauguuaucaagcgcuacaccgcucgggccccugaugaacugacauuagagguaagcaguuaggcaggccucacuguucucuggcccugcuaccuguauaaccugucucuagcuguuuuaagaauuuauguauuuaaaaaauaaauacaagagagaguaauggaggaugauuaugaucagagggcacgguauacaugcaugaaaauacaaugaaacccaacaguuugugcagccagcacaugcuaauaaaaacugaaagacgaaguagaauguuuagaucaaaguguuuaucauggggauggaugcagaguuugagccugcugagggcugaggcaugucucugauuuucauguuuauucucugcauuugugaauguucucgguacaguaaguaaccaguaaauguguguugacugagcaaauaaaagaacaacagugcaacaguuuuacgacgucaaaugaggacuguucucaaaccaauuagugaaaugaguguaagcauaaaacgacagaugucuguacauggacuguaguaguaauaguaauaguagcuguagcaguagcaauaguagugcccccucagacacagucccaucauuacagccauuggcauuuuccuuucuuucuuuugauucuuacuauggaauuuuuuuguacugaaaaguuacaauuugucauuaaauaaaucucuguuaagacauuaauuuuaaugucaggcauuguggcucaugcuuuuggucccagcaguugggagacagacaggcaggucucugaguuugaggccagcauaucuauguagugaauuccaggacauuuaggacuacuuagucauaccuucuacacugauagauagauagauagauagauagauagauagauagauagaaagaaauucauguugaaaugcuucauuauaaaguaucaaauuauuaaacauuuaaaaacagaggaaaauaaaaaaccauaguuucaucauuucaguacuuaauaauuucuuuuuaaguuuaauucuuuuuaaauauuuuuauuuauuuuaaagacucugagaauuucacacaugucuacagagauacuaauccuauccauuucuucccuuugccuccucugcaguccuccccaacacuccuccucagugaugccauguucucuuucguagaacccgguuagguccaauuacugcuggccauaugugcauuuucuuugaguaaagaauauagguucuguuagauauauaauagaaaagucuguguuuaugauuuguucguuuguacaaaccuacacaauugccuuuuacaaugaagagccuacucuuuuaguggaguguaagugucaucugcugaugcagggucaucaggcuuuaagucacuaugcgcucaucuccagcuucuuccacugugauggaaucagguauauuaauuaggugcuccauguuguguuuguaugugcaugauaaucaguauuaauagauuuacuauuguaaguaugugcauuuaaugcugucuuuuugagauaacuuucaucuuugauuauggcagcaaaagcaacauucaaaaguuccuuaaagggaugucuuaguaaaaugaaaguacuguugacucagaaauucacugaucuacguaaugcaagcacccuggcuuugccauccaucuaggauuagaguguauguuguuugccacacgauuucauagcugucaguuuccaccagcauuacaaaaggacaccgcacaaagcuuacacugauuaccuguucuuugcaccauaguaaaauaaaaccaucaugaauuggagaauguguucugccagaagugauggugaugcagugauaccuggcugagaaaugaugcaguacuuacaaauacuuguuacuauugcaaggacccagauucagguccuagagccuaugugaugguucacagccaucgauaauucccguuccagaggacuuguuguccucuucugaccucugcagguaccagaugcacacaaaguuugcauauaaacauacaaguguuuccucauaugcugacgaauaaguaugucuuuaaaaacauauuguguuaaaaucugguuuuucaaguuuccaugucuguuaccuggaacaguuuuguccuauuuaacuuucaguagaauacccuuugguaaaagguuagauuauuaaaauuaucuuuaaacgacauaugguuuccuaaaauuuauuaaagcauaaaguaguacuuuuuuauauacuacauaucauaauuauagauauaacaauuggcuugaaauuuugauucuuguaggugggagacaucguuucuguuauugacaugccucccaaaguauuaagcacaugguggagaggcaagcauggauuucagguaagcagcaaaaacacuggaugugggagaguucagagaacauuuucuguguuccuguauuguagcuguucaaaagcuguguuaggaaacaucaggagugugguuugcaguggugggaagauguggugaugacaguguuagccuugauuccugcauguaguaguacuguccugccuucccccugccuucccuuucauucuucagcuggcuagagccagaguuggggcagucuuggggccgaggaccagguuaucagagauauggguuugccuugcuucuaacaguuuuaaauaaugauucacauauauuuuccauuacaguucucuuaguuucauauuuuucaauaaaaaugaguauuacaguguauaauagcucaauaacaguugaugacagaagaauagaaucagaagcugucuccuuuaacuuuccauauaugcuucacaguuugagacuugacagugacggcuuuuaguagcucauagcacuagccacugaacuuacacuaauauuuauuugaccucauuuaaucuuuuaaaauuacucaaaguagccucugaaaaugucuuagaauuauauuuuucaugugcaccauguagguuuuagguuuuuuguuuucuuuuguuuuugcaagggucuuguuacagguagcuguggcuucuuuaugaaacuguuacaaaaaauauuauauagaguguauaauacaguuagagauguguuaguuauguaaaaauucugauuauuagcuuuuuauggaaugugcauauuugagagauuuguacaguuaacacagugcagcaugaagcugacagugagcucugggcagucggcuuggcucuuagucuaugcuaccuuggggauaguuuuugaugcugugucuuuucaaauggagacuacagaacuguauuuuaucucauagauuuguccugaagguuaggugcgugaacacggaaauguuaagugcuuauuauaucaggcuuaguguauaggcuguugugcucaauaaguacuaguccuaauguugaaacuuagccgucuuuacuugaacauuguagccuucucguuuucuuuagagcacagccagccauuuaauuucuuaagaucaggaagcagucccuguccuggugcugcacaccuuguauggguaaucagaguuuucuuucuucugguuucuucagugugcugaguaaugaaugcuuugcaugaaauaucaagcugggugggaguuaaugcuugucccagugagauggcuuaggaaguaagacguuuaccgccaagcuucucagccugaguucagucucugggaugcagaggcucagcuuccaaguuaaccugucucacacccauuugccugaugugcauucaugugugcuugagagggccuaagaaaagaacugaucagaaccaaauugacuuuaaaauaaacccugguuuagucuuggcauuacugucagcuuuuuuuucuauagagcuuagauauguuucuuuuggacuugcauuucauauuaaagucagaaguucugcuuauaguucucacauuuccuuucaacaucuugauuauaagauuauaaucguagcaauuuucuuucauuuaaauaguaaauacuuauugaguaguaaagacauacauuacucuccucauuauuuuaacaagaccgacacagauuagucuggcaggcuaauuuuuuuuaaaguuaguauaggacacugguuauuccauagucaaaagaguugguucaguaguuaagagcacauacagcucuuauagagacccaaguucaguccccaucaccuacaucuuguugcuuucagucaccuccaauucuagcucuaaugggucugguacccuuuucuggaauuuguggccauauauucacacauccaaauacagccucucuuauguacauauuuuuaauauuuuuauagaaaguauacaaauuaguguauauuaacuaguuuaaaacuagaaaauuaacuaucaauauauauuauuguaaaauaaaauuaucuaucuaucuaucugucuggcaggaucucucuacauaggaaauuagcccugucuggcuggaacucacuauguagaccagggcuggccucgaaagauccaccuccuucugcaucccaaguguugagauuaaaagcaugugccacugugcuuagcaaaaauuaaaaauauuuaauguaaggagauuugcauuuguaaauaaaauucuguucauggggauuugucauuuuccuuggcuucaggaaagugacugagucuguagauaacauuggaaucuccuuuaagaacaacaguugaugaggucccuaugaaaccaagaacaaaucuucaaaugucacugucaaaacuuuuuuuaaaagaagcccaguauuuuuagaacaggcuccacucagcucauuauuucuugcuguucucacaccauucauuuguaagagugcauguggccaauugcauggagaaacgagugggaaacguguuggacaucuuugagggaguguuacuuagcauuucuuaugcagcuuuuuuaauuaaaaaagucuuccagguaguuauuaucucccacuguuguggaaaaaagaugacuuuugugaguuucaaauucaaguuuauauaucccauugccugaagagcaccaagaaugguuucuagauuuaugcuccacuuguaugaacuuuccacuuuaguuuuuauccucuagaaagaaacagcuuuucuuuucaaccagcaaggaaugcaggaaaagccagcauccugggguguguacuauucaccggugcauugcuguuuaacugcaugcuggcauuuauguaaucaagcauugugugcuggggaagguucuuucugccaagcucuuucuuccuucucuuguuagacaguguugagcccugagaugcgggagggagccgcagcauugcuagcaacugcuucagguuacuagugggccauaguuuacauaauuaaguguaugguagcaaaaccuacccaaauuuuguaaucuuuaaaagcacuuaacaguuuaaagguauuaaaggaguggauucuguauaagaacaauuugauguuaaccuuuguagaaagucaauauucagaguuuuaaauuucucuaauguaaaucauguugaggguccuacuauuucauacauucugguauagauaggcgguagaaauucagaaguuaaacaauagugugugugugugugugugugugucuaucugucuaucauucuguuauuaacauggcuacuuccaagauucacucagugcuuuauuuguauaguauauaccguguucauuuucuagggauaucauaucaaaauacuacagacuguggcuuaaauaccagaaaauauuuucacaagcuucuggaaguuagaaguccaugacuaaaggagcuaucagauuugauuuccuccaaggucugucuccuuggcuugcagaugguuuucaucuuacuguauccucacauggcauuuccucuaaguguauggguuucuguguccuaauugcuuuuuuuuuuaaaagaaaauaaagauagagauuagguccugcccauaugagcucauuuaccauaauuaccccaauaaaagcuauuucuaaauaaagacacauucuuagauauuauucaacauaagaauuugagauuauuacaauacaagacaaccagucugaaauggagaauuagguucacuuuaggaguggugaaagguauaucucauacacauauuugauagagaguagggccuuccguaaguuccuagggcaaaggcagucagaacuuuggauguuggccaugccucauaagagauugaugucuguauaaagaaagauugcuacggagguauccugcuuugcuucuguuaucaggugcaucucagcaaggccugugucaggcucacagaccagcguuaggcacuccuuauuguggcacugggcacagugguccaaggcacagaggacaaacaggcuuagugccuucuucaguguuuccugugaaggagagacucagcuaguucucuggagaccuugaggggauuccuaaagcagugcucaggugaccugcugaagccuuugucagaggaaguggacagacuggccauacaugaacaguacaacucaguccaccuguggugacaugcugccucugcacguggagucucucaacacuagagaagagaccacaaaggaagugaagaguguggcgugguuuggcuuagcauggcucugauuugggucuucaugggaaucuugauuaguauguguaugacucugaggaggggcagagaggagcagggccauagucugccacuuugcagucugaagaccaagucugcuuaggauagcauccucugaacacuucugggaguucucugaauguccacacuuguaguucugcucagcuugaugagauuucuccucuugucagggacucacaugugucuugucuccuuucugaccacaugguaugauaugauugaucuccacauguagcucuuuccuuguaauuacucugaacuaacugugcagcugccauguggugaaauuauuuauuuucauuuauaagaacaauuagacuugauuucuaguaaaaaguuagacuuuaggcuaaagugagcaaguaguucgguuuuacagaauuauuuuccccauaauuauucuguuauuuaucguguuuacagugcacuauguggcaagcacagaucuuugccagcccccagcugucggcagaaacuaccugcaguauacaauaagcauucuuucuagaaggugaucugagggggcuauacaggcuggacaguuucugacccacaacuccuaaagaacaauuuugacuugguuuauauuguaauuagugaacuaauauugauaugcuauuuuagguauaaucuguuuuuuagauuaggauguauauaguguugguauuuauucuguggguuuugacaaagcauauguauuggucauuaaagcuuccuaaagaauaguuucggggcuggugagauggcucaguggguaagagcacccgacugcucuuccaaagguccagaguucaaaucccagcaaccacaugguggcucauaaccauccguaacaagaucuggcgcccucuucuggagugucugaagacaguuacaguguacuuacauauaauaauaaauaaaucuuaaaaaaaaaaaagaauaguuucauuauccuacagcuuuccuauaugucacuuauaccuucuuuccuugaacaccugguaaacauagguauuuguaguaugcugauaguuggaaucauagaauucauagccauuuucuacauauuuguagaauucauacacguaucauuucuugcauuucuauacccugcagcucauuuguuguguucuuucagaacaaauuauccauaucaguguuacaguaugccauagcuuacauauccauugacccacuggaguacaccguacuguuacuguguucuagcaaguaugaguuaaguugcuauuauauuuacuuauagguguuguguagauuuuaagcuaaaacacugaauccuaggaguaaagcucucaaauacugccuuaguaguuaaaggguaguaugccagagcccucugguauauuuugucucuguuacuagguaaauucaaguuuucagcugguagcugguuaagaccagcaauuugcuacauuauguucaaugcauuuguccuagccagaccacaauuugcuguggaaggcuaaguucauccauggguuuaaauuauaccaggacucuuuuuucuucaaacuucugggaguagaaagugcgaaauuauauuaacuacagucauuugaaauucugaaauguguggguuuugucuccuaaggaguauacugaaucgcuuaucuuuguuuucuaagguuuucaucauaauacauacuucagguggaaaagaagccuucccuguuugaaaauaacuggcaccacucucagauuuauguuccuaguguagagcccucuucggauuauggaggaagaccuuagagugcuuuuuuuuuuuuuaaguaaaagguauuauacaagcauagugguuagcaucuuaguucauuaucaguuuaagugcagugcagucagaggguuuuuguuuuuuguguuggggaugggcuccacuugcaucagaauggcccaaaguguuaagauguguuaaagcuagaucuugacaucagcaucucagagcauggaccaggaguguaagucuuauagcaagcuccacagaugguuugaugcacaugugaagcccacugauucagccugcauagaugggaggagucaguacaguucgccaucgcccucucuucccagcucaugggugucuuccuucucuacaucagcacuguggcuaauuuagaagauaagucuguuuggagguaucagcauuuuggaauccuuguguuugcuuaguucacaggaugaucaaggauuaccuguucuauguuucaguuauuccagaacacucuguaaaguguuucugucccucaucccccgcccccccccaaaagaaggaaaagaaaaaagcaauuugcaaauacuaguacucuacccaagcaaacacuaguaaaguaaccaagaguuuaauuugcuucuauguaagugauugucauaaaguguagguacuuggaaaucuugccccucucaaaaagcugcaccuuuucaugacuaaaaauugaauagagggccaggcaugguggcgcacaccuuuaaucccagcacuggggagucagaggcagaggcaggcagauuucugagcucgaggccagccuggucuacagagugaguuccaggacagccagagcuacacagagaaacccugucucaaaaaaccaaaaaaaaaaaaaaaaaaaaaaaagucauauuaguaacaauuucauuuagaacaucacauauuuucaagagcagagggauauaugguaccuagaagccauuucauaaauguguauguaagcuguucuaagugcuuuuuauuaaccuuuaauucucacaacuuuagaugcugggucuuuauaucauauauggaaaaaaacuuaaacagccuacuguucaaugcagagcccacauagaaacaggcauucuguguaaagaacagauagaucacaguagcaauuaaugaacaguagugaccucuacuugucuacuuguaaaaauaauagauuguugcuguagauaagaugacagugggccaucugcuuuuaaacuguuacuuaagugagacuagagacaggaccagggagauggcccaguuagauugcuucauacacaaucaagacuacaaaaguucagauucucagaauauaggaaaugcugacuggguguggaaaagcucacugggugugggagugggaccuugccucaagaagaaugagaaggaagagcuauuaugauuaccaauaucaacccugucuccaaacgcacgugcacacaggcaaaguacacacacacacacaugcacauacacacaaagaaaaaaucuagauggagaacuguagagaaguuguuucacuuaauaggaacaguaaauguacgaugcagccaugauuagaacacuacagauccagaacugagcucggccugccucagcucugccuuaggccacagaccuggguaaaguguauauguuuucacucauugcugacauacaguuuucagguuggugccauugucaucacugauacucagagaugaccuugcuacucccuagcgucuuauuacuguacaccaacagaacauauccuaccaagugacggcugacacuucagucucacagaagccauuggugagacaguuaaguguaguaguuaucgagcucuucaaauucuacuuucucccugcuugauaagugucuucuaagacuuuucuguuugacucuaaaauaaguuacaaauaauaccucuaccuaugugcauaaagggaguccacagacuuaaugguauuuaaugagaaagcuuaacaaggccauuuaugauugcaucggagaauagucuuacagcuaccucuaaaaagagaugugaaugauguguaugcugugcacugcagaaccuuacugccuagugagacagcccaaguaaaugcaaagauguaccaugauuggguguugguaggcuguggucuuaagcuguucuuucuucccaguuugaucguaguuaaaaauccccacaagcuuuuuguagaaauugaugagcagauuaaagaauucacauggaaauacagaggauguaagaaagaaaaacuaccaguuagagagcaagcacaaagcgaagcucugcauagaacuucaguaucaugagcuugugggacugaugcaaauaaaggcaguuuaguggaacaaaguagagucuagagguagacccacauaugcaaggagaagugauucaacagccaucagaagucaguucaauugaggagcauuuuaccuccaaaaugaacuuuaguuuuuguauguugcaucuagugggaaaacggacucaaaauggaucacauacccagaagaagaggaacuuuaaaacuccccaaaugaaagauaggagaaaauguuuguggcuuuggauuagggaaaauuuuucuaaauguaauaucaaaagaaaaauuuguaaaauacauuuaauuuuaucagauuguaaaauuuauacuacuuacaaagcaccauaaaaagaauaggaagguaagcacagacugggagcaaauaucuguaguaguuagaucugaugacggaaggccuuguccacagagcauacaaauaauuccgagagucacuaaaaaaaggaacuugggucgacaaagugaguuccaggacagccagagagaaaccuugucuugaaaaacaaacaaaacaaaacaaaacaaaacaaaacaaaaacaaaaaaacaaaaaaggaacuugguuucaaagaggaacaaaaaaauuagugcgugcguguguguguguguuugugugugacuguaaccaaaagaacuugaaugacaaacacauacauuucaacgccaauaauaccuagauaaaacaauggaguauagccucaaacucaaguggcaagguugaagaauuagaaucuuacccagugcuggaagguagggcugcugcgugccaguuugguuuauauuuugguggguuuuuaggugacuuauauaccuauugcauuucuuaucaauuccauuccauuccuaaugaauuacacaagaagaaagacuauguuuauacaaaagcuugaacaugaauguuuauagcagcuuuauauacaauagucuaagacuguaaauaaaugauuauaucaucugugaucuacagacuaacaaauaaggauaugauagcaugcacacaauguagauuuacuuaggaauaaaaggauuuaauaauuuaugcauguaacaacaugaaugaucuucaaaauaaugcuguauaaaaggagacagcucagcuuuauuccacaggacuucauucauaugaaguuauaggcaguccaaaguaaugugcaguuguagugaccagggguugccuggcagcaaggguagagggcaagaugugaggaaggaaaccuuuggguuggguugaugauguuuauguaagcuaccuugacugugguuucagaacuuguaacaaugugcuuuuaaaagcacacaguucauuguuuaccaauugaauucaagaaggguaaaagaaaaaaguauauccaaccaagcugaaaguuuuuguguccuccauucauuuacucuucuucaagucaccuuguagguuugcuauuaccuuuacugcacuguucuugcagacuuccagugacauucugcuucuuaugccucucggcccuucuacuuccaaaguccuuucacuacuagauuucuuccuaaaacagaccuucugucccucugauauucagaacuuucugguuuccuuuucuacagaaagaacuucaaacuccuugcugugacaaaaugaccagucaugauucugcucaccuguucucauucguucucugucucuggcuuauauuucggugaucuaccauuaaaaaggauguaauuauuuuuauuacaagcaggagaguuuugccuguguacauguaagagcacugaguguguguguguguguguguguguguguguguguguguguguguauuugugugucugguacugauagaggccagaaaugcagcacugaauccccuggaaugaaguaugaaguuacaggcauuugugaacugccaugugggugcugggaacugaguccaaguccucugcaagauuagcaaguacucuuaucugcucaccaaugguuuauugaauaaacuuacuugucaaacauauuuaaccauuaacucacuccaacuuaaacauacuacucuuuuuuguucuugugucuuuuuaaacaguaaaggaaauuaauuguuuuaaggcaguuauaauuuauuuugucuuauuuguuauuuccuugauuuaacccagaaaagaaacagaaucuccucagguguuugccauucaagagauaccucugccccauucuccaaguugugauugaacauucccuuguucuugcauuucccaucgcccacuucuuguauuuacugucuccagccagucucaagucuuaaguuuaucauuauaguaaagcugauaaaaauauuuucucccuagcccucacaaauguguaguuggcaccauacccuuaaaacaaaaggcaaaugaacaagagagagcuaagcuguauuagcaugccaugcauguaacaugagacaaccccagugggcagaaacuucaagagguggccuggaggcucgcuuaccuccagcacagagacuuuugggagacguggcaaugcuaggaaaagcaaucccaaagguggggaacuagugaagagacagauuguagguagguuaaggagcuagaggagucagguugguuccaagagccgccccacucugcuccccagugccguugcuaggccguugcuaggcugguacuggggauggaugagauuaaguacucucuaggguggaggaggagagcucugaccuuugaccugccucaggccaggccuuacuggagaacaaccugugaacugaaacuagagaacggcccuggguacacagguauaaaaacgcagaaauagaaauucaacguuuacugauaauaaaucauaaauuuuaaucaguucuuugauauacauaugguuuuauuacuuauugaugauauacuucuuuacauacauauuaaaccuugaccacagguuuauacugcaagauauaggacaaucaucaacauuuauauuugaucauacuugauuuuuuaaucaucaaugcuaaguuuaacacuuugaauaaauaccuaauauaacauuagaaguauguuuagggccauuucagaaaguguuggaaguucucucuuaaguucugaucaaaauguauuuaugauuuuuauuaaacaagacucaaaacagcaggguauuuuugcuuuguuuuguuuuuuguuuuuguuugucuugagguagaaucucucuacauagcccuggcuauccuuauagaccaguccggcugcuaacucacagauaucuuccugccucugugugcugggauuaaaggugucucccaacauauucugccaaacaccauuuaaaaaaaucaagcauucuaauaaaauggugaauuuuuugggugaauuugcuuccuuuuuucuagggcuuuuagauguguugucaagcugcuaguaugugcugucucccguuucuucuuggaggcacucagcgcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugauaggauacaugggacaauuucaauauuuuuguaucuauugaggccuguuuugugaccaauuauauggucaauuuuggagaaggucccgugaggugcugagaagaagguauauccuuuuguuuuaggauaaaauguucuguagauauauguuaaguccauuuguuucauaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaaugaaugguucagagaugcacuauuugauaguuacugaaaagugauggcaggaaauuggaagucuuuguuuuaaauaaauguuucuguaagaacagaaaauuuugcauauauaguaaagccacuguaaaucuuaacauucagucgucucaaaucuaacccgagccauuguguguacuccauggugcggugguguguguaguacauuguguguacuccauggugcggugguguguguaguacauuguguguacuccauagugcugugguguguguaguacaagugugccuguugugugcucagagcccagacuacaguucuaugagacagaggaaggaagcacuuccacagacagcuuaggcucauugauauuugauuuauaauuacguuuuagucauugcgaaugcagaaauguuuuacuauugccaaauuuuuaugaccccauuaggcagagggaagacagaguuccccuggauuuugucuucagcucacuauucuuugcauucuggggagguagacucuaguuuucuuuucuuuucuuuuuuccuuuuuuuuuuucuuuuucgagacaggguuucucuguguagcccuggcuguccuggaacucacucuguagaccagguuggccucgaacucagaaaucugccugccucugccucccaagugcugggauuaaaggcgugcgccaccacgcccggcuugacucuaguuuucuugaacagccauaaaucacaagucuacuccuaaacccaagucugugacgucacgcgccaugugucauuucuggcguaaugcacaaacauuuguaugauucuuuuuauuucucagaucuaagcuuucaucaguaucagauugcugucuuucugacauuucuucucuugacugagguggcacaguacuuuuacaaguucuggcugguuuucuguugcuuggaccagauuaugccuuauauucgaccccuacauuuuggggagaauuaacuucucauuugcugugcucugggcuccucuuuaccgguggagcuuuaaauagcauguuucuguuaguuccgagauugauaucccaaucucugaccucauuucugaaucccaaaccagucucccaggcuguagaacuaucuuuuucuaauggaaauuggagagugggcauuucagaagacaucaugauguguuuuugugggagaugaagaguauagggagaggagcgacuuaaguagaacccggagcgagacuuguucaccaccagugcgugcaaccacaaaugaacuaagggauugagaacguacccuccacuuuucaggucucuuguugcaguagcuucugccugguuuguuuuguuuugucucuuccuuuuugaaaaauagugaguucuacuuuuagcaacucauuggaacagcuggaucuaguuuuaaaauguuaaacaauuuuuaaaauguuaaacugugaccugucaucuguuugugugagaagguugagggaagggccugaaggucugacugggguuagucuaaaacaaaguaggcucucugagaaugguuguggcaaggagaaaaaugugaauuucuuagaauuccuacuggguuaaauauucucagguaugugauuuucuuuagaaauagaacauguagauauaaaaaaguauuaguuuucuuugggguguugcuggauuugguuuggcacaagauuaauauggaaagaaauuaaggacauuggcuuaaauguucaaauggucaacaggguguucauaccggauagaaaaaaacaaggggaaguauagguaugaacguauuagaaucccuugaauuuuagcauugguuauggaauagaaacaccagagauuuaggggggcagguguugugguaaaucucuccaacccaaauaugccccagcaaugaaaacacagcacaguuaauaugguuacacgcugcgcccuagauugggcagaucuacgcuacacuacccucuuccacaucuaugagaccccuuagaacuugcgguuucuccaggccuugugcuucugcuccacuugucuucuucuugcuacuccucugcauccucucccucuuccauuuuccccuuccucccucccucccaccuucugcuccuccuuccuuuuuuaucugcccaaucauccgcucuccuuuauuuuacaaaguaaggugggaagcagguuuacaggacaucaccugagugcugacucacuccuuguucacaaccacucacgggagaauggaaguagcaucaaauauaauuagcuccagggcuagccacagccggcaggaaguuuuacugagaaaagaagaaacuggaguuuuagcuuucugaagccaaauaauccccacugaagaaaucuggugugaccgagcagcaguggaacugugcuuauuagcucaaagccuuugcuccucugaaaccuuguccucucaccggaaagcaagccugcaggucugugacaucagugacagcauugcugcgggaggcugaaauuccuucuagguuuugguugcugagucacagaccccccuggagcugauccucuaagcuaucagugcgaacaggaacagaaacaggagcaaguagauagcuauagauuaggggggagcugaacuagugaauuagugcaguuguuagaugcaguuauuccuaaaaucugcaguauauaaguucacaauaaaugaauuguauuacaauacaguauuuucuaacuguucuauuauaucuuauuuuuuguguucuugagguuccauuuucuccuggguuuguaugauacaaauauuauauaaccaaguguuacucuauaucauuuuucaaucccguuccccauuggcacuuuaaaaccaacugugacaggguguuugugccacaaacaccagcaaaggccaugaaucaaagccauuuucuucacugggagcuauuauuaaacacuagcacacuugcagguauaauaccccucccucgacuuuugcuguaaugcagaaacuuaaggagaagccuacugacugacgucauguuucuuccuccucuuguguaccccuccugacucugucccagccuuccucaagaucauucguugucuucuuuuaauaucuuuuuuugugccucuucuuuccaaagcugaaucuuauuuugaucccagaugauuaaaaggcgugauucucuucuuagcacugaugcagaauaagauaagaaacaagaugguagagcaaguagguccaguugccaggguuuuagacauagucacuacuuaacacaucgggugguuuagacuuuccuaugugcugcaauaauuacuugacauguguguguguguuugugugugugugcauguauguauauauguauguguguguguguauauauauauauauauauauauauauauauauauauacauauauauauauaaagucuauauaugaacuguauuuuuaguguuacuuacauuagugaauaauauuuucaacagaauacaguuucauuuguuuaugauggauuauuuauaauaggaacacagacucuguuugccuuccucaaauauauaaaacuauuuuaaauaauagauccuuucaccauuagugauacuuaagaaacagcaaaauagaaaaaaaaaaaagguagauguugucuacaguggagucagcagcuuaaugaugauuaggcaaaggccucuaagauucucuaguuuucaucgugguuaggugauggcugagaugccuaaaagcccaagagagacaggaucguagccugacuccuguuguguucacauaugcauuaguuuccuuggaaugccaaaucuagaacugaauaucugauuugcccaauguuacagugugugaagcagugugccaagaacagggauuacagugagauauucaguugcuaugcuauaaaucugcacaggguaggaauggacuuuuuccauugccuaaauuguacaucgagacaaacuuaaaagguaaacguagugaacauaaugacauagucuucugaagaaccccgccaagcuguggacaguuuccguagggaagugaucagaaacuccuuaacuugccaaguuucggauagcaccugaguucaagaacuagacuagguauuuuuacuuuaacucuggaaguguacacggugcguuuccuccuuucagaaguugagaaacugauuauucagggcucagccuagaaagugagugagauauuuuccaaucuagucuuuaugccagguuucagguguuuauaaauugaacggaauuaagcuauuaugggaggaaugacauuugagaguaccuuagcuuauguacacagagaaaaaaagaugguauaauaucaucuauucaucugguguagaagcuagagccccgaagucuucauuagccagcuuacuaggauaauaacagcauuuggcaagugauuacuauaugcauucuauuagacuaaucuguuuaauacucauguacacccuuuuagauaauuauuaucauuguguuuggagaagagaacuaaauuacaaagaggccaacuugcuuaccuaauauaucaaguggccucuugcuuuugacagggaugucaguccgugugccacacauccucuuguagaauacauacaaggaaaaaaggggauuuuaaaguuggcucuuauacagucuaaccaaucuugcaaggauuuuuacuuguuuggagaaacagaaguugaauaaaauauguguuaaaagaauuuuacuaauaaaacauauuuaauacaucauuuugcaagacauggcuuuaauaauccccaauucaaaauuuuaggcaaagcugauaaucuauuaacaacuccuuuucaacuuacucugugauuuugucuuuauaguuuuaagaaguaccauagaauauucauccagaauuaaaugauaauaauguagcaaacaagucugugaaaauaaccccacacaggugggagcugcacagcucagacuguaugagucacgcucuuggaagagucgcacucuuccucagucugucacaaagggaggugcagagggacggagcuugcauauuucgccuuuaacaucugcugcauggugucccguuuuuaucccuaucugaggaaacaucuauaaauauugguaaagauuuucauuauacauuuucucagauuguuuaucucuguauccauaccuccgagugccuggaacgcgguauuuucuagaugcaucuuguuaggguuucaccuguaaggcaguauggugugcucugcucugcaaugccaggcagaggcacuggguggaacgaccuuuuucuuccuuucuucuuaccugcccugcugauuccuuagcaauagugaguauuguaauuuuaaaugagucaauauuucagaaauuuauuuuuacuauguuaauuuuaaaugaaagccauaggaaagugaagaagauacucaugaaacaauuugaauuauggcuuugugucagucuuuuuuaaaacucaacauaaacauugauuguagugauaucagugccacuagauuaagaucucagcaagguaaaucauuagcuaguaauaguuuuacugauuugaugcuuagcuuguagucagauuagauauuuugguugauauaaaagaaauuccgggcauuuaaaacagaaacuaacaaagaagacuuggauauuuggacugaaaacuacacacagcuucauauacucauagcaacagauuguuuauuauuuguuugugugacugucaucugguauccagagccuuggaauauuagaaucauuugggaagggcugcggaguacauuacuggaauugaauuggcaguguucacacacuggucuguuugcuggauuggaauccucucuuuguugcuuuucuuuaggugggacucuucccuggucauugugucgaguuaauuaaccagaaaguuccucagucaguaaccaacucagugccaaaaccaggugaguuccccuuuuucccucugugucacugugcccagcuggcugcggguacaugcacuauauuuugaaaaaguguuuugcuugcuuugcuguucuuugcauuuauugauguaacgcauguuuuauaugguuuugauuuuuaagugcuuuccuuuguguagagcguguuacaaaagguuuaugugcauuucaguguuggguaauuuugauggacuguggguuagguugagcuuugucauuauuugcuuuuacagggaccuuguaggaggcuagguagugguggauaggugaguaaaaguuagagaagugacauggucuguaaucccaguauaugggagggagaggcaggaagucaggaguucaagaccaggcacacacacacacacacacacacacacacacacacacacacacacaagugaaaggaagagacaggcugaccaacccaccuaaucugggugguaugacugacuaguugaaaauuaaaagauguaaagagcauguauuuuaucuucaagaaugggcauaaaacaguuuugagcagccuuucuagucaugcaguuuacuucugguaaauaugccccacaggcuacagaggcugugaugcugaaagugauuuauggaaugaagagaugggguuuuaaauguaugugagagguuuuaccugggugggauucugcugaauucccaguggaggaugccugguuucauaugcauuuucauuuuuauuuucuaaagaaauugucuaauuguguagggcagcuuggcgcaaaccuucaaucuuccugccucugccuaccgagcauuaggauuagagcugugugcuagcugcauggcuugacauaacuguuuaaaaagaaaaucaagccgggcgagguggugcucaccuuuaaucccagcacuccggaggcagagguaggaggauuucugaguucgaggccagccuggucuacagagugaguuccaggacagccagggcuacacagagaaacccugucucgaaaaaaaaacaaaaaacaaacaaacccaaaaaaaccagaaugaguuuuggagggaacaaguaaugaaaucuuacauuccuuuguuucuuucuuuuuauguuaaugaaagaaggagaaauucugggccccaaaacucauuugagcuguuuuuccugaagcacccugagaguuuaggacucaugguuugaagcaggaagagagaagcuuccugcucccuguggagggcucugccuggccugcucucagcacccaucaggcagugcgugccaggcaugugggagugcggaaggggagcggucuuucacaggguaccuauuucaucauggguuagggaucauuguuccaguuucucucgugcccguuuguuuauuuuagggagacuaaauuuauuucucaguaaggaaaaguauucagaauagucuugucuugcaugccugcuugagccaggauucucucucaucuucaagcaauuuuuuccucuuuagaguauuugauugauaaauauuuaucaguagcuucggugauuauguuucuuuuacaguauggcauuagucauguaaagggcauuuuaaauauaauuuauauaccaugaaguucacccuuuuacaauucauaauucagggcugcaggcaagauggcuucgcagguuaagaugcuugucacccaaguuccauccucagagcucacgcaaaaguagaaggagcagaacugaccccauagaguuguccucuggccucugcacuuuuuaaaauacagcacacacauacacacaaacaaaccuuuucauauuuauaaaauaaaauacauauuucaaggucuuuaguguccucauaguuguaaagacaguauggguugucuuuauuauccccaaaagaaauccugugucaguuagcagacauuggaaacucuucugcucuacccucuuugucuguaugguuuuucuauucuugauguuuuauauuuuguagcuggcuuccuucacucugcauaauguuuucaaagcuuuccaugcuguaauauagcuauaauuuaacauuugccuauuuguguguuguuuuuauuucugacugcuaugaacaaucacauguaaguuuuagacauguuuucaucuuucugguauauaguuuuuuuuaauuaauguuuugauuaauguaaaacuauuugguuuccuaaugauacauagauauauacugcuauacuuugcccauauucacucacaacuacucuuacauguuguguucucccucucaguggucucucauucaaauagguaacugcuuucaugcugucuagauucugcaccugagggggaccagacagaguuuuguccuuuagaucucacaugacaaaaugcaugugugaacucagccuucuccuuccccauuacccucucuuacuugucgcugucuuuagacacguuucuccccagcucguagucacuuuucuacuccaugucacagugcacauaucuaaaucuggauuugaccugugaggagagaugugauagcuggcuuauuuugcuuuacacaaugacuccaguuucauacauuuuccuauaaaucacugaguuauggcuaaucucaguugucaccuugacacaccugggagcagucuucuuuauggcugauguguguaugugucacacuuuaaaaaaaugguuuaucuguugauggccaaucucuccugguuccauauuuuggcuguugcgaacacuacaacaguaaacaugaauguguauguguuuauggucugcugguguaacuuccuuuggauauguguccaagagugguguauuaaucacuguucucacugcugugacaaaaaaccgacaaagcuacuuaagcaggaggcuuuguguugaccuaguguugggaugcucacaguuugccaugcuaggcagggccuggcgagggggauacgagauagugggucacauuaugucuuugguccaugccucaggguuacugcuguugugaugaaauaccaugacugaagcaaugaggggaggaaaguggugauuuggcuuacacacuucuacagcacuggccaucuuuaaaggaagucaggacaggaacucauacagggcaagaaucuggaggcaagaacugaugcagaggccauggaggaugcugcuuacuggcucgcucagccugcuuucuuauagaaucagggacuaccagcccacacacaaugggcugggcccuccaccaucagucccuaaauaaaaucaaccgaaggcuuauugccagccuaucuuauggcggaauuguuuuaguugagguucccuccucuuaggugacgucaguuugagacauaaaacuagccagcucaaucaggaaguggagauaugaaugcagcuggcuccuuccucuuuucccuuuuuauucaguaugggaauguaguccgugagacaguacuguccacauucagaguaaguuuccccguuaagucucuguagaaaccccauaaauaugcucacaggcauauuuauauauccgaaucaucuaggugauccauauguuuauuguccauuuauauuucuucuagugagaacuguuuaauuuacuugccagguuauugauugaauaauuuguggggaaaucuuuauagucuagaugguaaccucuucugacguguacaguugaccaagauuuuaaccuguucuguaaaccaucucuucacucugauaauugcuuucuuugcugugcagacaauuuuuaauuucaugcaccuguaguuugucagaucuugaaauuauuuccucagcuauuagaggcuuuuucaaaaaguccuuucaugugccuauaucuuaaagugguuuuguauuuuuuuuccucuagcuguuucagaauuucaguucuuauauaaaguuucagaacauagauuaaguuuugauacauuuggaacugauuuuugcauaguaugagaggugucggucugguuucauucuuuugcauguguauaucuacuuucccgaaaacgauuucuuuaauccuauacaugccuacuuacauuacguggcuuguuucuagacauuccaucuacucuucucuuaagagagagggggcaggcaagagaggagagagagccaccugccguguuguugggaugcucuagugugauguuagaucggaacccgugcuuuuacugcugagggucucuuuggcuggucaacacucuuguucuucagucaagauucuuuucuuccaguucugugaagacuguuguaagauguuaguaggauuacauugaguauauagauaacuugguaauacagccauuuucacaauauuaauucuucuaacaaauaaucaugggaagucuuucuuuuuuuccauuuuuuuauuagauauuuucuucauuuacaauucaaaugcuaucccaaaagucccuuauacccuccccacacccugcucuccaacccacccacucccguuuccuggcccugauauuccccuguacuggggcauauaaucuuugcaagaccaagggccucuccucccaaugguggcugauuaggccauccucugcuacauaugcagcuagagaugggaagucuuucuauuuucuagugucugcuuccauuucuuccuuuguuucuuaaaaucuucauaaaugccacucaccuuguuuaggcuuaaucuuagguaguuauuuuauuuuuuaaacuauacugauuuucccuccucuggaugucuuucucagcacauucauuguugguguguagaaaagcuacugaccuuuguauguugauuauguaucuucuaccuuguuaaaaguguuuauuugggcuggugagauggcucaguggguaagagcacccgacugcucuuccaaagguccugaguucaaaucccagcaaccacaugguggcucacaaccauccauaacgagaucugacuccccucuucuggagugucugaagacagcuacaguguacuuacauauaauaaauaaaucuuaaaaaaaaaaaaaaaaaaaaaaaaaaaaaaaaguguuuauuuaugccggccagugguggcgaaugccuuuaaucccagcaccugggaggcagaggcaggaauuucugaguucaaggccaucuuggucuacagagugaguuccagggcacacaggacugcacagaggaaaacccugucuggaaaaacaaacaaacaaacaaacaaacaccaacaacaacaaaaaaaguguuuguuagaucuaagagucuucugggggcuguucuguagggucuucuaagcugugugcagagaaggacaaugugccccuuuccugucuauguucauuugacacuuucucugcccuuacucuuuaguuaagacuuuaagcacuguacugaauuaagaguguagugauuggauaucuuuaucuuucuccugauuuagagccuaugcugucaguuccccucuuauuguaacauuggcuauagguuuaccguagguaaccuuuauuauauugaaguauguuccuucuuauucuucaauuuuuuaaagaauuuuuauuucucaaacuuuaucaaaggcauuuuugcauauaauuagauuaucaccagauuucaauccuuaagucuauuuauaugauuccuuuuguuuguuaaaccaucugugcuaguuaguuuuuuugucaacaugacacaagcugagucauggggaagaaggaaccuuaauugagaaaaugccuccuuaccacacuggccugugggcaaggcuguagggguacccccuugauuaauauugaugugggaggucccagcccacuguggacaguugguccuuggucauauaaaaaaaggaaccauagaaagcaagccaauagcaacauuccucuauugccucugccucagucccugcccugacuauucuuuagugauggauugugacuugggaguuguaaguugaaacaaccuuuuuccuucccacguugcuuuuggucauaauguuuuaucauagaagcaagcuaagauaccauccuugaagccugaagcaaaaugaacauggucaugauguuugggguuuuuuuuuuuuuuugcaaauauuuuauugggaguucuugugucucuauucauuuuggaaauuggucugugauuuuucucuguuuguugugucuuucccuguucuuaauauuuggacaacgcucagauucacaaaaggguuagaugguguuccuucucuuuguauuuauggaacaguuugagaagaacuaagucuucuuuggaagucugguagaagucaguggugaaucuuuugaguccugagauuuggggaggggggagggucgugguggaggagaggaucucuuuuccuuuucaauaucaucgauuguuguggaucuuuuaaaguuguuuuuaaucucuuaauuuuuguggguuguauguuucuuagguuuuuuucauuuauauuuucuauuuguuucagaauaugauuucaauuuuuuuuccaagacaggguuucucuguguauuccugucuguucuagaacucacuuagaccaggcuggccucgagcuuagaaauccaccugccucugccucccgaguguugggauuaaaggcgugcgccaccacgcccagcccaaucugaauuuuauuggaauuugauguaccuuuuuuuaauguuuaauuuuguuauuuuggguauucuggcuuuugacuuuagauaagguguuaucacucuuuuccccucccagccccucaaagagacaacucuuugguucaugucuucuuuaucuuguuagucucuuagucaccauuucauuauuuuucccuuuugguguuuauuauuucucuccuucugcuguuuuguauuggucuugauuuuucuauggcuuuaaaguacaucauuauguuguuuauuuaagcucuguggauuuuuaaucuaaggauccauucuguaaaccuucauuuuuuucuguuuuuguugcgucucagagguucauuuucacuuagcaauauuuuuguauucucccugacuucuuuaauguccauuggucauucaagaauacguuguucaauauuucaauuauuuauguaguuugaguuuuuauagaaaauagauaguugauauuaauacuaguuguauugcacugaaaucucaacuugauuauauuuauuaagacuggucacaugaccuagaaugugguccacuuuagagacuguuaauugagccuuagaggggaguauauauucuguaauuuuuggauagaagauucucuguuauguccauuucauguauggugcaguuuaacuuugagguguauuuguugauguucaaucugguguacuuauugcuaugagugggguacugaaacugcccaucauauugucuuagagcacaucuauccugucugccaguauuuguuaaugacauugggaacucuaacauuugguauacauauacugacagcuguuaucuuuguuuuucucuuuguuauuaacuaguggccuuuuaauaucuucuauugcuuuggguuuguaaucuacuugauaacuucggaugagccuguuuccuuggucuccugcugugaccagccagguguacuguuaggcauccuuuugcucuguguacuguugccacggacguuguaggagcaaucuucuaguugggccuuuaaaaaaaucccaucagguagcuauugucuuucaaauagagagcuaagaccaucuacaguuaagguucuugcugaauccuguaauuuuuguggcuacuuuuucuccuugguuagacugucauuucuuuuuaauuauuuacugcaguguuggcuuguuggucaugaauugcuuuacuauaugcccuuauuuucuagccaauuuaagaauacaacuuugcuagacacagcaauguguagugaguauuuauucuugaggcuuaauuccuagcaccacucagagaggagcaaagggccauuguaacagcagcagcaggaugccaagcaagauucggaaggauucucaaagucagcugcucuguguggcagcagcaugacuuagcagcuuuuacuuauuauuuuuucuugaugguuuucuuugguggacucuaccaguacacauugaauggaagucgaaagcaugcauacccuuguuuuauuuacagucuuagggggaugauuucagucuuuggccauuggggaaauuguuauuugugugcaguuucauugauguuuauuaucagaccaagggacuuuuccucuaguuccguuuuguucaacguuguaaaaguaguugccagauuuuuaggaaagccaaguuauucaggugauuguggauuuuuaugaguacaacaaaaaauguuguaauuucuuuaucguuguuuaaucugucuucuuguguuggaagcuaaaauuuuaguagucauuaugucgcaacuuggguaauuucaaucagagguguucuuaaaacccugguuuuaaaaacguaauuuaacaguggcauuaaaaugaucuguauuaauaacauauuucauguuuucaaggaaauguaaugcuucucauaauaguaaucucagaagccguugcaguggagaaaguuaaucaccuggagaaagguuuacguucauagaagugcaagucauuuuagaucauuaggagacagacaaguauaccuucaacagcuaauggcuuaucuuuuagaacaacucagaguuggccuaaggaaaagugcauuccuaauacagauugaaagagcugaugcacauucaaucagccuugggcuuguuucacacuuuaaaacugucuuugccuacaguauaaacaacucgaauguucuauuuauuuuuaacauugccaucugucacuguaggaugccaaaucggaaagaugcaucuauaguuugagucugaaaacuuaaagcucccuauauuauuauucaacaagggcaaugggaauuuuuuccccuuuaaagcuguuuuuuuuuuaauguucuuauuguguucaauaacucauguagaugaaaaugaaacugagguaguguguccugaccaagacagcaaauagccuuagugcuuaaggggggaagguacaauuuugagagaacagaaagggaggagaagcaggggauagcaggagaucgcuggaugggagaagcugcagcugugcccugaggggaggaagugcaucuccucugggcuuggguugguggcauucacugaggaacuauugguaucucuuaccaguuuggaaacacucagcuguugucuccucucuucuccagcccacaugacuuacauuccaugguacucucuccccgaucuugggcucuauucuguucccucuauucucuuaugucuuuguauggauacuuuauauugacguguccucaacuucaagugauucugcuuucugcucuguauaguuuucucuuaagcuuaugugaaaaauucuuaaacaguaaugucauagcuucauuaccaguaucaacaugugugaucuuuuaaaaauuaucuccuuggugacauucuacgucuaucacauuaccuaaccuugucugugagagagaugggguguggguuggggcggaagaaggaacaucaggacuagugggaagcagaguaugcuucuguuguuguccuucagacaaucuuuaaaugacuccaacuucucaauauuaaaaggaucacuagaccaaaaauucccaagcaaccuuauuuuucauuccauauauauauauauauaugaaccucaaacauagcacacagacauuaccagccuccagaacacaauaugaaauauuccuaaggaacauaaagauuuaguauauaauaaugaaauuacaguauacuuuugauauaugagcuucagaacacaaaagaccagggacccuaauugaaauaguguacagauuuuuuuuuuucaagacaggguuucucuguguagccuuggcuguccuggaacucacucuguagaccaggcuggccucgaacucagaaauucaccugccuccaccucccaagugcugggauucaaggcaugcaccaccauacccggcuccagaaaauuuuaaaaagcccucaguaguaguuuuaauacugugaucauuuagcacauuuagcacagaaauaguacugaguucucuccuagagccuaugaccuauguaaccacauguuauuauauauauauauauauauauauauauauauauauauauauauauauauauauauauauauauauauauauauacguuaugaacuauaauaagaucagagcaucugucaaccuucaucagagacacuucuccuugggguagguagcaauuaacacaaagacccagcugaucaacaugcagagaacaaaagccuguagaguguucagccccagacuagacaugucauuucucuugcuaagacucaggaaucuuagcagaaaagagggcagaaagauuagaggugguggaugaugucauaaaaacuguuuuccagacacaacaggaguacccacacauaugaacuugcaguguuugugacaucaugcauuaaaccugcgcaaguuucagccagacaaaaucccuucauagagggcaggaggguagcuaugucaccacuccacuagcugagcagauauuagcauuuuuuggcagcugugagagggaaaaucuuguuuuguuuuuauuuuguuguugcugaccacagaacagcaggccuaaaucucaagauuaucuggauuacauaaacuaggccagauggagacagaaguaauuuuuuuacaggaaucucaaaguuggaugcagugggccuggagaguugagaggguaauggggaggagguggggaggugaauauauuccaaaugcauucuauaggauuccgaugccuuucuagauucugcaggcaucugcaauacaaguggugcacagacaucuaugagagcagaacacccauauacagacaauaaauaaaucuucaaaaaauacguuguaugaaguuuuucaggaaguaauaauucuuaaaaauauaaaaaugucaauaugaaguuauaguuagcaaaacaauuauagguaaguuaaaguagaaaagagaucugucugucucagguacauacuccuagcuguacuucaguuuccuguucacugauucauguuauuuaauccccaggucagaaacaagaucuagguaauugauacagauaauuauuugguuuaaaacuaauacaccacaaauuauuuuuuauuguauauauuuaauguuuuaaccuguguccacaccaugauacauacaugaggacagcgggcaugaguuaguucuuuccucccaucacgugggucccagggacagaacucagaucuucagucuuagcagcaagugcaguaaccugcugagucaucucucggcccugauuauaguauuuauagucaauggugggagaggagccucucuggaugcccccauaaauaggcuugcaggguguauuuuuguccucuguuugguaauagccaguuucauucuucuccgguagcagauacagaaauagcuuagcuuucauuuuggggaagaacuuuauaauuaagcauguaacuggugagaucuuuacauuuauuuaagaaguaauuuaauaugacaacauaucagucugauucguuaguauaguuuugaaaugaaaaauaaaagucuccacagucuuuuguuuguuucuuuguuguuugggguagugcugggaguggaguugaugccuuuggcugcaugguggucaagggcuguaucccagagcagcauucccagccugcaguguuggaucuauuuguuuguuuuuguuuguuuguuugagaguuucaaaaccacauuuuguuuauaccuaccccucccucuuacaguguucuuuuaaggcagaauuuccuugugguguuauucuaagaaaguguucuaguggucuucuaauaucuuccuuucuuuguuguuuuacuugugaaguugcuaauuacaguucuuuauuucuuuuuguucuucccuccuucccucccccuccccuccaucccuucauuuuuugaguuuguaguuccuuuauuggcaucuucuuucagggucacuuuaucugaagugaccacuaucuuccuuauuuuauuuggaauguuaucuugaauauucuuccugcugcacauacacauaugugagacugauacuuuaauaagaaucacguuuggggccagacgugguggcgcaggccuuuaaucccagcacuugggaggcagaggcaggcggauuucugaguucgaggccagccugguuuacaaagugaguuccaggacagccagggcuacacagagaaaccgugucucgaaaaaccaaaaaaaaaaaaaaaaaaaaaagagguuuggacuaguaagguggcucaguggucaaaagcaguggcugcucuucuagaagacucaaguucaguuuccagagcccacaugguggcucacaauccuauguaacuccagggccaaugggaucugaugccuucuucuggccauugugggcaccaagcaugcacaugguacacagauauacauguaggcaaaauacucauaacaggaacacaauuaaaauaaugauuuaaacaagaauacgaggugauaaagucaguaucuuugauggaagagucagaggaauacaauguaaacauuaugucaagauuuucuuacucugcaccaggaaaagaacccuagaacauugaugaugcuuucccccuccuuuuguuugccuccucuuccacuuuaugcauaaugcauacuugaaaaguuuuugacuuguaauuaugaacaagagcuguuuccauuagagacaucaaaaauauuuccuaaguucucauggucccuuaaaacuauguaagaaauagaccccuagacacaguuguccugcccugguuaguccuuggcacuuaagaaaucuuuucaaauuuggguuuuauucauuaauuagauuaaauuauuaucuuguguggugcuagagaucuaaccccagccucauucagaagaggccucguccccuaucacugagcaauaauaauaucccagugcuuugguaagugaugacuuaggugcaugcuacaggcugugcugaaauagaacucagcagauggaauugagaaggagcuaugagagggugguggugaauauaucagugagauacuugguauaauauuuaagugccguggagaaaaguacagcagagaggaguucagagugggcaucuggaacauuguucuuaugggguugagauuacaggagaggaguguguucagggaagggaccauuggaacaucacuuuugaacaaagaccuagaggacacggggagggaagauccagggacaaacuccaaagaaggacuaaggcaguauuaagguagaaagcugucuggauuuuagcuuguaaacgugccagcaggagggacaggugagcuagagagagaacagagagauggaguccacagggaaaggaugccagcuguuuccuccuccuuggccaaggugccaccgugggucggcuguuauuugugaugguaaugaagaguguaagagcaguuguuugagcugaugagcucugcugaaaggguaauuuugguggcugauagggguaaaagaaaagacucagaguagcuguuuugggugacaaggcaagaggugaugguagcuuuggacaguguguggggcaugaaaguguuuagaaaaguguuuugauucugaauauaucuggccauaauucaaagaauuugcaaacacacugugaaggcuuugaauuauuccaauaauauuuauaauaaaaaguuaacaauguagccaguugccuccccaaugaauuaucuuggccucuuaaacccaccaaggccugucuuacucccuuuuuucagacagacagcucuagagguuguguuaaaugugaagaauagugacagaugauuucuucuuugcaaugagugaucaauaguugacacaauucagugcauuuucaguuaaagguacuugcaaauuuuuuguuuugaaaugucuuagaaaaaaauugcaaaaauagaacagagagaucccuuguccuugucacucccugaguuggaguuguuacaucuuacauaacuagcugugcagugcauuaugaaaagcaggggauugaugucauccaauacaguuaaccauagcggagacuucacucccgaaucugccagcaucgguaugcucucccauguaucuccacgugguagagaacagccucuggguuuggcaugagagcugcuucugugagcucuucaguucucucacaccuacagaaacuuuuguggaauauacuuauucuuacuucuuaauauuuucagucauauaaaggccauguggauuguacugggggcuagcaaaaugguuuucuuugauauauguuucuuuuguucccaucuugguucucuguguuugugugagggugcauaugugucuggaaauuuguguggguguacauacccuugcaugcauguggaguccggaggucgcuguugguugucuuucucaguuacccucaaccuuauuuuuggaaacaggaauuucucucugaacucaaagcuaaccaguucaacaggacuguuuggccagugagcaccaggugucugcugccccuuucucccaugugcugggauuauagacacuuaccaccacagcaggcuuuuugucugggugcuggggcucuaaguuaaguacucaugcuuguaugaaaggcaguuuaccaacugggcauuuccacagcaccccgucuuuguuccuuuuccccuccucuuuucucuccccugcccuguuauguuuaguauugaacaaagaaauaauucaggggggguugguuucaauuugaaauuaaagaagacaccuucuuugucaugaguaagucuuacaucaauaaaacccuacgaccacagcucuuccacugccaggaaguuuacuugguauguucuugccacucuuaggauucucuguguccuuuuguguuuaaaacuaaaucaaaucguucuuucuuuaccguggcuugccauuuagcaacaguuguauauucagagcuguguucaaacacggagggaagcguguaacugagaaucucacauggaguauggugagcauucgguggguguggucucugcugcauaauagcuaugcugcucugccacacugcucagccccucggccuucuucauuuguaagaucagauaacagcaccagcauuagagaguuggaugaggauuuuauaaguacuuagauugugucuaguaccuaguaaugauuuuguugaagaaaacaauaucugacagugaaauuucaauuggaauugguaaaaccucaauuggaacaggaaguaugucaguguuuucuaauuuauuuuuuaaaaaauccaguucaguggagauaguguggcacuggugaggggucuccagaguguaguauugugcagauaacuaaugauaaugucuuagcaaugcuccugugguagcgcuuccugagcauugcuucuucugcuggugaauguuucuaauagaggacaggaagugccuuggagucagugacaaauugagccucacacugugcaauggaaguuuguuuuggaagugcuggauuucaguucugagcaaacuucccuuuucccugauacauguaugguugccuuccucaaagccuuucaugcagaggcuguguaaaugggugucuugaaacaugucaguagcaaagcagucacagccuaguaucaaccaagcuauugaaaggucugucccucagccuguugcaauggcuuucaugacucagccuuuuacuaacaauacuuccuacuugguuccauaccuuucuuguuuuccuuuggcuuaacaugccuccuuuuuucagauacacuguccccacccacuuagcaaacacaaauaacugaauagucaguaacuggcaaagcaugaagggcacaguugcaguuuccuagggcugcucucugaccaggaagcgcucaccugugggaggcugcuggguggagccaugcuggugaagccuguucugcaagugugagcuuaaauuggggcguuccugugguguggcagagcuguauggcugagaggaggauuaggcuccugaaggcagagagcucucacugagacugacucaaacagggcugaaaucugggccaaggacuucugaaagggggaccuggaaacagcuggcaccuccaugggugguagagaccuggccaggagcccucuggugcuggagaaggucugagcugcugugaucauguuccguguguaagcuguugcagagaaugcacagccgccguugccugcugagucuacugcuagauacagucacggaguaguuuuaaauacugaucuuaaaacgugcaucacagcaagagguaaggagaucacaagccgucauucaauauuucauucaaacuacuuuugggcuaauuccuuggagguauuuuuagauccuauuugaucuaagaucuuaagagaguaugugauucagcauuuaucuggaaauugaauaauagcauuaauauuugucuuguagagauguaaucacuucuuaaaguaaaauuugugaguuguacugcacaaguauuauuuuuccagagauuuuuaggaaauacuuauuuuucuacuguuucuggucagcuuauuugguaaugccuucuagaccucaguuauuauaacagauuuucaucauuagacaagcauucauguaagugugugugcuuauguaugugugugaguguuucuugugggcuaauauaauacuauuucgauguuugauuagaggaaaaucagcagggcugacuuaggacuuuagcagcucuggaaagucugcuugguuagcauaaggaaguaaguucccggcugucugucuuccccauuccugccagcauucugcuccugccagcacuguccuuccuaaggaccagugucguugcugucacucaugaaggacugugucuccucagagacugcacagcucgugcuuauggggugcuuugauagagcauuuucaucaugcucuuucacuagcaugacauggaaguagguauucucucuaacacagagcaguccaguuaugguuucuuugcaagacugacccaccauugcuuacaugaaaucacuauuaucauuuucaaaacauuagguggagaaguuucagaauuuagaguucuuuuucauagucaacuuagaaaaaaaaaaccugucauucagucaaaaugaucugaaagcucuuuucacuuuucagguauuggauaauaauguuuuguacucaguagaagagagcagaaaucuaaaauuaccuggaaaauugaaggagagaaaaguaaaaaccauccuauauuuguccauacccucccuagguuacccuuuguuggagguauaagccaaauuugaccaaacuugaucugaaaagcugagucagauucuuugucagucauguacuaagggaagaauagcaaaguuuucauaucagaggggaaagaaauuguaguggggaaaacaguucccacuuccugacacagggcuaauguuugacaccugucauuccuugucagguccgugguggcuguuuggauuuucaguucauugcaucauguaggaaacagggggcuaauagguaauaugcuaaagaucucaaacuuuaaaggaaggaagcaacauuugccuuuaaagagacuuacuguaaguugcauauucucaaauauacuuauauuuuuagaaccaucccuucuaccuuuugcuguaaaaucuuuacacccugcccccaacccaucucuggcacgacuaaugcuccauaucagucuugauagccuaauagaauacccagggccagugguggaugcucguacuugaaucuaaucaaagagagaaaaaaacauacaggaaucaggaguuucaugccauugagucuaagguucuaaaauuuuguuuccuagaaguuuauguagcauuuugguugaccuauuaccuuugaucuaccugaaucacuaaaauaugugguugcuauacuuuaauuuuuauaagaauguacauauuaauacauuucuuccugaaaucauacuaaccaaauaguacauccuagaaaaauaagagcccaagcaauauuaaacuucuuagcagguuuaaaaaucuguaaccuguguauuaucucauucugguguuaaaauacauucagcaucaaggaauuuauaucuaucucaaguuuccuccuacucgcuucugguaaaaugcaaaucuuccuuuuguuccacuuuuagaaaugaaauuagucauagucuuuuauauaacugaguugguaaagucaccaaguuauuaaaaacacacacacacacacacuuugcuuuugcaaagaguugagaaacaaaaccacuaacauauauuuuaguuuguaauugaaauuuaaaaaauaaaaacaagugucugugagcggaaaaaaaucuacgagcuuauuuauaucaaccuaaagucacagaaucuagauuugagcuucugugguauuucuaacaggaaucauagcucccuggaaaaucaaguaagcaguguagauaccaagagcuuuaccuaauguuccugcguuuucccagggagcaugguuuuccaaagcuccgucuuguaaccauguguguuauauccucuggcgaaggacagcagcccaaugcuucuuugguguccuuugcagacacagucuuagugaaauagccauguauuuuaggugugcccuacaagugccuugugcuaguugcagagaaguugcccguuuccugcuucguuuguuccaugugagcuguucuuucuucugucacagaaagauacucuuuugaaaaucacugcaggccuauuuuccagagccuuuagagucauugauuugcuuucaggucagcaaugacuuugaaauggcuccucaucucucucaucagccaaugagagccuauuauauaacugucagagaguuauaacugccagugugccauuuuaaauccagcaugcaggaccugacaggcauuccuaggauaccugguucccucccuuugagguuggaaugucagacaucacugagcacugugcaggcuccagauaguugcucuuuggcagccucuugcagcugucaccugaaucaguuacugaauccuguguuuucuuacuuucagaauuguuaaucauauauauagcaaaacgccaaaaaaccccaaagccacucugugcuuuauuuuguuucgcaauaacaucaagaauauguuaaaagcugaggcuaagccuccucaaagggguuuucaguuuauguuuggggaauaagggcaugaagcccaaaacuggacaacugcuauuccugauuucaaaaauagaagcuaacuucagugguuccugcagaagacauuaaggauuuugacuuuugaacaucgcucugcagaagcccagaauuuuguagguaaaacuuagcauucuuuuuuuuucccucuuuugcugcaguaaucuccuuccuaaaaccugggccaaaaguuaaucuuuauauuuuauauggaguuggucaacaaaaaucauaaaauaaacgguauuuuaugcuucucuaaaaacuuggaaaugaauaaaccaaaauaaucaauaggauuauuauguaguauaaccaguuuuaugcuuagguucuagaaagugagguauguuauauaaguugguuauauaaagacuccucccucuaauuuuaagcauccauggaacaaaauaaucuauauacuagacguuaaacuauaaccuuaauggcaacuuuuuaagauuaaauuuuauacaauccuuucucaagaugauuuaggaaggccccauuuaaaacagaguuuucuaauuaaguuuucaauaauguuccugauaaauuauuuaaaacauaaauauuucccauagacuugagguucuauuuauuuauuuauucauucauucauucauucauucauucauucauucauucuuaugugcuguuugacauuuguguucccacagaguuuuauguuuggggaguacuuuuauugaagucuagauuuguguugccuagugaaacauuuuauuauacuguucaacuaagaucuuacgcagauugauugucugcaaucuagcaaaaaucaucaucaaaaacauaucuucauauucuuggcccagugcuuuuucacuagccuagccaacaaaggccuaccuucaucagaccauggguugaagucccuagucugaaaugcuucagaacuuuaaauguucugcaucaaaaugaugcccuagugaaaaauucuauacuagaccuuaugugacaaaucacuauaacaucauauaaaauuauccaaagacugaauauaaggcacauguggaacauaaaugaauuucaugucgaggcuugguccccucuccuuuucuuuuccacgaaugcaugaaaaaauauauacaaauuuauauuuaaguagauagauauauauguaugucugaaucugaaaauaucagaaaccuaaagcauuuaugauaccaaacauuuuagauaauuucugaauuucucuuauuauugaaaaccuauaaaagcuuuaaauucuuagguuauuggcucaaguauauuuuaaaauauucaaauaggaugauuuuaacugagugccaguuauguagauacagaauaguaucaaggaaacugaagagaccuggaauauuggugcuugguuauaucgauaauauacuacuggauauguagaaaagaggaaaggcauuaugccaguguuuuuauaacccuugacauagcauguaauggucuauuuaauauuucugucugaauauaaacuucuaagaauguaauagugauuagauauauguagcucauuuuagaauacaaugcuaauaaaaacuaaaauuaaacucauuaauaucucuaagguccugacacauaguaagcauuccaugaacauuuguuauucuauaauuauaacuggugaaggauuucuuuuccuucauauuguccuacaggaccagggacaguccugugcaaaguguuagagaaaggguagaccugagcauuuacagacauaagaauagagucaggaauaggaugucuugcuuauuccuuaauaaaaacuuaacuuuguguuucaucugcaaggaacacuuuacuaugcucuauggaguguuugugaaacugacccuguauuucuagcccucaggagcucuggcagggggaucuugccacccugagcuauaggcuaagaucccccuucccagguccucacaaagucauacuagauuuuaguaagggacucaaugaagauauaaaggagucuguuacaucguuauccauucuuagaacuugauaugaaauguuuucaauaguauaagagaaagauguuuuuaaaaguucuauauuucaguuacuagaaagcuuuuuuuuugcuugauuuccuuuaguacuugagucacagauuagaaucuugcucaaccaccuagaaaauguccuuuagagauuuagagagcuacuacuguucaaguaacuuacacauaauuugugaguccauuuaugugcagaagaaaguuucauuuguaucaauauuuucuugccauaccccgucaagugcugaucuuacucaaaaugaucucuuuuguuuuccaaagguccuuuaagauuauacacuaacacauacaaaacauaaguuaauuuucauagcucuugccuguauccauuugagauacuuaaaacuacaugugaaaauuguucuuguuucuuugcuaucguuuaauacaucagcaaccuucuuaaauuuagaagucccuguuuaggcugucacaauaaaaucccuguguaugucuuuuuuuuaacacuuaaaaaaaaaacccuaguccuaaugguuaucuuauaaaaauuugcuuauaauauuuauucgaauuccucagaaagacuuaucauggcuucuggcuucaguucuuaaauucugacucuccucucuggucucuuuaccuuaaaaggauauggaaaaucauacaaggcucucaaaggaguuuugaauuuaacuccccacuuucauaauuuuaaaauuuaaaaaaagagagagaacuaaaaaucaucuuaguagauaaauagauauagcaaaucaccagguaaagaugaucacacauuaauuuauacuucuuaagaauuaguagcagguaaguuauucacauuggugauuucugcucaaagucccaaagugacucuuaauggugagauguaagaaacaacuagguuaaaaccagaagcaagauaaucauguaaaaacacuuuuucuauuuuucuuuucuuagauuuauuuauuucauguauguggguacacugucacagucuucagacacuccagaagagggcaccggauccccauuacagauguuugugagccaccaugugguugcugggaauugaacucaguaccucuggaagagcagucagugcucuuaacggcugagccaucucuccagcccuuucuuuaauuuuuaaagauuauaauauaaucacaucauuauugucuuuggccuuuggagggagcauuggcagcccagauguguaaauuucauuuaagcugugcuauguguaguuauaaacauacuugcagguauuguguuuguuuuuucguuuguucauuuguugugguuaguuguuguuuaaguaaguacuuaguagugugacuccuucugacuuucagacggccuuacucuuauuuuacucccuccccccauauuuaagauaaacauuucuuuucuuuuuuucuuuuucuuuuucuuuuuucuuuuuucuuuuuuuuuuuuuuuuuuuuuuuuuuuuuuugguuuuugagacaggguuucucuguguagcccuggcuguccuggaacucacuuuguagaccagguuggccucaaacucagaaaucugccugccucugccuccugagugcugggauuaaaggcgugugccaccacacccggcuaagauaaacauuucuuagagauucaguuaaguuagaaacaaaugagaggacugagauggaagaaucaaauccagaucauauauggaggcgacuacugucaaaucauuacaauaacagaagcuggguuagagcguuggcucagcaguugagaguccagcaugguuguugaauaaaagauaauguuuguuaaguuuucugcucagcaauaaguguuuuagacuuacacauuguugugacaaaaagccuauugcauacuuacuauuauuaauguuuuauagaugaaaaauuauaguuuauccacacucacgcagcuagcacaaaggcagguuuggaacuuuggaaaccuuaauauuccaaacuauguuaaauuucuacaugaaaugguuagaggauguaguuuagaaaaaagauaccauuuagaauagcaacaaaaaauuguaacauuucugagacuagcucuaacagaaaauauguaagaccuuaauaugaaaaguaaaugaaggacauaaaaggacccucaguaaagggagaaaagauuuuguucaugucuuaggagacucagcauuauauuucaaauagcuuauuuuucuccaaaauaaucuauaauugggagcagauucaaugacauuucccaagguuucacccugacacguugauucucagaaaccuaugaaagaguacaggauacaaacacagggcuguucugaagaguuaagaauaagugaagggacuuauuuuuauuaaguacuacaaaaaaaauaauagugauggcaagugaacucacagagucacugcgcaucuuuauacaaaacagaaguggcuuuacagauuaguagacagagcaauauuuaauuaaggguaauagaauaauugauaauauauaugaaagagaacgaaaaugugaagugcugaaauuuuauguggaaaauccuacuguauguuuaugacuugggaugaagaaaaaggcaauaaaguauugguauaccuaaagacaugcuuuaguuuauccaauaagaaacaaacuacggauaugguaaagauuuuugugugacauauucaacugacauuuguuuucagguuauaaaagaauuaauaccuaucacugaagaggaaucugagucacuaguaaagccaaacgccuacuaaacuaacaaucuaaacuagcagucacaggagugugugcuaaagucaaauacagugugguauucaugagauugauggaagagagaaacagaauaggccauagcugugaggagugggcaugugcgucccuggaagcacgguaacagugcgguauaaguacuggcauucuagagcugccucuaguaaacuuuaaggaagguugcacagcagcaguauacugcagaaaaaugguucugagcauggagaccagaggaagccucucacugugccagguaagcacuuauguagcuuagugcaguaucgacuaaguucaauugaaacucuagcugauaacaggauaauguaaguagaaaugguucuguauacguaaaagggaagauuaauacagcaaaaaauuaauauacugaauuacaaguaacagggauaaaaaucucaaaauauguaacgauauagaauuuuugauauuaugauuuuauuccuauaauucuaaacauacaacaugcuuaucuguauuauuugucacuauauacacaucuaguuugaguacaaaacacugguaaagaugaaaaauacuaaauuugagguaaagguuuuuucuguguagagaaaauuggauuaaggcgagccuacugcuucagcagucgauagugcuuuauuuccuaagcugaaucaggaaaagauguaugugggcaaguaauauggcaguaugcuaagcuuggaaaaccuagacgauggauacaugaguauucauauucuuucuuuuaauuuagugauucucaaucuuccuaaugcugugacccuuuaauacagugccucauguucugguuacccccaacaguaaaauuacuuucguugcuacaucauaacugcaauuuugcuacuguuauaaauuguaauuugaauauccguguuuuccaauggucuuaggugaccccugugaaaggguuguucaccccugaagggguugcaacucacagguugagaaccacugguuuaacucuucuguacaauauaaucaaaguuugguguaaaauuucaaaguaaguauuuacaguugguucaaaaaaaccuagugucaguuucauugauaacuuuauauauauuuugauuguauucacucuuuuuucucugaaccucccauauccacucucuccaaucaacccaacuuggaggcaggagggcagggaagaacccuguugcuggaaacaucuccuauguuaaagaacuuucccuaaaugggacacaaaugucauuauuccuccccaacaaaacuugaggauuaucauagauuaucauaguagacaaggcagaaaguguguaauagccaaacuugguggauaauuucaaggaaccuguuuucugggcacaauagggcaguuugcacauacgaucuuacagcacuuguaacaguguguccaaggucugcaagagcucaagcagacagaagccuagcguggagcacaguuggaaggaaggugcgaguccccacccugucugaggcccuguggccauuugauagcugcugggagagagagggacgagucagcuuucuuucauaaugugacuaugguagggugagcacacugcagggcaggccuuaaauuuuauguuuuagguuuucuuuugaagagcagaauuuuauauuagccuaucaaggcaguuuaguaauggccuagauagaauucuuacuauguguucuaugguguguguguguguguguguguguguguguguguguguguguguauugcuauacuuaagaaaagcaaacuuggcaggugugguggcccacaccuuuaaucccagcacuugggaggcagaggcagggggauuucugaguucgaggccagccuggucuacagagugaguuccaggacagccagggcuauacagaguaacccugucucgaaaaaccaccccccccaaaaaaaaagaaaaaaaaagaaagaaagaaaagcaaacuuaaaaauuuacaaauaaaaauuaaaaucuuuuuauauuuauauaauagaaaauauuuaacguacacagucaagacuuagaauccuuguugugaagaggcuguucuaagacagccuaaauaugcaguaguuaccugugcuucuccuccccacagcuggccucuacagaauguuaccuaaucuauguuugagagccaaguaguaguagaaauuagaauacagugugugaaaugccucuggauuuuaagcauuacaagcuuuauuuacauuuauaaguucauuauaucuucaguuuaaucagggcaaucuccacagaguguguguaccaaaacuaucuccccaccagccuugcguuuugccugcuugacuuucugaauuuguuauaaauguuacaaauaaugaauguucaaauaaacguaaugcugaggccauuuucuagauacaaaccagccucuauauacacacucagaaguuacgccaagucccgacuuguuuuguuagucuaauagaugcgugagaacugauuuagggaacucuaggugaaguaugagaacucaaauuggcuuugagacuguuugggaauuauggucauauaauuaaagaccucagucuuccaccuccaugucaggguucaccuagcucuacagaaauggcugucuuuaguaucuugcuaagaacugguaauugcuaucauaaagauuuaccuuggcaaguagacuaaagccuguaacuaccaggaagacagguuugguagguuugccuggcuucuaaaaagauugcagauagaaaaucacuguggcuaagugauacggaaaaacauaguauugugacccaugcugcauuuuaaauucuggaauaggaaauuuagacauaagaugcgauugguuuuagugguaucacuuuauacuucuuccacauuuauuguuugauuaucuuuaaucuagccugguuuguggcccuugauccuuagagccucucccacuucuucacagucacugugccucucugggaaugggugugucagcacuuaaccaccuagaagcaagcuuugccuuccucagcagcaguguuucaguagagcucagaguuuauuuuugccuuucaagaguaacugguaacauugggugggggcauuucuuauauccaaagugaguuccuuuuggccauuuuaauauguaagaaaugggggaaaaguuuaagugaagaauacuaacauaaaugaacaauuuggaauugcugcuagagcauugaauuugagauaauuaauuugcgcauuuuguuaguuccucauaacuacuuucuaauccaaugugauuaauccauacacuguuaccaucaugaauaucuauuauuuuagaccucgugcuaggauauaaauuucaagauggaaaccugccauccccucccccccucucaggaugggauagcaugugauauaucaguaaugguucugaaaaggcagcaggaaugcggugacuacgcaguaaacucauggaggacccaucugccaauacuguucuagcacccucaagugcagguggggccugcagucaauaguggcuucuucugguggcuuaauuuugugcuuuauuacacccuuuuucaauuagaccuuguagcacuguuuuagagaaaguaaguguguacauucuucacccuuacugggaaaggaagccacauuaauacaccaagaaguaagguaaaaacagcccagugcccugaaaggccaguugaguaaagacuauacucugaauaaugggguuuauuguaauugagaguuugcuuaaaggaucaaaauuguaaauucauccugucauuacuaauuaauugugguauucaauguguaauuaauucccauugaugacuaaguaugacguuucuaguaagaaaauaaaagaguaauuuucccuuuucuacuauugagcucaguuuaacauguacaaauaugcauaauaaaaauaaaucuuagaaagaacuagcuauauauauauguauauauaggcaugugugugugaauuuaaguguuuggaaaagauauauacauuacucauagcuuucauaugauaaacaaacugagacaucuuacuuuucaaacucaguuuaucuuggagcuuauacagcaucaguaaauaauaaaaaaaauauaggcuggguguggaagugcauaccuuccgcacuugggaggcagaggcagaugaaucucuguguucaaggcuagcucaaucuacacauugaguuuaaggccagccagggcuaccuagugguacccuauuuccaaaagcaaaacaaaacaaaacaaacaaacaaacaaaaaaaccgcaaaccaauaacuccaugugaguguaaaauuauuuauucagccaaguccuuuuugguccacuuuuggcuuuauaacauacacacuggguggauuuuuguuuuuuaacaucgccuguuuuaaauuggcuaagcuagucagugaguucccaugucauaaagaccaaacucucuguuauggccugucauuuguaaccacauugcauaccugcaccccauuaucucucauagcuucugucgcuuugauacauauucuuugggaaaguucucccugaccgaccugucuguuggaguuacuuugcuaucaaauccuguuuuuauuuucuuauuagccacuuuuaaaaaaauuaaaaaauccagcauuucguugggugucauacugcgcccugcuucuccucuugggugccuggagcacaggcaaaguccguaacgagugguccacaguccgagagagaaaacagagagguugugguucccagucuccucuguacccaggcacuaccagcauaucgcugggagucaggaacggggcuccaggauccacacuuccagucauggcguccaugugccagacaggaaggggaaggcagagccugcuuuggagacagaacgugaucugauuccgagugaguaccugcagaguacggaggggcuggaagagagagagacagccuucucugggagauuuaggcauggcuguuuaagaugaaggucuccccugagaggauccuugauaaagagaaaauccuugcuuguccaaaccucauuuaugaugugaaugcauacaccuuacucagggugaacccaggauuaaauaccuuguguaaaaggaaugcccaggaagggaagcucauuggcugaaugcucagggaguuuaucuagacaccucauuagcauggagaacugaagcuuuguaugcugcugugacugauugcuguggcccucagggucaugguuacauguuucagagcagagaguuaggccgagaauggccccacuccugccauucucuucucgggguuugagcucauucagccuuacauucccggugccugucugguaguaagggcucacaugcccuacacuugcugucuucauucagguuguaccauucaggugcuaaaagcucaagcaucagcaaauggccugguuuugaauucuaauuauuuaauccuagcauguugagucuccaccuuguucuucaugauccucggcuaauauuggagcuaaaaggcugaccauauggcucagugguaaaagaacuugccucauaagccuguuguuccaaauuuauguagcuagguguuguggugcaagucuggaaccuggacuacauagacagagacuagagaaucaccuggaaucuuaggggcugcccugaauacacaauagggcaaaauaguaagagagagccugccucaagaaggggagaacuaacuccccaaaguuguccugucuuccaugcaggacauguaagcacauaguaauuauaaauuaguuaaguuaccagaaucuuccugggcaaagcaaaggaagacucaugucccaggaaagcucagccaggauacuggagucugugagaaagaugcuuccuucugcaaguaguuuccaaugagacgaaacgaaggaugaccaauaucuggucuggucuaggcugguccaucucuaaguggcucuagguaacacagaauuucucuguaguccaugucuguucagaauauaaaagauugggauuugccgaauaauguguaguaacaagaauuggacuugaguaaucaugcauacagaguagggaaaggcuuggguaagguucuucaguccacagcugcucucugagcuucugguguuugcaguguguugaguaagucuuccugcaggcugcauuucuuagcaaacaccauuguuuuagggauuugccuguuuucaguucauucacuuucuguugacuuucugauguauuaauaaauggaaauauuuucuccaaauauuaauuuccuuacuucuugccuugauugucaaagaguuugaguugaugaauuuagguaaugcuuugugccaucauagggugcucuugguaaaagaggaaggaaaguaguuucuuucuccaguuguaccccacgaauuaggaacucugugaaaauuucucauugauaaaaauauguagccaugccuguuaacacaagcauaucucagcuuaguugggaaauuaaggcaagaagaucauaaguuuaaggcccgucugggcuacagaacaaguucaaagcugaccaugcaacguggugagagcuaucucaguguacaguccaaaggcugaagauagcuuaguggcagagugcuugcucuguacuauuccugcaggccuuucucacugcaaagaucuaaaaacaagacgguggauucaagauccguuucuucuugugugcucugagacgauggcuggcucuccaggcgggcuggauugaaaggucagagaguacaguauguauaauugcuccugucucauuaaauaggcucacaggccagcaagaacaaaguacaccaacgucaauaaauagcugccuacaguuauaacguaugcguguaguaggugaucuugaaguucgacuguuaagguuggcuuguuuuugugcuaacugaaauguaauccuugcuacaacuaagauuuauuuauuuuuguuucuuagugucuaaaaagcacggcaagcucauuacuuucuugcgaacauucaugaagucucgcccaacaaaacagaagcuaaagcagcggggcaucuugaaagagagaguauucgguugugacuugggggagcaccuccucaauucuggguuugaagguaaaaauuaacucuuugagcuuaugguaucgaaucuucacaucuuuguauugguuuucuuucaccagacacccaguaccugugguaaauggugcgugcguuugguacuugugguaaauguugaguucagcagccgacaccuaacuucagagccucaccucaguucuggguggagcgacgugucagggugugccuugcccacagugcuguggucauguagggagagcuggcaugcgugcaggacauggugacucugugguuuguuacaccguccaggcagcuucugcagccaacuucccuguucguguccuaaaacacucacuuccaguucuuuagugggagggugacaggugagacuguaacauacugaaaccaacugcguagauuuuauaacuaaguuuacauuccuuucucuuuaaauuuggaguccagaauuuagugguuggaugaaugguuagagggaaggaaaggaauucgaaguucuguugacaaaaaugaguucuuuaguauccagauuaauuguuuuauuugauaaguaugcagauuuuuuuuuuuuaagauuugagacuuuauauuguuuacacgggguauaucuauaguuauaccaugaauauauauuuuauauacacaggggcuauuuuaaagucuaaaggaauuaaauguauauuuucaauucuaaaacaguuagaacaaucaugaaaaaaaaucagauauuuuauauacaacuugagaggagaugagaaauacuuauaaaauaaaaaguuguaccuaucuauguauuauguauaauuguuuuuccuuacacuuacuguguuuucauuuagacuaacuaaauuaauaacaauaugaacugugguugugugcuacauaaugcuguauugggcagugauggauuguguauaugauaguaguccaguaagauuguauuguagcugaaaauuucuuguuaccuagugagauuguuggcuucagaagaguuagcacagacugaagaucccagguccugaguuuagucuccagcaucacugccucccaaacgaaaguccaggccagcacuucaguauguguuuauaauaacauuggugcugauggcuguauaaaaguauaaacuauagcauuauaaugauauaccuaauauuuauugguuuugagacagccuuuggcuggccugcagcuuccuaucuaguccaggauggccacaaaguuccugcuaucuuuguucugcaugcugcgauugucgguguaaccuagcaggcuugacugugaacaccguuccugauaacuaacuauaaugaaugauaauauugcuguuguauacuaacuguacuauuuaaaauaagcaucuuuucauuauagaaguguuuguuauggcguuucuacacuuacauugguuauuguggaguacauuacuucuauuuaaaaguugcuguaugcugggauggcagccgcucuuguauuuacuaugucuuuugacuggauuauuuucuucugcauuugaucuaaucuggcuuugccauuuuucuggccucugaguguacaaaagccaccauuaauguguuaggaagagaccauguuguuugaucuggaaacuguauuaacagugaucaaggacccugcagguagacagcauccaugaugguuguucccucugccaggcuugcauucugucagcuuugauggugagaagagaaugaagugauuaugaaugcuuugcagagacucaaaacuggucaaagugcugagagcaggugacuguuggaugcccaguucacaauacacaucuguaucgccuccuccagggcucagaggccaucacgggcuaggaggcagaaggcggaagagcuggaacaucagaaagagggcugugaaacaguccaugcuggcuuuuguacccaugaauucacaacagcagcgacugucuaugaaagaucucacuagcauucugacauagugacgaaggggauuguaaggccugccccucccuggagagccauaggcaguuccucagagagggguaccauacuacuuagugguauauacacuggcauaacuuccaucuaugcucauguagacaacccuaauuaagugcagagggcugccuacacaugcacacucucaugcacacagggauggaaugauugcaaagaaggaaagugaggagaauaugaucaaaguaaaguacagggucaggagagagagaaauuaugaaagaauaaauaaacuuuaaauagagagcucagcauuauuaggggcaaugagaguaacagacacugacagacuggggggagaugacuggagucugagugcugacgugugcuaagacugguagaguuaugucauugaagcccuccgcuaccagaaccuugcuugggucucaccaaagcauguuaaauggcaucuagauuuaccaaggguggggaaguugugaaagucagcauggcugagguggagcuggcaaacgccuuaacccgaggugugggugagggcaacgcucagccacagaggauguucuugauggauggauagauauggaguaacuggaacucgaucagaaaugcacagucaaagaagaagcaagaguaaggaaguucuggaggaaaaggaacccccaaauucaugaugaggcuguuaucgcagaagcuuccacagaccccagcaaguucaguuuaccccagugccaagaggaaguguucugaggcccuuucuauugauacaucuauggcagaccgagccggccacucugaguaccuggggcugaacagcucuccaggagcugugugcagggccugggaguaaucccagaaaacacuguuccguuccagaggggaggauggcgguggggacugcgauaccgaagauccugauccagaguuagccugcgauaacaugcuuacgucuuuaguucugaaaaguuuaaaauagaauuagaaaauggaaaaagcuugaagaguaaggaagaaaauuauaguauauuguaguuuuagcucugauugcaagucaaaauauaaacuuauaaaauaaaauuuuauagcagcuaagauuaauuuacuaagaaaauuuuuuuaugaguuuagugcagcccaugcaacaguucucuagacacacacagaugcccagcacagcccugagcccaggcugacucacugagcauagcuuccaguccucaaggcccuguucauaauaaauguacguuucucuacaauuacuaugcauagauauagauauguuuacagauauagauauguuaaauauuuaugugccgggcuauuauuaaccacaguguucagaauaguaccaugcugcucagcuuuaugccuuuggggcagugggcaagauuguacaaccuagguauaaaguggccacauuguaaggcauguaugaauaauucuaauguugguacagugaaaucaaaagauaucugagcauguaucccugucuuuaaacaaaacaugacuguagggucuuugcccuaaauauuugcauuucuggcacuuuuuuuuucugagagagggacucauauuauagcaauauuuuacuaagugacucauuuucucuauucugcagugagugaugagagucacagagguaauccuguuacacuuuuuacuguuucagcaccucccuguuggaaugaaugacaaagcugaccuaccugcuucucuuaugugguggcuggugguguaagaaaccaggcaggagcccgacaaaccugucuucuguuaauguuucacuuguugucccuagugccaggguuugacagaguguaagcucucccagacucacaaaaugugagcucacuaaaaguuacagguauuuauagggccgcuaguuuaaaaucugccaacagaauuuucugugcaacuauuagacuaauuugucauuuauuuggacaucuuuaauugcagagucaggucauuuucuuacuuuuaugacucuugccauuuuccagccuugcuguggugcaaucauuaauaauugauaacucugauuaaucauuaagaauuaauaagagacuccaccaccagacuguucugucaugucugagcauccagcagcaauuaagcaaguuucacucaaaucuuacagguuuuguuuuuccuucucucccucucucccucccuuccuacuucauuagagaagacagcugccaagauaauauuuuguuuugacaaauacagguuuuacugcacuaucauaaguucucugauuauaaaaucuggucaugugaaauggaauuuucagauaucuaagguuuuuggcugcuauuguuuucacugaaggcuugugcaugcacauguggcagaacacuggaaguaaggaaagagggagggagagagggaggauagggaagggagggaggaaagaaggagggagagagggaggauagggaagggagggaggaaagaaggagggagagagggaggauagggaagggaagggaggaaagagggagggagagagggaggauagggaagggagggaggaaagaaggagggagagagggaggauagggaagggaagggaggaaagagggaggauagggaagggagggaggaaagaaggagggagagagggaggauagggaagggagggaggaaagaaggaagggagggaggaaagaagcaagaaaguuguuuugaaaugucuacacuguaaggauuagucuuugauauacaaaguacucagugcuauuugcuacugcuuuuugauuuuuaaugacaaggaccuucagguuuuaaguguaaaauaugauaucugagaggauuugaaagguggacugcauaaaaggcaggaaaagcaaggcaccauuagaguaaagaaaugauguggaaacauacugugaguugaauucaguagcucugccugucucacuaucaaucuaaccugcuucaguuuacuguauuucucccuuaguauagcaucucuuuacagaccaaguaauguccucccaaaccuggcuaucagggauuuuaacugacacuaacacguggccaacuaagaagccugugugcuguuuaaccugcauuacaaaaugaagaaugcuaagcuguggccauuguaagauugaaaugguuauagaaguuuauuacauaguuucaaacuuuuguucuaucgcacaugcccgaaauagcuauuccuuugcauugacugagaugucagagaaacuugguguaggagccaaguguuacagcacuugucauuauguuguuggggcaaacacuuuguaaagucucuugcuguggaugaccuugagugaguugcuguuuguuuauuuuaguuuguaguaguguggggguuaaacacuugauuuaaaacagucugguugaagacuguaugaaugauacacagacugaaccaggcuagagguugccagguguagauacaaguuuaauaaaccggugaugaucuuccuccccuuccuuccccuucuccuuccccuucuccuuccccuucuccuuccuccccuuccuccccuucuucccccuccucccucuccucucucuccucccccucuuccccuuccuccccuuccucuucuuccccuuccccuuccuuuccccuuccccuuccuuuccccuuccccuuccuuuccccuuccccucuuccuccuucuccucccccuucuucuauaacagacugauuugugaauuucauuuugcuuguaaacacaaagauguuuugagcauuacuuugguuacacugaauaacaacacugaucugucuuuaaaacucucuuuagugccccagguucuucagagcugcacagcguucaucgagagguauggcauuguggaugggauauaucgucucucuggcguugccuccaauauccagagacuucgguaaaacucuauagcaccuucuuuuuuauccuuauuuaacuaacucagcaaauuaaacuuauuucaaaaacagcaacuaugauaaccaugguuauuaguaacauguuugagauagaacuaggaaagaauaccacguuauucuccuccuaaaugacauuucauuaucugcagugucccagagccaugcuugcugacuuccucaguaguauuuuaucucuuugaaguguuggaggaaggccagugggauggcuuagcagguaaaggcaaugccaaguccugugacccagguuccaaccuggagcccacacaguagaaggagagaacacacuuccaaauuguguucuguccugcgugcaugugccuuggcaagugugucaaaguccaaaaguaauauaggaaauauaaugaugugacuaaaguagaaagucacugaaguaaaccuuuagggcuaaagacuuuucuguuauaauauugaauggauaucugacaaaagauggccucucauuuguuuaaguccaaauauugguuuguuauauguaauacuuugaaggaagcagcagcucugaaguagaggggaacauuuugggcuucugcuuuuuguucugugguguauauuuucuucucuucacuaaaguaauugucuuugucuucugucuugguuagucaugaauuugauucugagcauguccccgaccugacaaaagaaccuuauguucaagacauccauucugugggcucccucuguaagcuguacuuccgagaacucccaaacccucugcucaccuaccagcuauacgagaaguucucugugaguaccagagggugggauagauccucccucucaaggucuccguggaguuuuguuguguguuuauuccuaauguguugugguuuaauuucauucgagaauuaguucugugcugacaaaagacucccugaacaacagcaguuaaguggucugggucuuugaagcuuucaaauuguuguucucuuccuucuggcauugagccacuaacucagcaugcauggcauugaauaccagcaugucuuuuaacaguggcaagugagcaccacagcguguggggacagugugccuucuugaugcuucgcuuugccccagugagacugcaagucaggaacucccauuuggacuagcagagcucacugcugugguggguuguaucuguuacaggaugcuguuucagcagcaacggaugaagaacgguugauaaaaauccaugaugucauccagcaacuccccccaccacacuauagguaagucaugacuuggcagauagauaguagcagccgaagcugagguuuauauuaggcacagcugggucuuuauggcucauaugugaaugauuguuuuuaauaauagaauguauaguacugucuuuuggucacugucuuuuauugguuuuaaucucuguguaguuaggguuucagaaguguuguagaugacugauggauuguguguguguguguguguguguuuaguuugucugucuacauaucugauuguguaguuuaaguugauuacuuuauuugcaaagauauucugcucaguuauuuaaucucaguguacacaagguuguuuagauaaauaugaugaacaaagacguugcaccugagugggcuuuucacuaugaaagcagaucagcugccagguacuguuucuacugcuccuggaguugcgcaggccagcuuuagguuuguuaaugccuugguuuuaugcuuuuaaauuaguguucaggcucuuuccuguugucugucagaaauguacaagccagugaccuucacacugcuguacagugucuguuucaguuagcauguuguauuucauuuucuagaacccuggaguuccugaugagacaccugucucuucuagcagacuauugcuccaucacaaauaugcaugcgaaaaaccuugccauugugugggcaccaaaccugcugagguaauuuguauuugauuuaugaacuuuaaggaaugcauuuucuugaauuaaaaagaaagccuugcaucauuuuucaucaagaaaaaaauuagcaaguaaaacaaacucuuauuguauuaacaucucccuaaagcagccaucuagguauuauuagcuaaggggcuguaaaaguacgauuucuucuguggguaucuuuguagcuucugugcuacagaauugcacguuaggagaucucucacaacucuggugguccugucauucaccccacagaucaaagcagauagagucagcuugcuucagugggacagcagcuuucauggaagugaggauucagucugugguuguugaauucauucucaaucauguggaugugcucuucaguggcaaaaucagcgcugucaugcaggaaggagcagguacggcuccgauggcuuuuccuugucaccaggaacagguuccuagagggauggaggacuuugcaauuauuauuucaccuaauacuaugugaaagugguagaagacagcuaagucaagucuguuagaaacucaaugaauugacaguuacuugaugugccuauauaguggguacuacauaucagauuguuuugguaucaauuuauuacacauuaaagauaucgugccuuagggcuggagagaugcuucagcagcugagaacacugacuucucuuccagagugcucaaguucuguuuccagcacccacauaauggcucacaaccauuggcaacuccacccaguuccaggggaaccagugccuccuugccgcuuccacaggaaugcgugcaaguagagcacagacacaggcauacauacacccauacaaaaaauaaugaaaaggauuuaaaauuuuuuuugccuccauuauuaguauauauaaagguaugggauaaagcagaaagagaaaaacaugcuucuaaaacuaaaaacaucugagugaucaccuuuaucugguaccuuuuaagaagcuaaauuagauuguugcagaaucucacugugcucugaaaugucauuaaauauaaaacacugugauauuuauuauugaaaaaccuugaagaguugaaacacaucacuaaguagagagugaagguggauggacaaacugauacacacaugcaaugcugacaucauuccuuuuccuucugaagcuucucugucaaggcccaagucccugcuggucucgucuccaucuaccaagcugcugacauuggaggaagcccaggcaaggacgcaggcucaggucaguucuccuauugugacggaaaauaaguacaucgaagucggagaagggccugcugcgcugcaagggaaguuucacaccgucauugaguucccacuugaaagguaacauaccugaguccuguuuuaaaauaugcuuucacagcuucagauaauagaaugcuuuaaaaauuucuauuuuauuaaaauuggggcaguuguagaaaaauacuuaauugaauauagacccugaacccuuuauaaggaccaauaaaaauuauucuuguaagacuuaauaacaguauacuugaaaaaaaguuaguuguacaagaaaaauugcuaguauaaaugauacauauuaauuguaugagguuggcuuuucucuuugagaaauguagacauaaguuaugcugaaauagcuuauucagaaaguaauguccucugagagucuccacccagcagccaauggaaagagaugcagagacucacacccaaacauucgauggagcucagggugucuuauagaagaguugggagaguugagggaccugaaaaggacagggacuccacaggaagacaaacagagucaauuagucuggaucuuuaaggugccugaaucaccauccaaagagagagccugggcuggcucuaggcccccugcacauauguagcagaggagcagcuuggucuucauggggguccccaacaacuggaauaggguugucccugagccuguugccugccugcuuguggauccuccucaccuaaauggacuuccuuguuuggccucagugggagaggaugcaccuagaccacagggacuugauuuaaggaggaacuagggaaaugggggugacacccaguaggaggcuuccccuucucuuuugagaaggggaugguggaauggggggaggacuugcaugagggaguacugggaggaggaaagggcugauguuggguuguaaagugaauaaauaacuuuuuaagaaagaaauggcaacaggcaagaaccaaaaaaaaaaaaaagaaaagaaaagaaaaaagaaaaagaaaguaaugaaugcuuagugacuucucugacacugguucuugaccagcaagagaaucacugguaacugagacaugcaaacccuccugccccagcccagucccaccuggucaggaacuggagcguccagugcacccugauaagugcagaaguugucaugaucccagagaagcugcaagcaggacucauacaaacuugcaugaggcuuuuguuucacuacaguuuuugguugucacuugguuucagggacuugagcgcuaugacacgcacugcaguguguccugccggugucccucugaggucuuacccucacugcuucucuaaggaaaugcuaguaaagggugugacucccuugcgagggcuguaggaagacagauauaugugcaaguuaguuuggauguuccugcugcucuccuggcugugcccaugaacauaaggcucuuguuuccuuagguaauguaacacuagcaaaccucagaauuucccuuuuuucauuuuuggguauccuuuaccuucauuuuuuuucugugacuaaagaaccagaaguuggcacaugucuuuaucauuucuaaguugguccucagcaccuugcuuucauauuuuagccccuguuuuacaaagaacaaaugucuuuaaguagagauucaaaaaguagacauuaggauguagacaggcuuggguuucaugaaauccugaugcccucauacacuuucacaggauuaggaaaguaguugaacuucuuaggucuucauuucaucagcuucuugugugguuaucugguuuuaaaggacaucuaacuauacacagguagcuggcucuuagucuggauuccugccaucccucuguccccacucucuccucgccucagcuguccuauacugucuucuuuguggaggcuuauuaucaaugucuucuuugcacuuuuuuucauccugaggugcacguggucuuugaagcuauaguucuuguugcuccccacauuagcucccaugccuugcagagcugcauggaaggcuccuauguggcucccauugugccucuccaggcuguuacauucuuucuauuguuuguucauuucuuguucuguaggaagggauagagccuugguuaucuuaguacugauaaacuacuuuuuguuucauagaaagaggccucagaauaagaugaaaaaaucucccguuggcagcuggcguuccuuuuucaauuuggggaaguccucuucugucuccaaacgcaaguugcagcguaaugaaagugagcccucagaaaugaaagccauggcuuugaaagguaagcacugagcugcccuguucuggguagcagacugccugguggcuucuggcaccuaccacugugcucacagccaacuucucuggguguaccuucccguugccaucaugacacaccucacuguaaagcaugcauaguuguguggcccagcuugguugucugcaugugugauugcagcucguaagauaguaucaguuacguagagaagaacuccguuucuuaaaaaaacuguguagauguuacacacacacacacacacacacacacacacacacacacacacacacacacacaccaguagugcauuugugucauugcuucucuaggguaacauagcuuguauagugcugguaauaauucuccuguguuauguacuuguuuugaucuuuaguuucacauauuuaaaauugacaagucuguguuugagcauacuuuucaaguuuauaacuaguuucacccaugucauucuccuacgugacuagccuauggaguacuguguuccaucagacagaucuaugacuguuaagcaaauuacucuuuaaaauugauuuuaaaacucgugcucugauacgaacauguucuuaaacuagaaaaccuaguagcauuuuucucuuagggaccauuagaaguaaugcucaggucauuuacaucauaccguuuacaaccaauuuauuaccuaauuguuagauauguuggcucugcagaaagaaaauuaagguagugcccugccuucagaguuuaacuagagagccuucuauaugagaaaacgacucccaguaugcaguuacagcugagggagaauuuuaugccuagcaucuuuggcuggcauugucagcucuuauggugguaggaugauggucaagaauguuaacuguauuuuagaaaauuaauauuuugcugggcaaugguggcccacaccuuuaauuccagcacuugggaggcagaggcaaguggauuucugaguaggccagccuggucuacaaagugaguuccaggacagccagggcuacacagagaaacccugucucaaaccccccucucccccccaaaaaaacuuaauauuuuauguguauggaugccuuguuugcauuuuuuuuuuuaccuuuuuuuuccgagacaggauuucucuguguagcccuggcuguccuggaacucacuuuauagaccaggcuggccuacucagaaauccgccugccucugccucccgacugcugggauuaaaggcuugugccaccacgcccggcccuuguuugcauuuguguguguacacuccaugugccuggugcucauggaggccagaggagagccauggauucccuggaacugaaguuauaguggcugugagcugccugccaugugggggcugggaaucaaccccagguccucugaagagcaucagugcucuuaaccacuaagcaugcucuccagcaccaggaaagagaacuuucaacuugggaguugaagaagguacaguucaccugaucuuuaaggcgacugagaguccuuucucaggagaugagagcaggcuggggagaggaacaacuuggagaagagauuuguaaagaacucagagaaauuguugucaagagaggagagcaggaagguacgguuaggaaggucacagagagcauaagaaacagagcucagaguaucugcaguuuguugugcuugcuaucaacaggucagaaagacauggaacuuuagcagguaagauuaauguauacaauaaaaauaaccaguauuccuggggcugcuguuacuaauuacuacaaauugaaacuggaagcacaaauguguauggaaacaguuugacagaugucaccucgccuguggucacuugaaguucuuagggaagacacccuccugucucuucuauccccuuacggcucccagcaucucuugccuuuuuuuuaauuauuauuacguauuuucuucaauuacauuuccaaugcuaucccaaaagucccccccuacuccccccccaacuccccuacccacccauucccauuuuuuggcccuggcauuccccuguacuggggcauauaaaguuugcguguccaaugggcuucucuuuccagugauggcugacuaggccaucuuuugauacauaugcagcuagagacaagagcucugggguacugguuaguucauaauguuguuccaccgauaggguugcagaucucuuuagcuccuuggauacuuucucuagcuccuccauugggggcccugugauccauccaauaguugacugugagcauccacuucuguguuugcuaggccccguccuagucucacaagggacagcuauaucacgguccuugcaacaaaggcuugcuaguguaugcaauggugucaucguuuggaggcuaaauggaccaucuagagacugccauauccagggauccaucccauaauuagccuccaaacuaugacaucucuugccuuuaaguagcacaacuccauguuuucauggggccuucuucucuaugucucuuugucuuuuauuuucacccuccuugaagaaaggagccacuguaagaugucaucagaggggcuggaggaguggcucaguggcugaaagcucuucuuuucuuuccuuuccuuuccuuuccucuucucuucucuucucuucucuucucuucucuucucuucucuucucuucucuucucuucucuucucuucucuucuuucuuuuuuuuuuuugggggggguuuguuuuuugagacaggguuucuuucuguagcccuggcuguccuggaacucggaaauccaccugccucugccucccgagugcugggauuaaaggugugcgccaccacgcccggcugaaagcucuucuaaaggacugaguuugcuuccuagcagcagagacuccuccgagggaucccuuacccucucuggccuccucggucccuggcauacacguggggcauacucacaugaacaugugcauacgaguaaaaauaagaguuguaaagacaucacccaagguuaccaaguuggucuuuuggaaacuuauaagaagagaaucuuuuaguucaccuuugggcucaaguucguaggcuuuggaaaguuguuuguuuuauuuuuuuuccccacacuggaaacagaaugaugcagcacauuccauacugggauaguaagcugaauaugacugcgaaauggacagcucaucacacuuggagauucaaguguugcuagggaaaguccagacccuuuaacuguauaguccuuaacaaucaaucacaggcuuuacacugcuugguuuuuauuauuuagguggcagggcagaaggaacccuccgcucagcuaaaagugaagagucccuuacuucucuccaugcaguugacgguaagacuaaaguguccucggauggauuacauaaaacacacagaggcagcaauguuaugaauauauacuuagcaagaaggcugugaaauaucacuuccaguacuauuagcauuaaguaugguucaguuaaaacucauggauauuuuaauauggugugguauuuuggcaacaaauacuguuuauguaaaauggcugaaauguuucaaagcaaacauuuauauuugucagugcuuaaaagugagugucacuguuuccuuuagauuugguaacuggagcagcuuugagacucauuuguuaaugauggguggucuucaagggucauuaguaguuggaccuggcaccuuaaagugagucugccuccaaaggaccaacaucaccuggcagauacuggagggaggugugguuacagcuuaaguuaaaauucagaaucagacuuuaugaaagcaaguguugugcuaagcugugccacuuggauuugcuuggaaagugaaaagccuguuuucauuggaaaagaaggaaggauuuuaagugugugaauagagugcuuuauuaaauguguguaaauacuuuuuaauuaggaagaaguaucauuucuucuugucugggguaccauaaggauauuuccccauaauaaacaaccuuuuguuacuauuugauacccaaggugcuacuuucagugaugacuucuaccuugcaagucaaauaugagaccagugauaaaauaagacacaaagaaaguaggaacauuugcccaaagucauagcaguugucaauguugaguuuggcauacaauccaagagucucuugccauuuucuuacccaggcuguggaucagcuguaguucaugugcuuuuuaauuaguguuuuauuuagaaguucuuuugccacaaauguaacugauguuuguacacccagagacaguucaugggacgagagauugaaguugcaugauuccugcuguacuagauaggugacuagugguggugcuguguccugugacagccaugcucugacauugcuguccauuuuuaccaggugauuccaaguuguuccgaccuagaagacccagauccagcagcgaugcgcucucugccucuuucaauggcgacgugcuggggaaccggugcaauuccuaugacaaucugccccacgacaacgagagugaagaggaaguggggcugcuccacauuccagcucuugugucuccucauucggcugaggauguugacuugaguccaccagacaucggaguggccagucuggacuuugaucccaugucauuucaauguaguccuccaaaagcugagucagagugucuggagaguggugcuuccuuucuggauucauuagguuauaccagggauaaacugagucccaguaagaaggaugcagaagcaggugguagccagucacagacuccaggaagcaccgcaaguuccgaaccuguaucuccaguccaggagaaacugaguccguuuuucacccuggacuugagccccacugacgacaagucuucuaagccaucuucauuuacagaaaagguuguuuaugcuuucucuccgaagauugggcggaagcuaagcaaaucuccuuccaugaacauaucugagccuauuucagugacucucccaccucggguaucagaagucaucgguacggucuccaauacuguagcucagaaugcaucaccuacaucuugggacaaaaguguggaagaaagagaugucauaaauagaucccccacccagcugcagcuaggaaagaugaaagcaggugagagagaggcacaggagaccugugaaccagaagcacagccccuggaacagggggcagcugaagaaguagaguugccagggacagaggagcggccuguccugagcagucagagcaaggcuguaccgucuggacagagucagacagguacuguuuguucuccuccguuccuucucuaagcuaaaaggggucuuccguccugugugccaucugugccuuuuaagagagccuucuccacagcuaggcuagaaucaaagaauguuuuucugaauggugcugagggcucaaagcccuaaacuaaaaugaagcaaacaaaacuccccaaagggcccaugguccugcugcgagccuucacaaaggaccccuuaagucucuggacagucaggauucauggauaauuuuugcacaacuguguagcucuugauucuguuuucucuucuaaugcauauucuauucuagccuuacaaguugacaagccaguguagcaguaccaucacagucugagcacuggaagcuugugcucuaagugaccuuuucuaagucaguggaggccugcuucccuccacccucuguagcaguucaagaggacuggcagccuuuaacacugugguaguuucccuuucaaccagaugugguuucagcagcauuugcaugugggauagaagaucauggauugcaauuuugaaauauggaaggcauauuuuuauguuuuuagugaucacauggggaguguuuggcuuuccguauaggguaacauaagcuaccuuuucauucuaauuuuuuuucccaauuucccacuaggagcaguuacccaugaccccccucaggaucccguuccugucaguucagucucucuuaucccaccaccaccgccuccgaaaaaugucgcccgaauguuggcacuagcguuagcugagucugcacagcaagccucaagucagacacugaagagaccaggggcuucccaggcugggugcacuaguuauggagacacggcagucguuccaucugaagagaagcugccuaguuccuacucuagccuuacucuagauaaaaccuguuuccaaacggaccggccagcagagcaguuccacccgcagaucaauggacucggaaacuguaaccagccucucccugaggcagcagcuaugggaggucccacccaguccaacacaacugacucuggggagcaacuccaccaaguagacuuaauagggaauucgcuacaucgaaaccauauaucuggggauccagaaaaggcuagaagcacuucagcucccuuaacagacucagagaagucugaugaucauggaaguuucccugaagaccacgcugggaagagcagcguguccacugucuccuuuuuggagcaggaccagucuccacuccauuucuccuguggagaucagccccucucuuaccuugguaccaguguggauaaaccccaccauuccucagaacuuacagacaaaucucccaugccuucuacuuugccuagggacaaagcccaccacccucucucuggguccccugaagagaauuccagcacagccaccauggcuuacaugauggcaacuccagcaagagcggaaccgagcaacagcgaggccagcaggguccuggcugagcagcccucggcugcugauuuuguggcugccacccuucagcgcacgcacagaacuaaucggccccucccuccaccuccuucccagaggccugcagagcagccaccaguuguggggcagguacaagaagcaccaaguauaggauuaaauaauucccacaagguaagcuagagaggaagucagugaaguaguauacuuuucccaagguaugccauucgguaggauguauuaucuuuuagucagaugcgugucagucagguggcagauuuccauggaaucugccauuugaagcaggcggucucugccugugccuggcuauuggcuuuguguaaugacagagcagccccuggugacugcagcuuaacuauccuugcugcuucuccuuccuuccugaagcacugagcucuuucacggggacacacugacagaaugaggcagagggagcccagggcugcaguagugauugucuuuuccagcugccucacuguucaggugacugagagugagucaugugaccaccuugugacuacccaacccuugaugucuguauugaagguacuucaucuccagggcuuucagaggucuaaggagugaugauaucuggaguucuuguuauuucccugcugugagcagcuguguugcauaguucaaaugccugcguugggggggugggagugcuagauacagagugccaaagaguuuuccuaauuccuacagguuuugugguaaccuuaaccaaaaggaguuaaaauucuggcccuuccuggaggguacuagcuguagaacuuaccucucagggacaacauauuuuaucugugggcccacugacaggauggacaaaacgcagaggcaguaagcccucacaugcugccacugcagacaagucacuuugaaacucuucccuguaucuggaaguuuaaaacugcuugcuacauggaacugagucacucugaaacuccugccagcugauaaaaucagcugcuuucauuaaauaaaaucuucuuggugcugagaccaauagguaggauguuuauuuuuuuuaggcccagcacugguuuuuuugccuaauccugucauugguucugcacauuaagauaccauuguaggcagucucucuucacauuucaacccuagcaggaguuagcaaacacuacacaugucuccauagguaauagcguacuguguagacacacacauacucuuuuuuggggggcuaugggucagguucaguguaacugaagagcuuggacaaaguuugagcugucacccaaauagccuggguuugccccuuauaaauguauuagcauuuagcuuugagggguugguguuaaacaacagacucuuaacaucgcugucuucccacagguccagggaacggcuccagcucccgagaggccaccugagucucgggccaugggugaccccgcacccaucuuccucagugauggcacugcugcugcccagugucccaugggcgccucugcuccucagccuggacugccugagaagguucgggaaagcagcagggcuccaccacuccacuuacgugcugagucuuuuccuggccauuccuguggcuuugcugccccaguucccccaacacggacaauggagagcaagauggcugcugccuugcacuccagcgcugcagaugccaccagcaguucaaauuaccacuccuuugucccuucgucagccucaguggaugaugugaugcccgugccacuccccgucucacagccuaagcaugcuucucagaagauagccuauuccuccuuugcuaggccugaugucaccgcagagcccuuugguccagaaaacuguuugcauuucaauaugacuccaaacugccaguuucgcccccagaguguuccuccacaccacaauaaguuggagccacaucagguauauggugcccggucagagccaccagccuccauggguccucguuauaacaccuauguggcgccgggaagaaacaugucuggacaccacuccaagccguguagucggguugaguaugucucuucucugggcuccucgguuaggaauccuuguugcccugaagacauucuaccuuacccuaccauccggaggguacagucccuccaugcacccccaccuuccaugauccgcucuguucccauuucacggacagaaguucccccagaugaugaaccagccuacugcccaagaccagucuaccaguauaagccauaccaguccucccaggcccgcucagacuaucacguaacucagcuucagccuuacuuugagaauggacggguccauuaucgcuauaguccguacuccagcuccuccagcuccuauuacaguccugagggggccuugugugaugucgaugccuauggcacaguccagcugcggccccuccaccgccuguccagucgggacuuugcuuucuacaauccaaggcuacaaggaaagaacguguacaacuaugcugguuugccuccacgcccacgggccaaugcaacuggcuauuucucugguaaugaccauaauguagucacuaugccccccacugcugacggaaagcacaccuacaccucaugggaccuugaggacauggaaaaauaccgcaugcaguccauccgccgagagagccgagcacggcagaagguaaaagggccuaucaugucgcaguaugacaacaugacaccagcugugcaagaagacuugggagggaucuaugucauccaucugcgcagcaaaucagauccugggaaaacuggacuucucucuguggcagaggggaaagagggacggcacccagccaaggcugucaguccugagggggacgagcguuucuacaggaagcacccagaguccgaauuugacagagcccaccaucauggaggguauggcagcacacaggcagaaaagccaucccucccgcagaagcaaagcagccuuaggaacagaaagcuucacgauauggguuguagccucccagagcacagggcgcaucaggaagcaagccauaggcaauuaugugaaucaaaaaauggaccaccuuauccccagggagcuggccaguuagauuauggguccaaagggaugccagacacuucugagccaagcaacuaccauaacucugggaaauauaugacaucagggcaggggucucuaacccugaaccacaaggaagugaggcuucccaaagaucuggacagaccucgagccaggcagccaccuggcccugagaaacacuccagagacugcuacaaggaggaggaacacuucucucagucuauggucccaccccccaaaccagagaggagucacagccuaaaacuucaccauacccagaaccuggagagggaccccagcgugcuauaccaguaucagacacacagcaagcgccagagcagcaugacuguugugucccaguaugauaaccuggaggauuaccacucccugccccagcaccagcgaggaggcuuuggaggggcgggcaugggggccuaugugcccucuggcuuuguccauccacagagcaggacauacgccacagcauugggucagggggccuuccugcccacagaguuguccuugccacaucccgacacgcagauccaugcagaaugagccccgggagcaauagaguugaagcagccucugcuggacaguggacuguucuauuuuuuuuccaauaaccaaaaagauuuaagaaagaaaaaaaagcuacaaaccccuuggccacaugaaagaaguauaauaaaagcaaaucaccaccuuccccucccacucauuaccgccuuauccaucacaggcugugcuguuuguccuuacagagagcuggaugauguaaagugcugugcugaaagccuaguaaagaaguucucgccggccguagacccuacuugcucuauagggcugaucucuaggaccccaaggacugccuuuaacccacugaauuuaacuuugcccuuccuucuuagcacuugcaaccuagcucagagcaguuugccucuauuuccuggugggcuuccgcauuucuuguuguguucccacuccccuguccagggccguguagccugcccagguggacucuccacucuuuucugcuuucauuaucccucuccacaaaggagucuaguauucuaaauuagagaggagaaaaacucccugauccuugagcuacgucacuuagacugcuaguggauuaaaagguaaaggaauuaggauuuucagcauuuagugccacaucacuguaaguagcagguccaaugugagccauauuccgcacugucaauaauuguucucuugacagggugggagcuccuaaggagcuuucuuugaaagaugaaguucauauguauugucagugaacucugcuaacauagagcaucaguagugcuuccagugugcuaccagccugcauggcccacaacaagauccgcacacuuuagugccaguacagaaucauccacaguguucuccuuaagaaaggacagcgugucuaacuacagaaauccguuuucuagggauagaaauguacacacuauuauguuucugaccuagaguacagauccccugggaauuuguaggaucccuagaaguugucuguuaggcaacuguacauuguucguuguuccucaguacacaguccgucucauccacuggcauucugggggucgcgugguuuggcuccccucauugugcggucacaggcuugcugcauuugucaccgacaccagcauuucagaauaguucuuucuaacucucuagacguguuaaacaugugaaugcccaggacuuuguuuugaaaguugcauuccuuacuggguuugggauguggcaccucuggcccagcuucccucugguuuucucggcccaucucacccuagacaguggagacuggucaggcaguccuguguuuagauugaguuagauuggcauuucauuccauaaaucaugaugauacuugaguuuuguacauuuguaucuuuuaaauacuccguaggagacacaggagauuucauuccauuuacuggaugguugcugcucuggcuuuuuuggauuagaguaucuuuuauuuagagcaaaggaagaaaucuuucaagaggcuaaaguccugcugcugugacugcugugaauuugugaaagauuagguuuauggcagucuuuguaauuaaaucauauaguugcauuuuaagguuauauauuuagaauuaaaguuuuaagaacaugcucauauuuggagauagucuacgagguuuucuuuauuucccagauugaccagagaguaacaaugaaguccaaagcagauaucuggaaacaccaauacaugcaaaggucuaugagaacuugggcaucugcauuaaaagugcagaccugacuaucagaguguccggaaaccugaugggugccgccacguggcauacagauguguagauguguuggcagacaccuuuuuuaaaauuuuuuuguagccuuagucaucuuuuuugucaaggaggcaacucauuggccucuggaagacuacaccagcccugaacacuauccuuagcagcacagauggagggauagaggccagugccacagugagugagacaaguugcuucuguaacuucaggccuugccugaagagaagugcuacaagguccaggccaauuuugauauuuguggauuaguuugucacacguaguguuugcuccugaaacuaaagucucuuuuauaaauacuaagguugauuccuuagaacaacuucuuuauuaauaacauccuuuggguucagaaaugucagaaaaaguauuuuaaagauagaaucauaauucagauuauugguauaauuaugaaaacaaacuuuagaugaagucuaaagugauuuacuguauguagcaccagccuuaacuuuggauucagcuauugaacagcuuugcccacauguuucucuaauucugugggggcagaaaucggauggcaaaucacugugagccagguuaccucagugucguccgccucgugugugaccucacaaacacaggaacugaauguuauuuucaaguguuggcauggagcguuauggucauggaaguggaacugccuuacacauuaaacauaaucucaccccacuagaacuuuuucagccaugucuccagauuuuagcuuuugggcgaaauuccacgguuugguuagauugaaguagauguuccuagauagcagucuaggagcucagcuagaagcuccaggggcauccaucauguucuuacuauuacuaauaaaucuaaucugagccuuauuucuuacugaguucaguuucuuuuaaaacauacauuuauguauuuuaaaugcuguuuggagaagucccugagacaguuccaagggcagggccugcacauuucuuacaaugguaaaacaguuuuuaaaauguagggucagguuuaaaaaaaaaaucccaagacuaauucugugcagaggagggacguggaaggugagcagagcaggagagccgguugucaguuuggaagcagcagugaauucagagaagguuccuguaaaguccauuucucuguuccagcccuauuggucacccauucaguaugauggcaaagugucaccugagcagagagugcaagaaaguaauaaagaaagcugaaguaugucagaaaguuacuuccaaaugguuagaggcaugugaucgucaguacuguguguuacggaaaugucaagaaugaaguauuuuaauguaugcaagauaauguuggugugcacagagggucuuuuccuuaucugauuaguacuguuaauguucagagauuuaaaaaaaaaugauuguuuuuacaguuuagauucugagauagcgaaaccugauuuucaaccaugcccugcaugagagacgcauccuaggaagucuuagaucauaccuuugaguucuuuaauuuauagaguguuuuuuauguuuuaauauuuuugugaacugguguaaauuguuaaugcauauaagcuuguguauuuuuguaaauaguuuugugauuuacuucuugcccccuguguaaauauuuacagucucauuucuuccaaacuuauuugaaacugaguuguggguuugggguuuuguuuguuuccuuguuuguuuggcuggggugggugggugggggaaaagggauuuuuguacuugagauggagauaucuugugguuuaaagcaaaugucccacugaaagcaauuccaauaucaacagaauuauuucagguuaaagcagacuuuguguauguguuuccuuuuugaugaaguauggauuaagaugaacuagaugggaguugugauggaguguuuggauuagguguucauaucacauggccuguuaggucauaccguguguccacugagcuauagugugcuaucuggcuacauuccucucagcucacacacucaucuuuagagcauaggccuucuaucuguucuggaacaucuaagcagacaguguccuagggcuucucuaacggaucugcugucuucugcugccugguacccagaaugcaguccucaggaaacucaacuggcuucaaagaauccuccaaagggggcguuggaaugaaaaacacaugccuucagauacuuacaacacaucucagacauccuguuuucagagugaaguagccagaaaauaaccagccuucuagacucaguucccuguggcaaagcugggcauggcacacccaguggaagcaggcuuucagugaaguggcuugcuguagaugugagucaugcaguugucuaacuggccgaugccauuucacugucagcaagaguugggagaaaggggaccuuaauagcuaacucccagagaugagucuucuccugugggcuguaaguucaaaucauuuuugagagccugguggagcucugucccuucugcccagcacugaggaguuuccuguauggucugggugccccuggcaauccacucaugcuguguaugcuggaacaacccugcuccaaaugaagcagaccugaguaguguuuccauggaaaaaggucaacagagaugacagaaagacaggcuggacgcucacacugcauguucuuagugucugucauuccaauuauuuuauuaccaaguuuccuugguacugaugaaaaugcaggacuuaccucaccaaaauguaugucugucaggacuugaugguaaauugcagugucaguguuugaauuuguagucauuuguguugcucuauaaaaagguaguuuacugugcugcuaauuacucacugcagaagaacccaguguaugugcaagcaccaauauuaagacccuuggucauacuuuuccauguugugagaacaugccuccuaaaaaaaacaagacuuaauuuuucu

SEQ ID NO: 4996 - RNA, 1350 nt, Mus musculus
ggaacccaaacguagccauagugccuggccauuaugcuuccuuauaaaaucuaagcauaccccggccccguuuuaaugggaacacagcagcucaugugaauaucauuagaaaaacaauaaacccucccugcaucccuuucacucucguacuauuaaguaagaccaggccuugauuaugaagcacuggcaauucugucugagagcaaagcaaguaaaugccauucaaaugaaauggagaugacaguuccuaaaggccuuccaguacgcaaugacagcaguggucaaaagcaggagaauacugggaggaacugggagagaaggacuuugcuugagaaaaacagcaauguggaguuugacccaaagucuuaguaacuaaaaaauauuugacucccaaauacucccgcucucuuccccuccgcaauuagaaauuuguauuucaagaguccuuacucauuccuuccugccugccuuuccccgcuguuguaacaccagcugcuuagaggagaagccaagagacucaacuccccaaggaacaacuugaagcuacuuucuaguucuccacaggccuuggauugaucuccagggagaucugggauguuuuaaugugagaguggagagauuuagaucuugccacuguaugucaugugugacugagaacacagacccagcauccuggggaaguacaugcgugugaaaggaaauuugauccucuguggcugagaggaagggaggaagaccaaaaugguucagucaguauaagccgugaacuucuuucauccugagaaggccggagauaucagggauaaauucuuguuaagauccuccaguagcgcaggaacagaggacgaaaacauguuuccacccaguugcugccguagggugagcacgaagaucacagacuuugcagccagagagacaagacccgugugacucucaaaguuaugaauggcccugagcagugguuaccaugguaaagacuagagauugaaacuaggguggauggugccuaaggccacagaguucagaguguccaaagcagcugucugggacuuauuuggaggaugauaaaacacuuaucugcgcuacgcgcacugagugaguuuuguguuccauucccggaaguuacuuuguauuaggaaucaaaguccaguugggccuuuggcuuuauuagcugucuuuguaacucucuagcagaguaguucccacagauucgagaccagcaggcuuuggcccauugugacuuuucccaugcuucggggcccaagagacauuaaaccugcacuugauggaguuguuuauccugcguuuuucccuggacacauacugaauaaagaaauucuaagacgagug

SEQ ID NO: 4997 - RNA, 72695 nt, Mus musculus
ccugccuccucccacaccccgucuccucccucuguuugagguuccagugguugucccaggagucagguguuugccacaucuaccuaggagaacaggacagguaaaagaggaggcaaaaggauggggauggaagcgguuugcuugccagccgaguaagacuuacugcuguuauucugaagguugucuuggcucaccucaucacagcuaaccucggaaaggaauagucccuuaaggccaaagcccagcuuguuacaucccugacucaugguaagcaacuuguaguguccugucaaggggugcagugggauuggcaagaaccuagaacccagaagucuaggaugaaagaaguccuuauguuagaaucgcuuccuucucuuccucagagauacaggggauucuaaguugcugguucagcuucugucuguacuguuaagaaacuguguaaucuugguucucagaagggugaggcaggaggaucacaaguucuaggucagccuggguuacuuagugggauuuuuuuuuuccccuaaggggugcugguggaggaagaagaaagugcaagagacaagucauaaacacauaguaagauaaaguggaugaugggggcuaggauaggcuugacgcugugcuucugagugcaugcauguuauauguuuaaaaggcauuugucugcauguuuauugagcacauauauaucauauggugauuucaggacaaguuccccuccauugucucauucaauacuaauaaugcucuuugaauaagcucaguuauuuccacugaucuuuuuuuucccccccauuaagaaaaggaaagcuauuuaguggcagaagcaggauuaggacucaagucucuaggcucaaaagaaagaagaaaaaaaaagcugauucuuaagcucaauuuuaugguagaaggauuuuuaccuuuagcaagaacuugucuuuguaccuaguuuggugaagacuuauccagguuuggaggccgggcaacuguuucuugaaucaacuugccagacauauuucaguuguucuuucuccccgagcaguuuuucuuuugccuucuucuuuuucccuugccaaacacagagacauagucauuguauugucuauucccagcuuagcuccagaccaggacaugaaauguaauaaauauuuguugagugacuaggugacugucaggccaaagguaccauucaaauaaaacuagguuuuggugagcugccaaagagcuuccaccuaugcaagguauaauucagauggaaacagccggaauggaagaagcuggaggccaccucuucguuuuguugugaauuggagagucccaacacaugagaccuccagcuuccccugacgaugacuuuaaacuccguuaaaacccugggcacuuacugucaguuauucacaucuuacuuacacuuagucacauccugugccgccuguuucuugaugggaguccagcacaacacccgccaccccuucucugcaacuagauagcaagcuuccgggggaagggggacuggaucuaauacuuuccuuguagccccagggugcucaagcuaggaacuggguaacacugugcugacuccugaaauggacaguccugcagggugguuucugcacuguuugcaguccaggcaauucuagagcccacggcaucaggguuaaaggcuugaagggguuuccucuggagacaggaugccuggcgccuucagcaagaacggaaacugagaaguuauccaaggcuaagagaggguaugcaaaggaggaagagcuaagggagcaguuuggggcgcauaggccggccuggggcagagaaaaggcucgucaauuuaggucaccugacugccaugagggcaugggaggauauuggaaggauggacuucuauuccuguucuugaguuucuguagagagaaaaggauacuuuuuuuuuuuuuaaccgcgcggggacagcaaagaagccuuucuugguuauuguuuccaggagagcgugggaucagugcuagaggcaacguugggcauacucaucuuggagccauucacaggcagcgcuugcccuggguuugcccucacccgauccagccucccgcaccccggccgucucucuccaggccagggaggccuccaggccaaccccagucuccccgcggccucacacccucgcccuccuuccucugcgcccucccucccuccuuacucccuccuuucucugcguccucccuccuucggcgcgcccucccuccucgaugcccucccucccuucuuagcucccuccuuucuccgcgcccucccucucucggugcgcccucccuccagcgcggcguucgcggcugucggcuucccgaccgugugcgcaagcguguccggccccuuccccgccccccgccccccgcccaagcccuggcccccgccuccccuucaggcggacuugcccgcucccaggccggccccgcucccgggacagggaccgggccgagcggagccacugcgccagugcugccccgccagucggggcgccuaacggaucggagcugcgcgcggauuuaccucgccccgccccgcuccacccgcgagggugaguacgcggcagccgggcucuggggccccgcggcggagggcggggagugacggggcugcgaggcugcagccucccgccacggcucggagagguggucggggggccccgcacguggacgccacgcugcacgggguugguguaggguggccacagcccuggggagcugggucccuugcuuggacuagauuuucgcgggaagccugacuugucucgcucucuaggagugagugagcaggacaauccuccggaaaguuucuaacccccaacccugucgcucuugcguccuagcugaaugggugacuaucaccucuagcauccuccgaagucaggacgugugggcuggcuuugcuagaggugacaaguuuugcagggucugccugugugcuggaguugcaaggucgcugaggcaaagcccaaaggugggcuugccaaauugcaggguggcuguguccagggauuagggggggucuuugggccaacugugcuucaaaguugccuggguaaugggcagugagaaggccuaggauaagacugagaaguuaaccuagagcuggggcagaacccuugucuaugucuguucuaggugccucucugagacccuugcuggcugagaccuaugggcagccccgagaugccaacgugucuuguaccacugccauuccucccagaccgagggguagacuuucugguuuaugagucugaucuacucuguucucuguccucuaggcuagauccuccccccccccuccccccggucaggcuuaaaaggcuagucuggguuugaauaguaccacagugauaguugucucucacaaggggcacacaccaauaccacagggcagggucagugcuacagaucccacuuggccccuccaggccucucuacccaggggguuguaaacgaauugauauguguaaguaucagggguacagagggaauguugugaguuugcuagugaaacaccauccauaaccuuacuuucccaggcaccccuagagugcuaccuaggaggugccagucacuuagggccucagaaauaacuggacauguuuuguucuguugggaguuggucugcaaacauccuuugagaaaacugacaccgcucggcuuccucaaacuuauucugccucugcccuacucugagcauccccuauggccuguccuguugcauaggggaaggcaucuuuggcugcuuacugaacccugggccucaccucccacucauuucacccuccucaacacauccgaucccccagccccacuacagcaagccaggaguugggccaguccccaaagauuucaaggugaugauggagauaaagagagguaugcaggcagaagucauaaaaguaaauuagggacugggggugugguucagugacagacggagcugccuacaaucccaguacugggggggggggcggcgggggggggggaggacggacaacgacacaaggaaugcaguugguaaaguguuuaccugucauaaacucuuuaaacuugaucucuuaacauugccuaaacauauuguggugguaccuauuuauaaucccagcacucuggaaauguuaugccagcauuuugacuguagaucauccaggucaucuucuguucuauguggaguuugaggccaaccugagcuacaugagacccugucuuaauaagccccuucuggaguuauucuccaagguuauucugggauuauaucucuccaagauagagcacuaccuugcuaucuaagaugguuaagagcacugagugguuuuacaggggacucaggcucaauucccaaguacccauauagugacuaauuccaguuccaggggaucugacccccucuucugguugccacaggcucaggcaugcacguggugcacauaaguacaauacacacaggcaagacacugauacacuuuuucuuuuagaguugccugcuuaggcuuuaaacagaagggacuauuuagcuuaagaguggguugcugcucagagagaggaagcccccauuccacuaggaggcucagggugaggaagcccccagugccuucuaggcucucuucuguucccucucuugcucccugcccugaaccagugacucacccacaaaagcacccuggccccucuacccugucaguuguuuuagugucauaggauuuuguuuucuggguaaaacuaagaaucagucccuuucuggaaucaucagaaauccugggaaggaccuccuuuuuucccugggucuggaggaacagaggucagucccacuucuuagcuccaucuugaggccuggccagucugcaguuacuccacuggacuggcaucugcccuggcucugcaggcuacaccaggccucuguucucuccucagaguaccugccccaaggcugcccaaggaaguaagaacccuuguuguccugguucaagguuuacaccacguuggagggaggacaccgcgacagauaauacaagacaauuauauucauuguauuaauacagcaauugagagcugucagguucaagaccacaggcuuagagagggagcauggggcccuaagaaggucuggaggcugaaccuagagauuuugaacaagguggagcugcagccauuaggagauagauuuggacaucacagggcaggacaagcgaggcucacacuaccugcuccacuacccaguguugaguuaccgauucaaccacuucccugcuaggaacuggugcugcucagccuauuuccuguuucuauuuccucuagcccuuaggaucccccuucuuccuaaagauccuugccucucaccccaagauuuuaguuuccacaaggaaauggcuaguacauggcuguagucauuagccuacaccucuuuuuguuagcuuuuuccagagaagcuccaagucaucucuguguguucagucccccccccgccccccgcaggagaugaacaguguuccucaacacccccauaccuucuccaguccugagguaugucugaauaauacagauggagguaguggucacacggccccgaggaguaugaaagccucagucagagccugguccgaaauccacccaacgguuauguugggcugugguguccacaagugcagcucuuccuaccugauccccagagcugccaugcagaaggcagaggugacugucuccauugucaagcccugggaccagcuggaggugggucagggaggaggaggaggaggaugcagcucagcaagggucugaagggaugcucaguguaugugaggaagcccaagagcgguugaagcuugaggauagccuuuccugcugggcccaaacgcacaauaucucugcuuuggacccaacucuuccuccaggggugagugcuacagcugcuauagugaugccauuuguacccacagucuacccucugucccauaccacugaagcacacucuuagaauaaagaagggacguagggcugggaauggugguucaucuauguaauccuaguauuucugagguggaggcaggaggaccaggaguucaaagacuguaggccagccuggauuacaugagguggguuuuuuuuggucuuguuuuguuuuguuuuuuuuguuuguuuuuuguuuuuuguuuuuuugacucaauuuacuagggcuagcaagaugcuucggugagaaaagcacuugcuacguaagcuugagggcuagcugggcagugguggcgcacaccuuuaaucccagcacuugggaggcagaggcagguggauuucugaguucgagaccagccuggucuacagagugaguuccagguuccagggcagucaggacuacacagagaaacccugucucaaaaaaccaaaaaaaaaaaaaaaaaaaaguugagggccugagggagacuugugggaggccagacuucauagccucuguaaucccagggcuuuuauagugaggugggagauggagacuagagaaucagugggggcuugaggaccagcugucuugacauaugcugugugaucaacaaagaguucuuguuucaaacaagguaaaaggcugagauuguccuguggucugcacauauacacugugguauguguccacagccacccgugagaaagcacacuauuuaacggaaaacagagacggcaggcuggagagcauugcgguacacuucucguuaccucuugcaagccucuuuguaaacgaagcccauuuguaaaugaaauagaccggggaagauaacaauuacucuaccaaggucacucacaucgcucacaaaacuguggggcugaguguggcucccaagccugcacuucucagcccuguuuucuccacuucugagcuggagcuugucuuaaccagucccaucagauaugggaagacgucagggucacgguuacuuaguaucaaagagggacuacaaauccaggccuccuuaagcugccagaaccuaugucuaguugggcuucucccuucuauggggcgggccagggcuccgcucccucccucucucagucccagcgggccccucccaacccugcgccucuccucuuucccgccgguaauuacuuccaucugccccgccugccugcuccccuuuuccuuggaaaugcagccggcucccacaaggcugaaaagacuuucuugggcaaccguugagacacguggggaaggggaggggcucuauugcugucugaaccugggcacccacccagugucuggguuuagacaggguuaccucuccugucugaugcuccgugaugccugggcugggcugacucagugccagagggguucaucaaagaucccaucuuguccuuuugaggucaucgcgccggcccaggagggggcaugcugggcugggcaugcacugauguugaggauuuguggaaugauuggugacauagacuggaaggguccuggagcucugggaaugggaaaauucagcuauaguuacuuugaucccaagcgauugucacagaaccagaggguggagaugcacauuuucauggaaguggucuguucaucuccuugucgaagacugcaccagcuggguagggaaaggcagcagcuagggcuucuucagauggcuaccugcaaguuuuagaagcaggcugugcgauggccauugaaagucauugagacacauccgugaccuugacagaaacggggacagugccggggaaagacaaaggacuggcaggcauguucguaguguggcauggaucugaacacuuguaaggugucuuccuccuggaagguuuaggacuucaagcucuagggucuugucugccuugcucacuguguagcccuagcugucuuagagcucacuauauagaucaggcuggccuagaacucagaucugcuugccucugccucccaaguggugggacuaaauguacccucugcugcccuuggcucucacugauauuuucuuauggccugaaaugaugacuagcaaauaauuacuugauaaacauuucuuugaggaguuaauagaaaaauguacuuuaggcuuucuagcuuuguuuuuacacugcccacccccaucuugugaagguccuuggauaauggggaagguccuguauucagauacagggagacaggagucccccaaggagaacaugccacucuaaguccagguaguuaccccuuuuuaguagcuuucagaucccugcaaagacuacucauaaccucacuuucugcuccugugucaacuuuuuguuauuugcccaaggaaggugacuuggggggugagcgcuccgcuggguggcaucugcagacucggggcuggaguuccagcuaaacccuucuaaaacugggacagaggguuucuuaguuggaaaaaaaaaaguuuguuugcuuucuaaaucucuauucaucuccaccaaguuucuccuguuccugguagcaugccacauggcuuugucaccucucagccuuugcuccccauagccuugccacaaggcuugguuaucuuugguaauuaccauucugaauugccuuuguccuucaggucacccugagccaguguucuaguaaggcuucccgagucccucugcuuucuccagucugcacacaucucacgcuuccaagcuugaguucagaagguaccucugaguacuggcagagccaaaggcuccucugagaugcugugaagccaagggauuugugucucuggggacaggcuguaagcccuuccuuccuacccucugcaguccuuguuagcaauauuuacaccuccaugaaauuaacacuccuuaaugagauagcacuucagauaauauucagugccuccaacauaguacuguacaagcgggcuggccuucuuuuaucccaggggagacgucuaccugccuuuggcccuggagaagaaggucauugagcugugcaggaccuggagccacuucuguguccucuguccagccaagugagcucaggcagaucuugcuuucgauuggcuuucaauuagaacaccugcuuguuuguugagguacagauaguaguaucugccacacucaagggauuacagugcaaagugagauaaacauuucuuucccuggaagagaccucagaggaagguauuagugucugcuugcuggaggguaaggacuccauaucccccgcccuagcaccugacugguaccucggaacugcuccauaauacuuccuuuuacaaaugauggagaagaggaaccaacaggucucuuuucuuguucaaggucaaaggcaggaagggaccgugcaggggccuagccucaagugugccucugauuuucucacuccugaacccccucccugccacacacacacacaccccuugcuuuucuucagcccauccacuuuacaugcucccaguuguugaggcuaaucucuucugaugcauggcgggccccuaagacuuggugagguaaaaugaagugucuggaagugcccaguguguugcacuagucugaacuggcuguguuaguuugagagggcaagggcugaaggccuuggggaagaagguguguugacggaauguggggacuagccuucuaaacauuuuggucucuucucucuagauuaauugcuacuucuucugggcccccuuuugcccacuucucuuuuaucucuuucagcucuccagagcucccaguccuacaagucuggucccagaggcauagaaagagagggagagggaaagggggagaaagagcaagagaaagcgagagaguacuaguuagagcagagagguuucugccuagcccccuuccagggagcauaccuuuuguucuugggaaugguaaugguaaugguguguguguguguguguguguguguguguguguguguguguguguguagaaccugggaugcacuuguguggaucuguacuccuugccuagagccuggcacuauguuggcugcuccuggccuaguguuggcuucuuuguugucuuugggaccuuggcuuugcacuggggcuuugugcucucuuagagaccagcugguuccuugcugugguccaacgcaguggugacugauccccggccacccauucagcugcccagggcccuggggccaguguuuguccccugucuucccaaauggaggcguguaggggcuuccugcccagagcuucaacccugccaaggcggagggaauggggaacagcugccuuggcugauucuggcuccguauggauuugguuugacaacaaagcucccucuguguguucucaggccccuuauguaacuagggugggggcaggggagguacaggaggaaauguaguuggagacaccaggaaggggcuugggagagaggggagcuggugagaccacuaaggagaagagugagugaggcggaagaguggagguuuugacucugccucugcccauuuccugccuccagagguggguagggcaugaguuucaggccuagcacccugucuuuccauguugucuuccuccucuugagcccuucccaccagcuaagaaagggcuguaggaccaaccuguuugggagugaggccagguaggguccuagaaguuggucugugaccccacccuuuaacugaacagaugccauagaacuggguagugguggcucaugccuuuaauaccagcacucaggaggcagaggcaggggaaucucaguaaguaugaggucaucuugaccuacagaccucaaguucaaggacagccagagcaacacacagaaaccaugucuugaaaaacaaacaagaaagaauaaaauaaaauaaagugguucauuuucuucccuugcauugagcuucuguucccuuguccuagaccagcccuuguccuuguccagaaccuuggacuccuuccuucugcagugauuaggaggcagcuuuccccugcacccugccaggacaagagguguccaagcuggccaccuuucuacuccucucagccugcagguuagcaccaucuguggcccuguccccugcagcacccaguucucuucucuacaucacugucuaagcagcuguccaaaucgagagggaagaaaauauccuuucaggagcagacuaacaggcucacaaggccugagagcugagcuggcuagagccagguguguccuggaguaggggguggggaccaaacgcugggacccggucacuuaaugaacacuaaagagaccuggagaagauguggugucucuggccucucuugucuuacagggagccugcaccuccaaggggauucuguucucugugccucaguuucuuaguuuuucuggugccuguuguuuauucucucucuuuuaaaaagauuuuacugcacuuggaaaaguguugcaagagccaugcauauugaauuuguaggaaaguaugguuccuaaaagggucgggaggaggacuacuagccaagguaccaguuauccugagucgggguucauggucuaauagauagggauuuggguauguaucuuuacccauggcuguguuggaguuuacauggaguuucuacccagagguacuccauaggacgauacucgagucugcugcuccacgggggaguaggugugugguauagcccagacaugcugaaagaacauggacucuuguccucaauccccaagcacugacuggcuagggucuuaggcuuucacugccuccuuccaggccugggugcugggaugauccugggaaugcugaagucucaggcucgagccuguaugagcacgguggguagggagaggcuaggaggcaaauggggaggaccuagcagaccuagggcuuucuagguuuggugcucagugagcugagaggucaguuccucauauagauuaggcacagauacagggcugaacaauccuggaggaugguauugugagugcaggcugugagugucaugccacuccauuggacuauaugcauagacuucugcccuguaucuuccuucuguuucuguuccuguggccucuuugguaaguuccuucacacugcuuuugaagaugacaguaaucuuuccucuuagaagcuggguuugcaaacacagaaguggaugcucacagucagcuaauggauggaucacagggcucccaauggaggagcuagagaaaguacccaaggagcuaaagggaacuacaacccuauagguggaacaacauuaugaacuaaccaguaccccggaguucuugacucuagcugcauauguaucaaaagauggccuagucggccaucacugaaaagagaggcccauuggacacgcaaacuuuauaugccccaguacaggggaacgccagggccaaaaagggggaguggguggguaggggauuggggguggguggguaugggggacuuuugguauagcauuggaaauguaaaugagcuaaauaccuaauaaaaaauggaaaaaaaaauuaaaaaaaaaaagaagcuggguuuggaaggccagaagccacaggaucagggauucccuuuauccaacuuucagagguccccagagagcagaugauguagccacucccugcuccucgaagcuccaggcucucuggcauauagcuccagggaccuucaaccaaacaaauaaacagcaggagccagagcugaaauugacgaaaccagagagcaaauacagcaaccaaggaauggaggaagagagugcacuggccuccggggcccagcagaccucagaaacuguacguggcuguggagugaguagggcaggggaaggaaugggagcuguguuugugagcacuuguguguauguaggaggccacugugcugcugugugcguucuuaguaacggccaguaugcacugagagguauguguaaguuagggcuguggaaggcuuaaguguagguguuacggagcaaagcgaguuugacuaagggaggggccacccacgucccuucguucugugauauaauguaacuguaggugcucggauaguaauuucuacccuccccucaagggguuacaugggcaagagauggccccggguaggcucugaaaaccugaacacaagccagccuguugacccagagggucuguggcucggggacuuuaaagccuggacuuuucugcagcacgcagaacaccugccucucccuucuccucccuuccucuucccuuccccuccccuugcuaucucugugugugugugugugugugugugugugugugugugugugugugugcacccaugcgucugacuagcuccucuaucuccuacugcuucagacugcccagacagugccucuuucuaaucucucccuagucuggagacaggcugauauaguaaggggaggccuggccuugccuuccucccucuucacaucugucacuccaggaagcccuuugcucccacaccaccacccacucuucuacagcccagccuuucauaccugcuuauaccuuuaaucaugggcucuucagaggaauacagaaagagucucccuaugaauaccuagagacuuccuugcuacugugggccauugguccacuagggaguacggaucugcagaaaugacagggauuuggggagaggagggcuucugauaucaaaagcuaccccccccccggaggggggggggacucccagauaacagcuggcagccagcagcagguguggagcccagggaggaccuuuggacuacacauuuccuuaccuugucccugcuuagagaaguagggaacauagauaauucccaguuuacaaagcuuugauuuaagguagaagaaaaaguuauaaugacauuugaagacuuacaaugauuuaaaaaaaacuuuucuaauauauaaaggcaauacacacugaguagaaacuguauuuaggguuuugaguuuugcccuuuaccaggccaguaaugcaggaugacugucuugugaugcuggcauggggcaggcacuggaacccuuuccagccacaaagucgcagagugaacguugaugcccuccccacaguagauuggguugucaagauagggugcuuagcauauagaucauggauauuaagugcauuuucgagcugcaguauuuucagcucaugaggcuuuuuuaaggauauaaaaaaguccauuguaggccucugucugagcaaaagagggccauucucuucagaaggaacacuacucuggaagaggcugccuagagggugguacugucuggagggcuggugccuguaccaccucggcuaagagggucugccuaaggucuagcuggcuggcugcaucagguggaaccagcccagagccugggcacugacugucaucacuugucagagauauugcucuuggaaagagacgaaagaguaggugaccuuccucccucgugugccuaugaauuguccagauuuggcuguguucucaggugugggugugaaugugguccugggguugugaucuugggcaggagacaacagacacucaccauccauacauacaaaugaaaaagcaggggcuccugaaauggauuaagcauuaugugaaguuccucggggcugcacaguugcuccaggcaucuuuuaaaaugucacucaguggugucacuccuuuaccaauaccccacugugacuuuuuaugacaucuaagcaaccccauguuccuuggguggccugugcagggucugagaucuccugguacccauggcauccuugauaccacauuuggcuaucucugaccaucuuuacaucugagaaauuugggucuucauauuuuucucaguccauaacccccugucuugguccuguguagaucucagguuaaaaccagauucuuugagagagggcccuaacuagacugcagaggaccccccaguuccucucugcaccacugcucugggucaguggcuuugcauaugaggcacuguuacuuaccuucauuauuucucuaugugucauaugucugucucuacuuaaguauaaacucuucuuauaugggccugcucuuggugguaccuaagacaguucuguggguguaggaggcugugguacaaauuggcuuuuuguuucugcucugugcccaaccuuuuuguuuguuuguugagacaggguucucucuauggcucuggcuguccugggacucacucuauaaaccaugcuggguuuuuuuuuuuuuuaaagauuuauuuauuuauuauauguaaguacacuguagcugucuucagacacuccagaagagggcaucagauuucguuacggaugguugugagccaccaugugguugcugggauuugaacucaggaccuuuggaagagcagucagcguucuuaaccacugagcuaucucgccagcccccaugcugguuuuuuuuuuuuuaaacucagauauccuccugccucugccuccaagugcugggauuaaaggugccacucauuaccucuggggcccuuguauuuuugaagccuaggggaauugcgcuaggacaggaguuguccuagaccugcuccuuugagaaguagguaagguagguauugcucauggcucuccugaugccuugugggacuacucuguaggugacuucacuucgggguucuagccagcaaccuuagaaucaguuaugagagcuggucaccaggugcaagaucaguuccucugaaaccacuguuuaaagugagagcaagaggaagugaugcacaggauuauaaacacauauagguuggcccuaccagcugucccagggaagcucuggcgaacuccuggccuguuguacucccagguccuugcagaagacauggcugucaugugugguguugcuaaccuaugcagagcugcugugugcauuagaaacacccucuccaucugcauauggcccugcaccuuaguauaccaagcagagagagggcuggauguuccauccuggauaguguguguguguguguguguguguguguguguguguguguguguguucgugcacgugccugccccauguguauuugugcuggccucuguccuuggagcaggacacaaagaagaguaagaagagcauguguaugaacgaggcagaagcugcacacauguccuuuagaccaagaucagcugcuuccaccucagcaacaaaccuaacagccacucuucucugccacuuugagucgccuucccagauggagcugcuguguuuucacccucagucacacagcagaaaaccuguguccuggaggcucaaaacggauggguaauucagaacucagguccggguauaugagacucuaacacuguagucuuaauuuagcaguuuaugucccucuucuucacacugagguuuuguuuuuuucaauuaaaaguauauuguacucaccaguuuuaaaagguuaaacauccacagcguauaugagagccagauguggugcacaccucuaacuacagcacuugagagaaagauggaaaugggaggauuaagaguucaagacuagccagguggugguggcacacaccuuuaaucccagcacuugggaggcagaggcaggcggauuucugaguucgaaaugaagugaguuccagaacagccaggcuacacagagaaaccuugucucgaaaaaccaaaaaaaaaaaaaaaagggaaaaaaaagaguucaaggcuauccucagagugagcuagaggcuaaccugugcuauaugagaccugccucaaauauacacaggcagauagauggacagacagaugaacacacacacucuacacaucuuacauacaaguuucaaguagauauagugacucauaccuguaguccuagcacuccagaggcuggagcagggggauugugaguuugaggacacccuagacgacacaauaagaucuugccuucacuuaaaaaaaaaucuaaaagacauaucccccccaaaugaaaaaugucucuuccauucuaaacucugcuccccuuucaagacaaccaccuucauuuauuucugcauccuucaaaucaauuauuuauaugcauauauauguauguauguauguauguaugcacguaaacuuucacuaagugaaucuggagaugcacaaaacacucuaccugguucuaggaauuuaauauuagacuuuagggaucacuugaugguagaacacguagauuuagauucucuuucagcugcauaauguuucucaagcucuuucauuauagcauuuagacacgucuguguggcuagauauuuacauuuuuuccacuuuuugcugauauacaaagagccaggagcacagugcugugacaaguaccuauaguuccagccacagaaagagugaagaaaaggggugguuaugcuuaggaauuugaugccagcaugggcaguauggugagaccugucuacaaaaacaaugauaaaauauacauagaggugcucuauuaaggaccuugauagacaggucucugugcaaacacaaggcuucucugcagaguaaauuccuggcaguggauuccggggaacaaggauguugauaaauguugcccaaucuuuacccacaaggcugacuugguuuucaguuccacuuacggggccccauuucccuuauuuucauccaucauguauacuguagaugucugugaagaucagugaaaaaaacggugcccuagccacacugggguuuggaguuuucaccccugugcuggggcuguaacucaggcccuggcaucugcuagacgaggauucuacccaggcugggauuuuuuuuuuuaaaggucagaaauggacucuuuuuauuuauuuauuuauuuauuuauuuauuuauuuauuuauuuauuuauuuauuuauuauauguaaguacacuguagcugucuucagacacuccagaagagagcaucagauuucguuacagaugguugugagccaccaugugguugcugggauuugaacucaggaccuuuggaagaguagucgguuuccuuaaccacugagccaucucaccagcccccaggcugggauuuuuacauguaggugagcaucuucucauauguggcguuuauauucuucacaguaagcuguauguucaugccauuguucuacuuugauuuuuuuucccccuugagguauggucucauuuagcucaggcuagccucaagaucacuauggagccaagaaucaguugccuuggacuucugaucugagaugacagacaugaaccaucacaccuggcuuauacagugcugaggguugaaccugggucuuguaugugccaggcaaacauucuucccaccaacccacgucuccagcccaucaacuuaaaaacauaagagacuagcguuaaccaaccaaaucacgaaguuaguaaacgugagcauuuccccauguucugucagacuuccuuuucccuuuaagagagaaaaggugaaggguugaguggugucuuccuuaccuagcauagaggaggacccaagauugauccacaaugcuacccaaaaggaaagaaauguaaaggugaugcaaaagugggagaccccgggggugcaagucuguccuuggcuacaagagcucccaucuaagauggaggaggaagaagaaagcggguggggagagguugccaggcaaacugcucauuagguguaaucucagcacagagaggggggaagaaagacugagagguaagaaggcaagggaaagaggcacagugcauguauaaaacuaaaggauugcgucuauagucaauucuauucuuauauguccagaauucaauugucacucaaacuuggguauacucuguuuacucuuauaucauacacacauaauucacacacacacacagacauacacacacacuacaaacaauauugcuuucugaucaauacuuuaucagcuuguaacacguaaaaguuacauuuauaguuuuagguuuaucugaaucgauccacauggaugaauuaaucaauuuaaguacugcucaauuaugugaacagagcacaguuuacuuagccagcgcccugucugguuccugcuucucugcucugcucuucuguugcucuuggauggggugucuguaugaaagggaggcuuacucugggguacacccaggaauggaauugccaggcuuugggguguguaugacuuccuuucucucucuuuuuuuuuaaauacauuuuucuguuuguguagccuaagauggccuugaacucuugccuucuaucucagcuaagugcuagaauuauaggcuaggauuauaagcauguaccgucaaacccgacucucugauuuauuaugggaaaauacauagucauaacauuucauaacauuauauuuuccaucuuaaucauuuaaaauuugaaagugugugugcguguguguguguguuuguguauguguucagguggaguccagaggacagccugcagugucaucuucaggaacacuaccucuuuuuuuuuuuuuuugagauaggaucugcugucauuggccuggagcucaccaauuaggcuugucuggguguguacuaccaugcucacaaaauaaauauauauauauuuuuagguuuauacaaauugacccagggaucuuuacauggauuuuggggaaucaacucagguccuuguguuucagggaaaguacuugauggauugagccaucucccuaacuccuuucauagccaaucauaagugcauaguucaagggcauuagguacguugauagcgugcagccgucuccaccaucacucugaagaacucuuuguuuuguaaaguagaaucggcgaacccccuggacaacccauuuugcugcucccaucuuauccucucaaccacuacucuacuuucuguuccuaugacuacugaaaacuuccuugcuauauaaguagagucagauagugugugucuuugugaccacauccuuccauucagcauauuguccucaguguucauccauuauguacagacggucagaauuuucuuguguggcugagcaguauuccaugaaacuuggguaccaaaugcuccugaucagguuauucuuucuuagacacuuggauugccucuaugucuuggauuuugugacugaccaaugcuguaguacauaaauuucuugggcgucacgguuucacuuccauugggcacauacccggaaguagaauuguuggaucuuauuguacccuuuguuuuucguuggcuuagugggcccccccuuccccaguuugugggauuguugauauuuguagaucacaugaauugugugugacucauuugaagccugacucuugagcccuguacaccacugugaggcaggcaguggcuuuggagcgucucuucuggacagacagcugcccagcaaagaagcuuugcucaguagccucaggugcugcuuggcaacagugaaacaacuuccucagacugccuccuuccugcccacccugccaugcuguaccucaccagugugccggagagucugggccagcaggugggugcuuggugcuggguggagucugggcaggggcucuccuccugucuuuccaggcaacugcguucuugugcugugggugcaggaguagaagcagccacugagaggacacgggugagcacagauuugggaauagguaggagcugaggcugagccccgccuuugcuguagugagacagaccuggagcaggagggggcuacuguugugugccacaccaaaugccugcucuguacugguccagcacugaggcuaugggcuuaaaacagcaugauaugucuuaacuuugaacaccucugcaaacuuaaucuuguuauugucauuuuguuguuuugggucuuuauguagguguuuuguuuuauuguuuuuuugugugacaaagucacacucuguagccuugcuguccuaaaacuugcuauauaagcuggccuuuaacucuuagagagcuuaaccugcuacugcccccaccccugaccccccaaauguggggauuaaaaguauacuaccucaccauuggcuugccacugcucccugagugcugaauuuaaaggugugcaucugaagcugguaccccuuuucuagaguaggaccccaguuggggcuguagaggcugaguuggacuucaggcuuuucggaguccauagcccuuuucucugcagccagagcuucaagcacuccucagcugguucccuguguuuaaugccaagcuaucuugaggaacauaggaggaggaaagagagacaggguuccaguggcccuuaucucuccugaagucuucugucuucagcuucuuguguguuccagcagccuggaccugguagugguugaguugaguaagaaaugucaacugccacgucuuuggaaacuauaugugauaaagcugauaaaggcguccuuuugaaaguagccacaggcuuuuggcagauaguagucacccuugcuggcccugaguucccgguguggugugagacucuagaaagccucagugccuuccuuggguguccaggucaguacagaagagggccuggaauuuucuaacuugaugaaauuuucuguugaugguuguuuugcuuauuugcuugagugaacaaauaauaauaauuuaggcauuugcucauuuuaaaauugugccaguuucuuaccacguaccugguauucaauuugguguuggggagacuggucuaguggacauuagcgauagcaugguauaacugccauaauggagcugaagcaaacugaugugacaaagaggaauguggaaugagaaggcuccugucaacuggguggcuaggagaaugcuguggccaagaaggguggggagucuagccuuuacacugauuuuaaauccugcagguaagacacuauuggucauguccuaacacagacccaaacaugaaaccguuggccuugacucaugccuuugccuauacccagccucuauucuucugugugcagauugcucggagagggauauacagccaaaguuguucucacuggggaaggaagguguguuuaauggggaggagguacagugaguuuaauuagauaugcauagugcaaggaacuugaucuccuguucaauccuccagucugugccuuuucaccuguuaauguuugggaaugcaccgccgugcuaggcauaguguuauagaccuguaauagcaguguagaggaaaaugaggcagaaggaccuaaaguucaugggcaucuuaaguugcagagcaacugcuuguaacuccaccuaggagcucugaugcucucuucuggguucugcagagcugcaugcaugcagugcauauauauucagguacacacauaaacacacagaaaauaaaauaaaaagugguauauacagcauuaaccucagcacuugagagucagagucaagaggaucucugugaguuggaggcuaaccuagucuacauaguaguaucuggacauccagaguuauguagagaaacccugucucaaagaagacgaagaugaagacgaagaagaaaaaugaaauuauuuuauuauuuuuguauguaugcauguuuacacaugcauaugugcaugcacaugucucaguguacuacauguggaggucagagaacaacuuaauggaaguggauucuguuugucucuacauaguuccugcgaaucaaauccaggucaucaagcuuggugacaauugcacuuaccucagccuuuguuuguuuuguuuugagacagggucuuauguagcccaggcuggucucggaucugcucuguauagaagauaaucuuaaauuccugaucauauugccucugccucccaaauacuggaucauguuuugggaaaaaagauuaaaaauaaauuggugaaauuaauuuuaauauuguaauauuaucaaaguauuauacauuuaauguaguuagguuucucaauaaguuugcuucuuaaaaauuauaaugucugugaagucagugagugcuucuacuuagaaccccugucaguguuaacuggccacauuaaauauuuaaauacuuuucuauuuguuuauuuuccauuuuuuuuguuuacugugugugcgugugcauguacauucaugggaggcagaggacagcuucuuucaagagucgauucuuuccuucuaguauaugggcccugggaucaaguucaagucauuagucuuggugacaagcacuuuaacccacugagccauauugugacccuacccaaguauuuuaggucauaugggcuuguugguauuguguggccagaucagggcuaguauaauccacuauuuucacauaaggcaucugagagcuagaggagagagggccugcuggugagccagcccagauuccaguaucuuuagccuccuggguaggcaguauuggaagagaaauaucuucaggaggcuuuggcuuggaagaaccugggacagguuacuauuggcaaccauuucuccuuuauuuauccuggcucugaccuggccuccugacuagccacuuggucacaugggcuucagcuuucuagcccugagaauuuauggaauuuggugucugccccucuaggcaaacaccagaaguauaauuuucaggcgguucccuguaaugucuugugacuaguaagacaucacaugaaugucuuaacauuguaucaaucauucagauacuguauuagauggaugauacaguguuucuacauggaagucuuccaggcuaggaugucugggugggcguggagcccaaaggagggcaccagagagacccuugugauuauguugggaagguuaugugccucuuuuucauuugugcuugaaugguuuguaggacaacccuaccuuccacagguggcugucucuuuccucugcagucucuaaaugagccuggaagaauagucucaccucagcccuccugugaucacacuacacaggaauggggacugacauccagcuaugacauuacuggggcuuguaccagaagugccaaggggacccaaccuauuaccacaaguuuuuccauuauuguacuacuguacauuauuaccauuguauuauaacaaugauuccugaugaacagauccauucguuaauccaacaaauuuguauugagaacuaacugugugccgggcacaguucuaauuauugaugguacagcagcaagaagaaaaaaacaacaacaaaaucaucacagguugggaagcauuggcuguguggggaauggcuccuggaaaguguagagaagguaaaugaagagcuagauacauagcuauccaagccugugucuagacaaaacccucgugccuagcauauagccagugcggaggucaaaggaaggugugugucuaguuucccucaccaaggcauggaggcaagacacaugagaaaacaggccaugaagaagagaggaguuggcuaugagggucccaggagaucugcuaagacaggucauguagaucuucauuggcauugggagguaagccaucaaauggggaucacuguaaugccgaaccaggcuguugacccucuacugagacgagaugggcccaggagguugcauuaaucauauuauauucaagucgugcuugacgucccugagauacuggcaguaacacuaagcuaagaaggguugcuguggguuagcuaacaucauggagacucaccuggacaugcagggaaauguguggaaacagguuuaguagaguccuaaacugaaguuuagaagagaggccacauguuugcagagcccuggagacuuggcauaccaaaaggauaucaccugucaguaugcuugcaagucugguguccauguguacggaaaacaugcuagagagcuuccagagggacaccagggcuuuggguacuagcaauuuugucucuugagaagaguggccuaagaagagguuaagacaguucuuuuuaauugcuggaagcacuuaaaggacuuuggugggccagaguucgacacaucucuaguuguuucaaagggcaucagaugaccaauacuugguguauuagucaguguucucuagagucacagaacuuaugggauaucucuauauauuaagggaauuuauuguacugacuuacagucuguagcccaaccaaccuaacaauggguggcuaggaauggaacguccaggagucuaguaauuguucagucccacgaggcuaguuguuucagaugggcuucuauauaagcugaaauccugaagcaguagguuccaacagaugugcuggcaaguaaaugcaagcaggugaagaagagugaaucucccuucuuccaguguccuuguguaggcuuccaguagcuguggcccaguuuaaagguauauaccaccacaucuggaucuggaacaugcuuuguaccaggcuggccuugaacuuagagaucugcuugccucaauguccuuaaauguguggacuaccuugccugggccuaagcuuuucauggccacuaugccucaagaucuccuugccaagauccaggucacaaacuugugacuuccagccucaagagcuggaucacagguaugcccuccguuucuggauuauaguucauuccagauguagucaaguugaccaccaggaauggucuuacacuuaggauccagugagccacucugccauggguuaguuugauuagagaacaucugcaguuucuacuagagauuaagaguggugauaguuucauccaaagucagccccucaguagcucuccuagucgaauguguuauuguguuacugagccuuuuuucuuagucuuugcccuucaccucucugucuauaaauggaagcaauuauagugguuugucuagaggcuuaucuagauuaauacaugaauagccccauagcaguaccuggaaaucugacauggggaaaggccugaauggagucuaguaguuacaguucaacuaugcuacuuagugucccauaguguccaagaugugggaaccgugaguuaacaggcuaauaaaauaauaauaguaguacagagguugaaagaaccaaauuucaguuauuaauaaaagacaaauguauuucaugucccgauggugacauauggcuauaaucaagcacucuggugacagagucaggaggauccagaguucuaggccagcucaggcuacguagugaguuuucagucagccaaagacaggcaaugggacuggcguuuuuauuuauaauguuuguuuaaucucauaaaauaguucuuuuagaguuuuauauagucaucuugacucccauccccagacucuucccagauaacccaacaccaaaguccaauucucacuauccauauauccugauauucuugggagugauauucuugggaguguagucuucugcugaaaugugguugacuucucacauacuuuagaaagauaagaaaaugaacucuacucucuugccccuugcucuuuuuuuuccuucuuucuccccauucccuaccuccaacccuccacaugguaauggcuggccucuacuuaucuacucuuucuucucucugcauuucucugauucuaguacccucguaacuccccuccccaugccugaaugaacucuauucuauacaaaaaagaaaaaagaaagaauaagaaagaaacagaagggaaaaaaggaaaggaaaggaaagaaaaggaaaggaaaggaaaggaaaggaaaggaaaggaaaggaaaggaaaggaaaggaaaggaaaggaaaggaaaaaauggucacauauaacuauaaucaagcacugugguggcauagccaggaggauccagaguucuaggccaaccucagcuauguagugaguuuugagucagccacagcaaagcaaugggacuggcauuuuuauuuuuaaauguuuguuuaauuucauaaaauaguucuuuuagaguucuauacauuagucuuccuuacuuuccccagacucuugccagauacuugccuccuucccuaccccaaaguccaauucaaaauauccauauauucuuauauucuuggguguguagucuucugauaaagugugguugacuucacagauacuucagaaagaugaggaaaugaacucuacucucuugcuucuugaucuuuuguucucucucucaccauucacuucuuccaacuuuccacauggucauggccguccucuacuuaucuacucuuucucucugccuuucucugacucuaggacccucuuaacuccccuccccaugcgcugaauaaacucuauucuauaccaaaaaaauuuuuuuucaaaaaaauaaaaaaaggaacgaaagacaggaaaaaauaaaaaagaaaagaaaagaaaaggugaaaaagaaaauggacuccuccuuucccaggagcugucaguugccaauagcuccuugacuaaaaaugggacuuagugccuaccucaccucuucaugcugggguugggucugccuugagcuugcacagaucuucuguaugcuaucacaucucugugugguuauuguguagcugaccugcugcaucccaaagacaucuugucaucuacuuuuuuugacucuauuacccuuucuauccacuguaguacaaaaaucccuaagacuuggaaggaagguaugugauauggauguccuguuuagggcuaagaauuaugcagucugucucugcagcuuuacugucugcugcaagguucucugaugaggccaacuuuaaaaagucuggacauguaaaucuagugauaaaauauuugucuuggauaaguaaggccuuggguguuaaccccagaaacacacagacacacacacacacacacacacacacacacacacacacacacacacacacacacaaacacagacacacacagacacaaauuucaguuauaaacaaaauauauuucaugugccuauggucacauauggcuuuaaucaagcacuccgguggcauagucaggaggaucgaauuccaggccaaccucggcuauguagugaguuuugagucagccacagcaaagcaaugggacuggcguuuuuauuuuuaaauguuaguuuaauuucauaaaauaguucuuuuagaguuuuauacaguaaucuuccuccuuuccccagacucuugccagauaccugccuccuuccuuacaccaaaguccaauucaaaauauccauauauccauauauuguuggguguguagucuucugcugaaguuugguugacuucccugauacuucagaaagauaagaaaaugaacucuacucucuugcuucuggaucuuuuguuccccucugucuccccauuccuuuccuccaacucuccacauguuaauggcuggccucuccuuaucuacucuuucucucugccuuucucugacucuaggacccucuuaacuccccuccccaugccugaaugaacucuauucuauacaaaaaagaaaaaagaaagaauaagaaagaaacagaagggaaaaaaggaaaggaaaggaaaggaaaggaaaggaaaggaaaggaaaggaaaggaaaggaaaggaaaggaaaggaaaggaaaggaaaggaaaggaaaaaagaaaauggacucuuccuuugccuggagcuaucaguugccaauagcuccuugacugaaaaugggacuuaaugccuaccucaccucuucaugcugggguugggucugccuugagcuugcaaagaucuucuguaugcuaucacaucucugugugguuauuguauagcugaccuucugcaucccaaagacaucuugucaucuacuuucuuuacucccguaaccuuucuauucacucuaguacaacaauccguaagacuuggaaggaagguaugugauauggauauccuguuuagggcugagaauuaugcagucugucucugcagcuuuacugucugcugcaagguucucugaugaggccagcuuuaaaaggucuugacauguaaauucagugauaaaauauugucugggauaugcaagucccucgguuugaaccccagaaacauacacacacacacacacacacacacaaacacauacagagacacaaauuucaauuauuaauaaaagacaauauaucuuucaaauggguauggucacauauggcuauuaucaaauacucugguggcauagccaggaggauccagaguucuaggccaacguaggcuauguagugagguuugagucagccacagcaaagcaaugggacugacauuuuuauuuuuaaauguuaguuuaauuucauaaaauaguucuuuuagaguuuuauacaguagucuucccuccuuuucccaaacucuugccaauacuugacuccuucccuacaccaaaguccaauucauacuauccaucuaucccuauauucuuggguguguaaucauccucccucccucccccgacucuucccagauaaucugccuccuucccuagaacaaagucuacuucauacuauuuauauauccuauauucuuggguguguacucuucugaugaagugucguucaauucccggaaacuucagaaaaguaagauaaugaaaucuagucuuuugcuucuugcuguuuuauuuugucucucuccccauuuucuuccuccaacuuuccacaugaucauggcuggccucuacuuaucuauucuuucuuucugccuuccucugacucuaggacccucuuaccuccccuccccaugcccugaauaaacucuaaucuauaaaaaaaauaagaaaauaaaaaaaguaaaggaaagaaaggaaaggaaaagaaaagaaaagaaaaaaaaauuuaaaaaaagaaaauggacuccuccuuuccccggagcugucaguugccaauagcuccuugacuaaaaaugggacuuaaugccuaccucaccucuucaugcugggguugggucugccuugagcuugcacagaucuucuguaugcuaucacaucucugugugguuauuguguagcugaccugcugcaucccaaagacaucuugucaucuacuuuuuuugacucuauuacccuuucuauccacuguaguacaaaaucccuaagacuuggaaggaagguaugugauauggauguccuguuuagggcuaagaauuaugcagucugucucugcagcuuuacugucugcugcaagguuuucugaugaggccagcuuuaaaaggucuugacauguaaauucagugauaaaauauugucugggauaugcaagucccucgguuugaaccccagaaacauacacacacacacacacacacacacacacacacacacacacacacaaacacauacagagacacaaauuucaauuauuaauaaaagacaauauaucuuucaaauggguauggucacauauggcuauuaucaaauacucugguggcauagccaggaggauccagaguucuaggccaaccuaggcuauguagugaguuuugagucagccacagcaaagcaaugggacugacauuuuuauuuuuaaauguuaguuuaauuucauaaaauaguucuuuuagaguuuuauacaguagucuucccuccuuuucccaaacucuugccaauacuugacuccuucccuacaccaaaguccaauucauaucuuccaucuaucccuauauucuuggguguguaaucauccucccucccucccccgacucuucccagauaaucugccuccuucccuagaacaaagucuacuucauacuauuuauauauccuauauucuuggguguguacucuucugaugaagugucguucaauucccaguaacuucagaaagguaagauaaugaaaucuagucuuuugcuucuugcuguuuuguuuugucucucuccccauuuucuuccuccaacuuuccaccugaucauggcuggccucuacuuaucuacucuuucuuucugccuuccucugacucuaggacccucuuaccuccccuccccaugcccugaauaaacucuaaucuauuaaaaaaaaaaagaaaauaaaaaaaguaaaggaaagaaaagaaaggaaaagaaaagaaaagaaauuaaaaaaaaguaaauggacuccuccuuucccaggagcugucaguugccaauagcuccuugacuaaaaaugggacuuaaugccuaccucaccucuucaugcugggguugggucugccuugagcuugcacagaucuucuguaugcuaucacaucucugugugguuauuguguagcugaccugcugcaucccaaagacaucuugucaucuacuuuuuuugacucuauuacccuuucuauccacuguaguacaaaaucccuaagacuuggaaggaagguaugugauauggauguccuguuuagggcuaagaauuaugcagucugucucugcagcuuuacugucugcugcaagguuuucugaugaggccagcuuuaaaaggucuugacauguaaauucagugauaaaauauugucugggauaugcaagucucucgguuugaaccccagaaacauacacacacacacacacacacacacacaacacacacacacacacacacaaacacauacagagacacaaauuucaauuauuaauaaaagacaauauaucuuucaauauggcuauuaucaaauacucugguggcauagccaggaggauccagaguucuaggccaaccuaggcuauguagugaguuuugagucagccacagcaaagcaaugggacugacauuuuuauuuuuaaauguuaguuuaauuucauaaaauaguucuuuuagaguuuuauacaguagucuucccuccuuuucccaaacucuugccaauacuugacuccuucccuacaccaaaguccaauucauacuauccaucuaucccuauauucuuggguguguaaucauccucccucccucccccgacucuucccagauaaucugccuccuucccuagaacaaagucuacuucauacuauuuauauauccuauauucuuggguguguacucuucugaugaagugucguucaauucccaguaacuucagaaagguaagauaaugaaaucuagucuuuugcuucuugcuguuuuguuuugccucucuccccauuuucuuccuccaacuuuccaccugaucauggcuggccucuacuuaucuacucuuucuuucugccuuccucugacucuaggacccucuuaacuccccuccccaugcccugaauaaacucuaaucuauaaaaaaaaauaagaaaauaaaaaaaguaaaggaaagaaaagaaaagaaaagaaauuuaaaaaaagaaaauggacuccuccuuucccaggagcugucaguugccaauagcuccuugacuaaaaaugacuaaaauagcuccuugacuuaaugccuaccucaccucuucaugcugggguugggucugccuugagcuugcacagaucuucuguaugcuaucacaucucugugugguuauuguauagcugacaugcugcuucccaaagacaucuugucaucuacuuucuuugacuccaauacccuuucuauccacuguaguacaaaaaucccuaagacuuggaaggaagguaugugauauggauguccuguuuagggcuaagaauuaugcagucugucucugcagcuuuacugucugcugcaagguucucugaugaggccagcuuuaaaaggucucgacauguaaauucaacgacaaaauacuugucugggauauguaaggcccuggguuugaaccccagaaacacacacacacacacacagagaaauuucaguuauuaauaaaauacaaaauauauuucaugugccuauggucacauauggcuuuaaucaagcacuccgguggcauagucaggaggaucgaguuccaggccaaccucggcuauguagugaguuuugagucagccacagcaaagcaaugggacuggcguuuuuauuuuuaaauguuaguuuaauuucauaaaauaguucuuuuagaguuuuauacaguaaucuucccuccuuuccccagacucuugccagauaccugccuccuuccuuacaccaaaguccaauucaaaauauccauauauccauauauuguuggguguguagucuucugcugaaguuugguugacuucccugauacuucagaaagauaagaaaaugaacucuacucucuugcuucuugaucuuuuguuccccucugucuccccauuccuuuccuccaacucuccacauguuaauggcuggccucuacuuaucuacucuuucucucugccuuucucugacuauaggacccucuuaacuccccuccccaugccugaaugaacucuauucuauacaaaaaagaaaaaagaaagaguaagaaagaaaaagaaggaaggaaggaaaggaaaggagaggagaggagaggagaggagaggagaggagaggagaggagaggagaggagaggagaggagaggaaaggaaaggaaaggaaaggaaaggaaaggaaaggaaaggaaaggaaaggaaaggaaaggaaaggaaaggaaaggaaagguaaggaaaggaaaggaaagaaggaaaggaaaaaagaaaauggacucuuccuuugccuggagcugucaguugccaauagcuccuugacuaaaaaugggacuuaaugccuaccucaccucuucaugcugggguugggucugccuugagcuugcacagaucuucuguaugcuaucacaucucugugugguuauuguguagcugaccugcugcaucccaaagacaucuugucaucuacuuuuuuugacucuauuacccuuucuauccacuguaguacaaaaucccuaagacuuggaaggaagguaugugauauggauguccuguuuagggcuaagaauuaugcagucugucucugcagcuuuacugucugcugcaagguuuucugaugaggccagcuuuaaaaggucuugacauguaaauucagugauaaaauauugucugggauaugcaagucucucgguuugaaccccagaaacauacacacacacacacacacacacacacaacacacacacacacacacacaaacacauacagagacacaaauuucaauuauuaauaaaagacaauauaucuuucaauauggcuauuaucaaauacucugguggcauagccaggaggauccagaguucuaggccaaccuaggcuauguagugaguuuugagucagccacagcaaagcaaugggacugacauuuuuauuuuuaaauguuaguuuaauuucauaaaauaguucuuuuagaguuuuauacaguagucuucccuccuuuucccaaacucuugccaauacuugacuccuucccuacaccaaaguccaauucauacuauccaucuaucccuauauucuuggguguguaaucauccucccucccucccccgacucuucccagauaaucugccuccuucccuagaacaaagucuacuucauacuauuuauauauccuauauucuuggguguguacucuucugaugaagugucguucaauucccggaaacuucagaaaaguaagauaaugaaaucuagucuuuugcuucuugcuguuuuauuuugucucucuccccauuuucuuccuccaacuuuccacaugaucauggcuggccucuacuuaucuauucuuucuuucugccuuccucugacucuaggacccucuuaccuccccuccccaugcccugaauaaacucuaaucuauaaaaaaaauaagaaaauaaaaaaaguaaaggaaagaaaggaaaggaaaagaaaagaaaagaaaaaaaaauuuaaaaaaagaaaauggacuccuccuuucccaggagcugucaguugccaauagcuccuugacuaaaaaugggacuuaaugccuaccucaccucuucaugcugggguugggucugccuugagcuugcacagaucuucuguaugcuaucacaucucugugugguuauuguguagcugaccugcugcaucccaaagacaucuugucaucuacuuuuuuugacucuauuacccuuucuauccacuguaguacaaaaucccuaagacuuggaaggaagguaugugauauggauguccuguuuagggcuaagaauuaugcagucugucucugcagcuuuacugucugcugcaagguuuucugaugaggccagcuuuaaaaggucuugacauguaaauucagugauaaaauauugucugggauaugcaagucccucgguuugaaccccagaaacauacacacacacacacacacacacacacacacacacacacacacacaaacacauacagagacacaaauuucaauuauuaauaaaagacaauauaucuuucaaauggguauggucacauauggcuauuaucaaauacucugguggcauagccaggaggauccagaguucuaggccaaccuaggcuauguagugaguuuugagucagccacagcaaagcaaugggacugacauuuuuauuuuuaaauguuaguuuaauuucauaaaauaguucuuuuagaguuuuauacaguagucuucccuccuuuucccaaacucuugccaauacuugacuccuucccuacaccaaaguccaauucauaucuuccaucuaucccuauauucuuggguguguaaucauccucccucccucccccgacucuucccagauaaucugccuccuucccuagaacaaagucuacuucauacuauuuauauauccuauauucuuggguguguacucuucugaugaagugucguucaauucccaguaacuucagaaagguaagauaaugaaaucuagucuuuugcuucuugcuguuuuguuuugucucucuccccauuuucuuccuccaacuuuccaccugaucauggcuggccucuacuuaucuacucuuucuuucugccuuccucugacucuaggacccucuuaccuccccuccccaugcccugaauaaacucuaaucuauuaaaaaaaaaagaaaauaaaaaaaguaaaggaaagaaaagaaaggaaaagaaaagaaaagaaauuaaaaaaaaguaaauggacuccuccuuucccaggagcugucaguugccaauagcuccuugacuaaaaaugggacuuaaugccuaccucaccucuucaugcugggguugggucugccuugagcuugcacagaucuucuguaugcuaucacaucucugugugguuauuguauagcugacaugcugcuucccaaagacaucuugucaucuacuuucuuugacuccaauacccuuucuauccacuguaguacaaaaaucccuaagacuuggaaggaagguaugugauauggauguccuguuuagggcuaagaauuaugcagucugucucugcagcuuuacugucugcugcaagguucucugaugaggccagcuuuaaaaggucucgacauguaaauucaacgacaaaauacuugucugggauauguaaggcccuggguuugaaccccagaaacacacacacacacacacagagaaauuucaguuauuaauaaaauacaaaauauauuucaugugccuauggucacauauggcuuuaaucaagcacuccgguggcauagucaggaggaucgaguuccaggccaaccucggcuauguagugaguuuugagucagccacagcaaagcaaugggacuggcguuuuuauuuuuaaauguuaguuuaauuucauaaaauaguucuuuuagaguuuuauacaguaaucuucccuccuuuccccagacucuugccagauaccugccuccuuccuuacaccaaaguccaauucaaaauauccauauauccauauauuguuggguguguagucuucugcugaaguuugguugacuucccugauacuucagaaagauaagaaaaugaacucuacucucuugcuucuugaucuuuuguuccccucugucuccccauuccuuuccuccaacucuccacauguuaauggcuggccucuacuuaucuacucuuucucucugccuuucucugacuauaggacccucuuaacuccccuccccaugccugaaugaacucuauucuauacaaaaaagaaaaaagaaagaguaagaaagaaaaagaaggaaggaaggaaaggaaaggagaggagaggagaggagaggagaggagaggagaggagaggagaggaaaggaaaggaaaggaaaggaaaggaaaggaaaggaaaggaaaggaaaggaaaggaaaggaaacgaaaggaaaggaaaggaaaggaaaggaaaggaaaggaaaggaaaggaaaggaaagguaaggaaaggaaaggaaaggaaaggaaaggaaagguaaggaaaggaaaggaaagaaggaaaggaaaaaagaaaauggacucuuccuuugccuggagcugucaguugccaauagcuccuugacuaaaaaugggacuuaaugccuaccucaccucuucaugcugggguugggucugccuugagcuugcacagaucuucuguaugcuaucacaucucugugugguuauuguguagcugaccugcugcaucccaaagacaucuugucaucuacuuuuuuugacucuauuacccuuucuauccacuguaguacaaaaucccuaagacuuggaaggaagguaugugauauggauguccuguuuagggcuaagaauuaugcagucugucucugcagcuuuacugucugcugcaagguuuucugaugaggccagcuuuaaaaggucuugacauguaaauucagugauaaaauauugucugggauaugcaagucccucgguuugaaccccagaaacauacacacacacacacacacacacacacacacacacacacaaacacauacagagacacaaauuucaauuauuaauaaaagacaauauaucuuucaaauggguauggucacauauggcuauuaucaaauacuuugguggcauagccaggaggauccagaguucuaggccaaccuaggcuauguagugaguuuugagucagccacagcaaagcaaugggacugacauuuuuauuuuuaaauguuaguuuaauuucauaaaauaguucuuuuagaguuuuauacaguagucuucccuccuuuucccaaacucuugccaauacuugacuccuucccuacaccaaaguccaauucauaucuuccaucuaucccuauauucuuggguguguaaucauccucccucccucccccgacucuucccagauaaucugccuccuucccuagaacaaagucuacuucauacuauuuauauauccuauauucuuggguguguacucuucugaugaagugucguucaauucccaguaacuucagaaagguaagauaaugaaaucuagucuuuugcuucuugcuguuuuguuuugucucucuccccauuuucuuccuccaacuuuccaccugaucauggcuggccucuacuuaucuacucuuucuuucugccuuccucugacucuaggacccucuuaccucccuccccaugcccugaauaaacucuaaucuauuaaaaaaaaaaagaaaauaaaaaaaguaaaggaaagaaaagaaaggaaaagaaaagaaaagaaauuaaaaaaaaguaaauggacuccuccuuucccaggagcugucaguugccaauagcuccuugacuaaaaaugggacuuaaugccuaccucaccucuucaugcugggguugggucugccuugagcuugcacagaucuucuguaugcuaucacaucucugugugguuauuguguagcugaccugcugcaucccaaagacaucuugucaucuacuuuuuuugacucuauuacccuuucuauccacuguaguacaaaaucccuaagacuuggaaggaagguaugugauauggauguccuguuuagggcuaagaauuaugcagucugucucugcagcuuuacugucugcugcaagguuuucugaugaggccagcuuuaaaaggucuugacauguaaauucagugauaaaauauugucugggauaugcaagucccucgguuugaaccccagaaacauacacacacacacacacacacacacacacacacacacacacacacaaacacauacagagacacaaauuucaauuauuaauaaaagacaauauaucuuucaaauggguauggucacauauggcuauuaucaaauacucugguggcauagccaggaggauccagaguucuaggccaaccuaggcuauguagugaguuuugagucagccacagcaaagcaaugggacugacauuuuuauuuuuaaauguuaguuuaauuucauaaaauaguucuuuuagaguuuuauacaguagucuucccuccuuuucccaaacucuugccaauacuugacuccuucccuacaccaaaguccaauucauacuauccaucuaucccuauauucuuggguguguaaucauccucccucccucccccgacucuucccagauaaucugccuccuucccuagaacaaagucuacuucauacuauuuauauauccuauauucuuggguguguacucuucugaugaagugucguucaauucccaguaacuucagaaagguaagauaaugaaaucuagucuuuugcuucuugcuguuuuguuuugccucucuccccauuuucuuccuccaacuuuccaccugaucauggcuggccucuacuuaucuacucuuucuuucugccuuccucugacucuaggacccucuuaacuccccuccccaugcccugaauaaacucuaaucuauaaaaaaaauaagaaaauaaaaaaaguaaaggaaagaaaagaaaagaaaagaaauuuaaaaaaagaaaauggacuccuccuuucccaggagcugucaguugccaauagcuccuugacuaaaaaugacuaaaauagcuccuugacuuaaugccuaccucaccucuucaugcugggguugggucugccuugagcuugcacagaucuucuguaugcuaucacaucucugugugguuauuguauagcugacaugcugcuucccaaagacaucuugucaucuacuuucuuugacuccaauacccuuucuauccacuguaguacaaaaaucccuaagacuuggaaggaagguaugugauauggauguccuguuuagggcuaagaauuaugcagucugucucugcagcuuuacugucugcugcaagguucucugaugaggccagcuuuaaaaggucucgacauguaaauucaacgacaaaauacuugucugggauauguaaggcccuggguuugaaccccagaaacacacacacacacacacagagaaauuucaguuauuaauaaaauacaaaauauauuucaugugccuauggucacauauggcuuuaaucaagcacuccgguggcauagucaggaggaucgaguuccaggccaaccucggcuauguagugaguuuugagucagccacagcaaagcaaugggacuggcguuuuuauuuuuaaauguuaguuuaauuucauaaaauaguucuuuuagaguuuuauacaguaaucuucccuccuuuccccagacucuugccagauaccugccuccuuccuuacaccaaaguccaauucauacuauccaucuaucccuauauucuuggguguguaaucauccucccucccucccccgacucuucccagauaaucugccuccuucccuagaacaaagucuacuucauacuauuuauauauccuauauucuggguguguacucuucugaugaagugucguucaauucccggaaacuucagaaaaguaagauaaugaaaucuagucuuuugcuucuugcuguuuuauuuugucucucuccccauuuucuuccuccaacuuuccacaugaucauggcuggccucuacuuaucuauucuuucuuucugccuuccucugacucuaggacccucuuaccuccccuccccaugcccugaauaaacucuaaucuauaaaaaaaauaagaaaaugaaaaaaguaaaggaaagaaaggaaaggaaaagaaaagaaaagaaaaaaaaauuuaaaaaaagaaaauggacuccuccuuuccccggagcugucaguugccaauagcuccuugacuaaaaaugggacuuaaugccuaccucaccucuucaugcugggguugggucugccuugagcuugcacagaucuucuguaugcuaucacaucucugugugguuauuguguagcugaccugcugcaucccaaagacaucuugucaucuacuuuuuuugacucuauuacccuuucuauccacuguaguacaaaaucccuaagacuuggaaggaagguaugugauauggauguccuguuuagggcuaagaauuaugcagucugucucugcagcuuuacugucugcugcaagguuuucugaugaggccagcuuuaaaaggucuugacauguaaauucagugauaaaauauugucugggauaugcaagucucucgguuugaaccccagaaacauacacacacacacacacacacacacacacaacacacacacacacacacacacacaaacacauacagagacacaaauuucaauuauuaauaaaagacaauauaucuuucaauauggcuauuaucaaauacucugguggcauagccaggaggauccagaguucuaggccaaccuaggcuauguagugaguuuugagucagccacagcaaagcaaugggacugacauuuuuauuuuuaaauguuaguuuaauuucauaaaauaguucuuuuagaguuuuauacaguagucuucccuccuuuucccaaacucuugccaauacuugacuccuucccuacaccaaaguccaauucauacuauccaucuaucccuauauucuuggguguguaaucauccucccucccucccccgacucuucccagauaaucugccuccuucccuagaacaaagucuacuucauacuauuuauauauccuauauucuuggguguguacucuucugaugaagugucguucaauucccggaaacuucagaaaaguaagauaaugaaaucuagucuuuugcuucuugcuguuuuauuuugucucucuccccauuuucuuccuccaacuuuccacaugaucauggcuggccucuacuuaucuauucuuucuuucugccuuccucugacucuaggacccucuuaccuccccuccccaugcccugaauaaacucuaaucuauaaaaaaaauaagaaaauaaaaaaaguaaaggaaagaaaggaaaggaaaagaaaagaaaagaaaaaaaaauuuaaaaaaagaaaauggacuccuccuuucccaggagcugucaguugccaauagcuccuugacuaaaaaugggacuuaaugccuaccucaccucuucaugcugggguugggucugccuugagcuugcacagaucuucuguaugcuaucacaucucugugugguuauuguguagcugaccugcugcaucccaaagacaucuugucaucuacuuuuuuugacucuauuacccuuucuauccacuguaguacaaaaucccuaagacuuggaaggaagguaugugauauggauguccuguuuagggcuaagaauuaugcagucugucucugcagcuuuacugucugcugcaagguuuucugaugaggccagcuuuaaaaggucuugacauguaaauucagugauaaaauauugucugggauaugcaagucccucgguuugaaccccagaaacauacacacacacacacacacacacacacacacacacacacacaaacacauacagagacacaaauuucaauuauuaauaaaagacaauauaucuuucaaauggguauggucacauauggcuauuaucaaauacucugguggcauagccaggaggauccagaguucuaggccaaccuaggcuauguagugaguuuugagucagccacagcaaagcaaugggacugacauuuuuauuuuuaaauguuaguuuaauuucauaaaauaguucuuuuagaguuuuauacaguagucuucccuccuuuucccaaacucuugccaauacuugacuccuucccuacaccaaaguccaauucauaucuuccaucuaucccuauauucuuggguguguaaucauccucccucccucccccgacucuucccagauaaucugccuccuucccuagaacaaagucuacuucauacuauuuauauauccuauauucuuggguguguacucuucugaugaagugucguucaauucccaguaacuucagaaagguaagauaaugaaaucuagucuuuugcuucuugcuguuuuguuuugucucucuccccauuuucuuccuccaacuuuccaccugaucauggcuggccucuacuuaucuacucuuucuuucugccuuccucugacucuaggacccucuuaccuccccuccccaugcccugaauaaacucuaaucuauuaaaaaaaaaaagaaaauaaaaaaaguaaaggaaagaaaagaaaggaaaagaaaagaaaagaaauuaaaaaaaaguaaauggacuccuccuuucccaggagcugucaguugccaauagcuccuugacuaaaaaugggacuuaaugccuaccucaccucuucaugcugggguugggucugccuugagcuugcacagaucuucuguaugcuaucacaucucugugugguuauuguguagcugaccugcugcaucccaaagacaucuugucaucuacuuuuuuugacucuauuacccuuucuauccacuguaguacaaaaucccuaagacuuggaaggaagguaugugauauggauguccuguuuagggcuaagaauuaugcagucugucucugcagcuuuacugucugcugcaagguuuucugaugaggccagcuuuaaaaggucuugacauguaaauucagugauaaaauauugucugggauaugcaagucucucgguuugaaccccagaaacauacacacacacacacacacacacacacacaacacacacacacacacacacaaacacauacagagacacaaauuucaauuauuaauaaaagacaauauaucuuucaauauggcuauuaucaaauacucugguggcauagccaggaggauccagaguucuaggccaaccuaggcuauguagugaguuuugagucagccacagcaaagcaaugggacugacauuuuuauuuuuaaauguuaguuuaauuucauaaaauaguucuuuuagaguuuuauacaguagucuucccuccuuuucccaaacucuugccaauacuugacuccuucccuacaccaaaguccaauucauacuauccaucuaucccuauauucuuggguguguaaucauccucccucccucccccgacucuucccagauaaucugccuccuucccuagaacaaagucuacuucauacuauuuauauauccuauauucuuggguguguacucuucugaugaagugucguucaauucccaguaacuucagaaagguaagauaaugaaaucuagucuuuugcuucuugcuguuuuguuuugccucucuccccauuuucuuccuccaacuuuccaccugaucauggcuggccucuacuuaucuacucuuucuuucugccuuccucugacucuaggacccucuuaacuccccuccccaugcccugaauaaacucuaaucuauaaaaaaaaauaagaaaauaaaaaaaguaaaggaaagaaaagaaaagaaaagaaauuuaaaaaaagaaaauggacuccuccuuucccaggagcugucaguugccaauagcuccuugacuaaaaaugacuaaaauagcuccuugacuuaaugccuaccucaccucuucaugcugggguugggucugccuugagcuugcacagaucuucuguaugcuaucacaucucugugugguuauuguauagcugacaugcugcuucccaaagacaucuugucaucuacuuucuuugacuccaauacccuuucuauccacuguaguacaaaaaucccuaagacuuggaaggaagguaugugauauggauguccuguuuagggcuaagaauuaugcagucugucucugcagcuuuacugucugcugcaagguucucugaugaggccagcuuuaaaaggucucgacauguaaauucaacgacaaaauacuugucugggauauguaaggcccuggguuugaaccccagaaacacacacacacacacacagagaaauuucaguuauuaauaaaauacaaaauauauuucaugugccuauggucacauauggcuuuaaucaagcacuccgguggcauagucaggaggaucgaguuccaggccaaccucggcuauguagugaguuuugagucagccacagcaaagcaaugggacuggcguuuuuauuuuuaaauguuaguuuaauuucauaaaauaguucuuuuagaguuuuauacaguaaucuucccuccuuuccccagacucuugccagauaccugccuccuuccuuacaccaaaguccaauucaaaauauccauauauccauauauuguuggguguguagucuucugcugaaguuugguugacuucccugauacuucagaaagauaagaaaaugaacucuacucucuugcuucuugaucuuuuguuccccucugucuccccauuccuuuccuccaacucuccacauguuaauggcuggccucuacuuaucuacucuuucucucugccuuucucugacuauaggacccucuuaacuccccuccccaugccugaaugaacucuauucuauacaaaaaagaaaaaagaaagaguaagaaagaaaaagaaggaaggaaggaaaggaaaggagaggagaggagaggagaggagaggagaggagaggagaggagaggagaggagaggaaaggaaaggaaaggaaaggaaaggaaaggaaaggaaaggaaaggaaaggaaacgaaaggaaaggaaaggaaaggaaaggaaaggaaaggaaaggaaaggaaaggaaaggaaaggaaagguaaggaaaggaaaggaaagaaggaaaggaaaaaagaaaauggacucuuccuuugccuggagcugucaguugccaauagcuccuugacuaaaaaugggacuuaaugccuaccucaccucuucaugcugggguugggucugccuugagcuugcacagaucuucuguaugcuaucacaucucugugugguuauuguguagcugaccugcugcaucccaaagacaucuugucaucuacuuuuuuugacucuauuacccuuucuauccacuguaguacaaaaucccuaagacuuggaaggaagguaugugauauggauguccuguuuagggcuaagaauuaugcagucugucucugcagcuuuacugucugcugcaagguuuucugaugaggccagcuuuaaaaggucuugacauguaaauucagugauaaaauauugucugggauaugcaagucccucgguuugaaccccagaaacauacacacacacacacacacacacacacacacacacacacaaacacauacagagacacaaauuucaauuauuaauaaaagacaauauaucuuucaaauggguauggucacauauggcuauuaucaaauacucugguggcauagccaggaggauccagaguucuaggccaaccuaggcuauguagugaguuuugagucagccacagcaaagcaaugggacugacauuuuuauuuuuaaauguuaguuuaauuucauaaaauaguucuuuuagaguuuuauacaguagucuucccuccuuuucccaaacucuugccaauacuugacuccuucccuacaccaaaguccaauucauaucuuccaucuaucccuauauucuuggguguguaaucauccucccucccucccccgacucuucccagauaaucugccuccuucccuagaacaaagucuacuucauacuauuuauauauccuauauucuuggguguguacucuucugaugaagugucguucaauucccaguaacuucagaaagguaagauaaugaaaucuagucuuuugcuucuugcuguuuuguuuugucucucuccccauuuucuuccuccaacuuuccaccugaucauggcuggccucuacuuaucuacucuuucuuucugccuuccucugacucuaggacccucuuaccuccccuccccaugcccugaauaaacucuaaucuauuaaaaaaaaaaaagaaaauaaaaaaaguaaaggaaagaaaagaaaggaaaagaaaagaaaagaaauuaaaaaaaaguaaauggacuccuccuuucccaggagcugucaguugccaauagcuccuugacuaaaaaugggacuuaaugccuaccucaccucuucaugcugggguugggucugccuugagcuugcacagaucuucuguaugcuaucacaucucugugugguuauuguauagcugacaugcugcuucccaaagacaucuugucaucuacuuucuuugacuccaauacccuuucuauccacuguaguacaaaaaucccuaagacuuggaaggaagguaugugauauggauguccuguuuagggcuaagaauuaugcagucugucucugcagcuuuacugucugcugcaagguucucugaugaggccagcuuuaaaaggucucgacauguaaauucaacgacaaaauacuugucugggauauguaaggcccuggguuugaaccccagaaacacacacacacacacacagagaaauuucaguuauuaauaaaauacaaaauauauuucaugugccuauggucacauauggcuuuaaucaagcacuccgguggcauagucaggaggaucgaguuccaggccaaccucggcuauguagugaguuuugagucagccacagcaaagcaaugggacuggcguuuuuauuuuuaaauguuaguuuaauuucauaaaauaguucuuuuagaguuuuauacaguaaucuucccuccuuuccccagacucuugccagauaccugccuccuuccuuacaccaaaguccaauucaaaauauccauauauccauauauuguuggguguguagucuucugcugaaguuugguugacuucccugauacuucagaaagauaagaaaaugaacucuacucucuugcuucuugaucuuuuguuccccucugucuccccauuccuuuccuccaacucuccacauguuaauggcuggccucuacuuaucuacucuuucucucugccuuucucugacucuaggacccucuuaacuccccuccccaugccugaaugaacucuauucuauacaaaaaagaaaaaagaaagaguaagaaagaaaaagaaggaaagaaaggaaaggagaggagaggagaggagaggagaggagaggagaggagaggaaaggaaaggaaaggaaaggaaaggaaaggaaaggaaaggaaaggaaaggaaaggaaaggaaagaaggaaaggaaaaaagaaaauggacugcuuuuuucccaggagcugucaguugccaauagcuccuugacuaaaaaugggacuuagugccuaccucaccucuucaugcugggguugggucugccuugagcuugcacagaucuucuguaugcuaucacaucucugugugguuauuguguagcugaccugcugcaucccaaagacaucuugucaucuacuuuuuuugacuccaauacccuuuuuauccacuguaguacaaaaaucccuaagacuuggaaggaagguaugugauauggauguccuuuuagggcuaagaauuaugcagucugucucugcagcuuuacugucuucugcaagguucugacgaugccagcuuuaaauggucuggacauguaaauucagugauaauauacuuaucugggauaugcaaggcccuggguuugaaccccagaaacacaugcacacacacacgcacacacacacacacacacacacacccauggucauuaccacuuuuuaaaaaucucuuucguuauaacuuuuuaaauauugucuggagacgcaaaacccuguucaaaaguuauuauuuaaucgguaagauacaaaaguccacuaauucuauaauaugaaauuauacuuuucuauaauauuuggucauucuaagucucucuuuuuggaagucaaaggauauauagcaagauauacagaccaauaacuauaagauauaaaacucuguauuuuuagugcucaaaucaacguauaaacaguaguuugugggaacaaagccuuaguuauuuagaauuaccuggaacaguucauaaaagcaaagcucucugagccagguauuaagggaauaggaucgucuaaccacucagguuccauagggaugaggguauugucuugguaccucuauggccuuguaacagcacauuauagacaguguuguuuauaauaggcugacguuuuuuagcucaugguucuggggacugccucaucccaugguagaagagagaaaggcaaauauguggggguagugaggacucauucuuuuaugaggaacugacuccaguuaggcaccuauucccuccauaaccccauauccuuauccagagggaagaggucuauggaucuaaauguaucuuacaggaaccaccucucaaucugcaucuuagaacucuaaagucuagucucugaaauugggugugaguagagaccuauuuuaaggcaauuuuauccaauuaagauauuuuauguuugauuuucuugauucuauauuuuucuuucucuuuauuucuuucucuaucauauuuuuagucuuuucuauuuaucuaugguuuacauuauagauuaaaauaauacuuuagggcuggguaugauggcacaugauuuuuaauccuagcacuugggaggcagaggcaagugggguuuuaugaguuugaggccugcuucuucuacauagaguuccaggcuugccaagggcuacauagugagacucucucucaugcacacacuaagaacauuuggauaaaauaauuacauuuuuuuuucuuauuugaauuggucuauacauuuuccucuagcucccacuuagcugcauacuauaaauguuucuguuguuuaacucuggauauuuccuguuguuuuuaaaacaaaaucccaauuguuugauuucaccaaaugaagacucaggagccagguacugugcugaaagccugcuaacucagagaagcugugaaaguacccagcugaccuuccuccucaaucaauauuccagaaggaaggaaccaguucacacugaaugucccuccuuucuacuuccuguucaucucucucucccuccuccugacuuccucucacucccuaugguauuuuccuauguucacucuuugucaagugguugcuugcucugccucuugaccuaugguugacuuuaauuuuguuuacaauaaacagaaagcucuuggauuaaagaugugugcuagggcugagccacaccacaaguagagacagguuuuuccaguauaaaauuuugggguucacaguguaaugaaguaucccaaagcauuuuccccuuuuugucugaauaaaaauaaaagacucuuucucuaacaucaaugaacuauauacuauaugguaagaauuacauucacaagguccaguccauuuguauuuuucaacuuuuuuuagacuuuuaaauauucucuuaaauccuaaacaacuuaagcuuaaucgugagacgauaacuaacuagucuucaaccccuucaagacuugagaaggauaaauauuaccugaguaaauaaguccagagcaaguaguuuccaaagcuauaggaaugacaaagacugcugccuaccugaacagucacccaagauucccugccaugcuggagcauccgucuacuggccuagaaugucugacagauuuuucugugaagcaggaauuaugaaggacuugucugucuuguccuggcagaguucagcaguugacuuucuuuauguccugcuuguccacagcuuggacagcauacuguuagcaguugaggcaaggacaguuuuuucccugugucuagcuuugccaucuuugaagcaaacuccauauggagguucuuugauauccaucaucuuugaaguagaauggggcugcugcuaggagcugacaggucucauugucaaaaaagccuuaaauuaacaaaacaccucuaaaugccauauucuguagaucuuugagguuuuugaaaugccauauuuuguagaucuuugagguuuuugaacaccauuugucuauagucuaucugaguaagcaaauguugauuguuuaugaauauuuacuaccuguucaaccuuggaaacauuucuguaaaaaauuagacuaggaucuaaaaugaccacaauuuugauugccuauuaacuuauauuucuuaacuauccuaaacagauuguaauagcagcuuuuaaaaggacuagaacuuaacacugcauuuuuaaaaaauuauaaaggaguaaauauauaugauauaguuauauaauauaguuauuauauacuuaauaauuauauauuuaauuauuaacuccuuuuaagaguuaaaaggaguuaauacacaugguauguuauaacaaauauaacuuuuuugggggggggguuucgagacaggguuucucuguauagcccuggcuguccuggaacucacuuuguagaccuggcuggccucgaacucagaaaucugccugccucugccucccaagugcugggauuaaaggcaugcgccaccacgcccagcucacaaauauaacuuuaaguucguaucaguauacaaaauucuauaccaguguaacuaaauguagcccuaauuuugcauugauauacaaaggucuacaucaauuaaccaaacacaaucccaauccucagucaguacacaaagauccauacuaauguaaaauuuuuguccaguagucacucuauagcuuaagaguagguucaaucauuauuucuauuauuccuauaucauuccuauaucuuuucuuuugucuaaauaaaaaggaaagauuguaacucuaacacaguaaaacuauuuacaguaaugaaucucuuucugccaagcuuuccacaauguccaguuuaguuguauuuggcaaucuuagaauuaaauauugaguucaaaguuuuguaaaacaugcaugucaguuuccuauaaacagaguaauuugaaugaacuuugggugguguuggucaguuuuguggcagucuggcuaaguaggacacagcagccaacccacaaguauccacuguuugcccagaaccugauggcagaagaggcauggggcaguuuugccgagugguagcgauaccacagucuagauggauuuguuguugcaggggcccaucaucuucuuggagaccucaaagguugcuguuaggaauaguagaaaacguaacauuuuaaauggcauguucacauaguucucagaaagguuugaggacaacaagccauccaggguacccaaacuuugucccuaguuaccugcuucagacucaaaccugaaaacacauacaggaagcuagaugaagcuuauuucuagaauuaguuaguacucuguaugacuacuagaaucaugacagaaaaucuauauguugauaaugaucuuauacauuuugagauaacguuuaaaccuuaagagaaguuuuaguggauaaaaaaaaaaaaaaaccaaaagauuaugagauuaguggcaauagaauagaauaguccuguuuuuuuguuuuguuuuguuuguuuuccucugucucauaccaaguggcucuccuaauaugagacagagauuuuggauucuccuuuaacaggcauguguggguuuagagaaagagaacaugcuccaaccccaaagccagcuuuaauuuuuaauugaauugggaccacguaagaguauuugccacuuauauuuguagaagacagcagagacaagcuggagaugggcaauaccacuuggccaauuuauuccuuuucuugggacauagucucuugaugcgcucuccucuuucuuuagauguccaauggucccuggauuucuuaguuggaugcuuuuauucuccuggaaagauaaagggaaaaccuugcccaguccuagcugaagggucccugaucacuucuuauucaggaggucuuuccaguuugaaucuaaucuuaucaacuucgauggcauccacagcuuuucuucucccauggaaacaaaggcaaaaccuagucuucaaaauaacacacauucugguuuccauucugaggucuacacaucuuuaaaacauagaggcugauuuaauuuaguaggguuuuuuuuuuucuuucugccguccaauguuucucuacagcuguuguuccuuucucagaaacauuuaaaaauuuaaaaaguugccaggcauugguggcacaugccucucagcacuugggaggcagaggcaggcagacuucugaguucgaggucagccuggucuacagagugaguuccaggacagccagggcuacacagagaaacccugucucggaaaaaaaaaauugaaguuaauaaagcacuuauauaaucuaucucugggagucuucacuaccccuuucugcuuauuaggcauaucuuuuaaagugugauuagaucuuucuauaacugcuugucauguaggauugcauuuuauaccuguaauauacuuuauguugugauaugcaaaaaguuguuucauuuuacuugaggaauauacuggagcauugucagccuuaauuuguacaggcaucuccauaauagccauaacauguaauaaauguguaauuauagaaucagccuuuucagaacuuaacuauguaucgauggaauaguguacauaguuuaauuuuccacacucuguaaaaugaaaaacagccauuugccaaauuucauuuugggggguaucauuuggguuacuuccugcaagugauagaguuugguuauacaaaaaacagguaggauauuuccuuauaauuuccuuggcuuauugucaagugauagaaaaaucuuucuuuaggccuuugcuguuaacgugguguuucuuaugaaauucugaggcuucuagcaccuuuccuauuaauagcuaaucaauuucaucauuacuuugugcuagaugaccugguaaaccaauaugggauggauauguauuauauacaaugaaugauuucuauuucugauuaguuguaguugaauaaauagugagguuaauucugaaucaucuggaauaaguuuagcaguuucaauauguaaaacaacuguuucugcauauugaaagucaguaccuauauuaagagauucaggaaaaucauauaaagccauacaaauggcauauaacuuugauuuuugaacugaaacacaaggacucugaagcacuuauuuuuucugacuuauagccugccuuuucugauuaauuugcaucgguauagaauguaggggcuccagaaauuguugucccuuuuacuauacgagggagaaucuaauuaguucuuuuuauaaccugaagucucuugcuuugggaauauuuguuauuaaucuccccaaaauuacuacaagcuuuugcugauguucauuuucugcccauagugagacaauuucagcauuaguaaagggugccacaaucucuacugggucuguuucugcuaauuggccaagacucauuuuuccuuucaugaucauucagaaagcuuuucuacauaggucuuuaauuuuuuauucuguuugugugcuaaauaugucuacucuaacguguuaucuucucucugcauaagaauuccuuugggaguguuggaguucagaaaucaccacacaaaccauaugaauaccugaauuuaaugucaccuuuugagcaaaauggagacuaaauacaaaauggcuacaguuauuuuaaaaggagcaggccucaagggagaaugauuagagggcagaauaaugaaaguacaauacagcuuuggauccaaucaguucacauguucguacuguaauuucuuuucuaucagagccaauuuuuuuugucucaaccucagcugauaguuuucuuggacuauuuaaguucuuuuuuuuuuuuuuuuuaagauuuuauuuauuuuaugugagcacacugucgcugucuucagacacacaagagggcaucagaucucauuauagaugguugugagccaccaugugguugcugagaauugaacucaggaccuggggaagaagaaucaaugcucuuaaccacugagccaucucuccagcccuauuuaaguucuuaucaccuuguacgguuugaaauagacuacuuaauaagugguuaauccaguuguagacaauagccaguuaauaucucccagcaauuuucgaaauucuuuaagaguuuguacuugauaagucuugauuuguacuuccuaugguagaauuuucuguaaaccaaucuuauauucuggauaguugauagaaucccuucuuuguuuuguuuuguuuuuucaguagcaauuuauagucacuaccaaggcaaaauucucuuuacuuuaucaaacauuuuugcuaagguaucugcauccgaaucagccaguaagauaucguccauagaaugguaaguuuuacauugaggaaacuguguaugguuauuucugacagcuguuguacaaaauauugacaccgaaugguugaauuaaauuugaugugggggacugugggaagcccuguaggguguuuccugauggcaaaggguuaccucguuuauccuguguugaucugcaaggguuaguccagaaccccccuuugucacaccuucugcauauuccauaaggcuggggccuucuuucuggauuaucacuagaagaaacauuauuucuaagaacaguuugccuacaaucccuuuucaaaagagcuugcuuaccacaauuaaaacaucugccauuuuauuuuucuuaagacuucuagaaauuacuuuucuuaccagaguaccaucauaaaugugagcuccacuaucagccagauuucuaaucucuugaucuuuuggugcugaucuugccuuuaaagaucuaaucacccauuugcauuccaaauuagcauuuuuaaaagcuaaaaauucuauuaguauuuuucugacuucugaaucugauacuauucuguuuacagcugaaguuaaucuuugcaaaguauaauugaaggcuucuuuugggcuuuguauaauuuugguaagugacucagaccucuuuccugauucuucaacuuuaucccuagcauuuaaagcugcuagaugacguagugccaaggugugaucaucaaauucaagcggccuuuguaacuccgcauauugaccuucaccuagcaauugaucuugggaaaaauuaauaccucuagccugaauuagucauucugugacccuagcuuccucuuuccacgaugcuugccauuguaagcuuccaauauugcuguuuccacauuuucuccagccuugguggauaauucuguucugaguugaccauaaauucaauaucugcuucauacaggauggauguauaccauaugaaaugaucgcuuccuuaaaucuccucaaaucuauaggauucccugaaauuucuucauaaccuugggggugccuaucaucugcugguaggucuuguauaguaauuagauaaacuaagguugguuuucuaacaaccuggggcagcccuucuucaguuucaucaugcaggguagguucuugucuaaauuucucugugucugaauauuuuuccuauuuucauuuaugagucucucuaaagcuuguaucuuauuaaucuacuuuucauggcuuuauuuuuauuguaucucuauaaauauuuuuccuuugagcgguuacagaaagcuacuauggcuauuaaaaauaaaauaugaaauaaucaaaugauaauaaucauaguugguauugagcaaauuucagucaaguccauuuagucuuuuauuuucugcuuguauuuucaagccaucuaaaguagcacuauauggaguccuagugucuuguauuaugguauuucccauccugaacucucuucuugaagacuucuuaggugacuuaauaaaucagaugucuucucaguuuguccucagcuggagugauuucucugucuguggugucaugccauagguuggagcaccaaauguuguuuugcuuuuaaaauaaaaucccaguuguuagauucaccaaaugaagacccaggagccagaugcuggggugaaagccugauggcucagaggagcugggaaagcacccagccaaccuuccucuucagccaacaucccagaaggaaaaagcccuuucuccuucuccacuuccuguucaucucucucucccuccuccugacuugcucucacucuaugguacuuuccugucuucacuuccuguuaacugguugcuugcucugccucuugaccuaugguugacuuuauuuaaucuuguuuacaauaaacagaaagcucuuggauuaaaggugugugcuagggcugagccaugucacaacuagagacacguuuucccaguauacaaucuugagguucaccauguaaucaaguagccugagacaauuucuucauucucauagcaauuuuuuuuuuuuuuuggccuuugaauuauuuagucacuagaauagugagauagacaauagaaguaauaagaagagaguacacuguaacuggucuguguacauucugguugccugacaauucugagaucucauggaaggcucugccucacccuguggaugguuccaccccacccugugguuccacuagaccuccuaggacucuauuguguucugacuccauaguucugcuaggccuugccuuccugaaagucuucuuugcuggcucugccuaugcccaggucccgggcugcuaucauaucuuuugaaauccaggcagaggaagucaugccccacugcucuuacauccuguaucuacagagcuggcacugagugaccacugccacagcuugucuugugguaauuuuaggaggaugggucaaaauucuccagagaggagcgguugagacagcaggaggcugugaagaauguagggugugaaggcuuaucuuagcccuuggcaacaagccccaagaucuggcuucucuucugauuauuuuucucucugaagcuuggcauucugggugugaaaugggagggaccucaauagaagucuccaaggggccuuuggggucauucucccauuguccugugugaauagacucagaccucacucugucuauccuacucuaucaaaugauuacuuagccacaccugcauuuuucuuucaugaaauugcuuuuaauuuucugcagaguucaggcugagaacccuucagaucccuaaguucuguuuuauuugauuucuagauuccacuuuacaaucacaucuuucuacucacaaucuaggguggacaguuaagccacacagcauccugagugcuuugugaccaagcuucuuccaccaaauauccucuuuccuccuauucuguaaaguuuuagggcacuaacaauucagccauauuguuagccacuuuauuacuaggaugguuuuuacucuaguuucugcaccacuuguguaauguauaagaaaguccagacuuucccuacaguucuaaugugagcccuugccugacucucuguucaccuuaacuuuuccuagccugcacaugcggauuuuuuucuagccucuccucucuagccgguuccaaagguaauuucacguuuucggguauuuguaacaguacuugcccuacuuaucaagauuagaucauucuuagucugcuuugugcugcuuuaaccaaauucuguagccuggauacuguauaaugaauagacguucauuuagaucaugguuauggaggaugcaaaauccaagaugaggccuucuggcugauucaucuucggacagauggaggcagaaggaggggcagagaguggaaguaggggagagggugagaggccaaauuugucuuauuauaauaacuccauuuccagcuuacagaauccauuccucuguguguggggggugcaaggggaggacacugguucacucaugagggcagaacucucugcccaaaguacugagaaaggaacgcuagacagguuuucuauuacugagcccuacacaucuccuuauaggucccgucucccaauaccacacauucaggaucaaguuuucaaugcaugaacguaagggcucacauuuaaaccauaugagguauccuagugcagaaaaaccugggcaaguguggggauggggguauggaauaugcugugggaaggaucuaggcucuguuagugugcuuggggacacuugcaguuuaucaguuucuuuucuaguugacauggcaaaauaccuaacaagcaauuuaaggaaggaacuguuugguuuuuuguuuguuuguuuguuuguuuuuggcucacaguuugaggguacaguccaucguggugggaaaagccuggcagucagggugagagguggcuggucacacugcuugcaaaucggggaagcaaagggcccucugcuggugcccagcucacuuccucccuuauaguuagucuuggccacagccagcuagaggaacugugaugccuuuggcgugguugaucuucccaccccaaugaaaccuaaucugaaagaucacucagacauaccuuaggugauucuagauccugacagguugacaguaucgaucaucaggcaugcgucugauguaucugcagggcauaaggauugaauuuguagguuccugguugcgcaaugccagcaucaggcuuuugagauagaugguuucugagauggaguguucuaagccagaacaaggcuugguguuccguuucucagggaaagguggagaugguagaugguaagggaguggggcgaagagguuuagcuuuggaggaaagccugaggcaaggguagccuacgguaggaugaugcagccacagacaguuacuuuaagagaagcauguuuauuggucagagauaaaacuaggaagggccaaaagguguggcuuuggcuguaccagauucugggaaagugauagauugggauuucucaccuaggugguagaauuuggagagaaaacugguaggugagucugaagguguuagaagggcucuacuuuuuuccccuacagaacugagaaccagcgggauaugguuccauaguagagcacuugccuagcaugccaaaggcuugaguucaauucauagaaaaaaaaucaaggucuaaagggcauagagccauugagcaaaccuugggcugccugucaccugcucaaccuuugggggauauugaucuaguugaaguccuuuuggauagcaggcauuggcuggguaccaguuccuacagggcccuguuucuucccauguccccuggcuaggcucaucagcucauuuuaagccagggacaccuuguucauggcagaauaccaagggugcagauagcuaucuugcugugggcuagcuuugcauuguagcugaccugugaaugagugguucuucuuggcaacugguucagaggggaggcugcugagccuuggacaugaauagaucaacugcaggcuuccccucaacagauuguccuuguagcaaccaguccaagaagccccgugccucuggaauacccggagauacaaagcaauucucugggcuagcccagcaaggaaaggaaguagcaugcuuaaguuugugaugggacaccuuggagcaaaccuuaauacuagccaggcuacauagagcuguccugguucugaucuagaaaaaaagaugugccaguguagaccugcauugggaaagaagccaaagaaggaguagcugucuuguugcuuggguuugcuccaggcuacuuaguagugacugccaaaaucuuuccuaaaggucaaggccagaguguggcuaaguuguucauuuacucuggaaccuguucuaugugguauuuuccauuuuggcuucaugcuagcaucauagaggagguagguuuuuuuuugggggggggguguuucauuuuuacuacuggugcuugacuucuaacuaauauaauaaaaucauggagagccugaccuagacauccggauacuuuaaaccccucaggucaaugccaacuuaaauggaaucucccucuccacuuccaucacccccaucacccccguccccucuuaggaaagaucuggaggaaggagggcaggagagaaggcaguuaaugaacaauucuggcacagaaguuuuauaacaacuccaagcgugguccuagcagggcccaagggauacuguauaaugaacagaaguucauucagaucaugguuauggagguuguaaaauccaagaugaggccuucuggcuguuucaucuucggacagauggaggcagaguuuuuaggcaggccuaacccauaccccuuggaaucaaagugugcuuaucaaagguuaaguaggaagcuuugaaggcuaucuaucuaaucugaugguuuuccugcauauuagaauugcuugcucgccauguguacauaaauuccagggcuagguuagaguaaugaaccagaauuucuucauauggaccagaauaaauacucauuaagaguuuuaagugguuuuauuuuuacauuuauuuuauuuuuuuuuuauguuggggugggagaguguguguguguguguguguguaugugugugugugugugugugugugugugugugugcuuguauauggagcucagaggacaacuugagggaacagguuaucagguguggccacaggcacuuuuccgugcugagacaucuuguuaccccuacaacaggccacuucccuguucagcuaucguucagaaucucuuccaugaacacugcuuuucagacuuaaauguagugucaaguucaaaucuccauucugauuuuguagauaugcaggaggccuaggauucugauucgcuaauaagggucccuggggugcccacguuccuaaacuaacaagcgcauuugagcagcagggaucuaucuaucgaucugcuuccuguauugacagcugaagaaaaugagagccagagaaggacauaugacauuccauggucaccuaacaugccauucauuuaaugcuuuaaguuuuuaaagcauuuacguuuuggaggggagcagaguugggguuuauuaaagauauuuuaauguauuuuaagcaugaaggcuaagagagaagugcuuagaaagaaagauauaccccagagcauugauguaaguuucucaaagaagacucaucuacucaaugcuuuuaauuaaauaaguaacuaauuaauuuuggagacaaggucucacuguguagcccgggggagacagccaugcaggagaagaggcccaugugacgaggaaugauuuggcgguugcuggggguagcaagcgaagggaugcucacuuuuaggagagcugucaagggugauuaagggugauuuuaacuggaaauuuaggauuacaagucucacuguuggcugaaugagugugguggcagcugccaauuaucucagcauguagaaggaggaggaauucaaguuugaguuacauaguaagucauaggcuagccuggacuuagaaucaauggacauagaaccaaucagucagucagucaaucaaacuaacucucucucucucucucucucucucucucucacacacacacacacacacacacagagagagagagagacagagacagagacagagacagagagaaggaaagaaggggagagagaaaucgaaagcuaguuuucuuucuuuuuuuuauggggagggccguucucaguccucuccaggauuuuguggguggcugcugcuaacccuacugacgaaugaggaaguguuugggacuucccuuauucccuuacacaaaguuguuuuuguuguuguuuuuucuuuuaauuuguuuuguuuugcucuugcucaccauucuugaacucauaguggcaucugagaaaugcccccacuuggggucacaggcuugacuccauaguaggucugcacucaaaaucauagauuuaugauuaugauagccaacacuuccaacagauguuuguccugcccucaagaaauaagcuaagauguccauuuuucucuaggagagcacaaacuagugcuuccuuugaucgucugccaggagucaccugagcugugugugacagugcaugucccaggccccacccgagcugaugaaggccuaugucugugaaauguguguauuuaguucguggcucugugauuuuuuuuuuuuuucuguuccugaucauuugagaaacagaacaggauggaagggauauaggcuggaagaagcuggcauuugacaucuauauaucccccuaggcugguaagccacauagaucucuuaguagcaugguccuagaggaguugguccauagagcaauugacugcuuccugacuuccucccaguuaccucgcuggccucugcccucugccaugcggaguauaccaugauuccuugcagagccaugccaucaagguucccugaccacaucuccuauugcacuggccuuccuuccugauucaaccgugcaucuuagaaacggaggccggaguacuguuagugucuagaaggacugaacguggggcuucuugaggaccuucacaguaugaaucaaguucugccuuaguuaacuuuugugccagaaauggugggcacaucuacuuucccccgaacauauucuuccugugucauagugcuggaaaauugcaguagagacugguguugguaagucaggcaugggaagugaaagaggguugggaccucaguuccccuuccuguagcagggcuccaccuagauuccucacacugcccucugagaauuuaggaggaagaucaccugggccugguugccacguaguggcuucaugauuccuagagcaggaaaagggcaggcagggggugugucuaguuaggugugcaggcugagccuagacugacaccugggacuccugccuccuagguggcccgaggcagccgggaugacacuucuccccaggaacccugcuaucugcugagaaacaugaccagcaaaucucgugaguguuguccuggggguccuccaugcuggaagguccagcagucauugucagcaucaacuugggaccuucgcaggggugguagagggucacacuuggagccaaggacacucuucuuauccugacagcagaaauacuucagucccagccccucucuagggacaggaugaggccagagacugggucugcugugcugggggcggaggggcccaguauuagcaaaggagaaggcguccuggaacuguaccugccugccucugccuucagcuccguugugcauguaucuugcagacuggaagcuccuggcccuggcucugguccuuguuguugucauggugugguauuccaucucccgagaagauagguacauugaguuguaaguaugcuuucuguguucuucuauuacuucucgaccaagaggggcugauguaaaagcaggguaccuagccaggcaggaaacuuuugagacccuuugccugacaucuccucuucagcuagcugcuagcucaaagaguccuuccauggggauggguggguugggggauaggugggaugguguucuggguggcuucugugaucucccacagaggaaauguuagggcagaaagaucuggacccuuaaugauuuguguucaaaguggaacuuggguugaggagauacugagucuguaaguccuucaccaguucuguggggccucuguaccaucacaggggagguugauccuaccugcgaugauggcaucaggaccucagucugacuggaucuucugauucuuuuuuucucucuccagcuuuuauuuucccaucucagagaagaaagagccaugcuuccagggugaggcagagagacaggccucuaagauuuuuggcaaguaaguaccagaugauggaacaggguacuuaggacugagugguuuugccucaucacuaaugggcuggaggguagaugaagcuggaagaaggacaaagaccagcuacuauagucaggggccugacccuguuccgucagauuaaucucuuucucuucccuuugcuguauagccguucuagggaacagcccaucuuucugcagcuuaaggauuauuuuuggguaaagacgccauccaccuaugagcugcccuuugggacuaaaggaagugguaaguuauuucucagcuccgugggcaagcaucucacugacuaugaacugcucugaaggacuaaugugcuuaaugacuuguucuacccaagcaaguggacagacaguucaaggucugaucuugugggccacguucuuggauguugcuauccacuggcuccaugucuggguucuuuugcccaggcucagguaccuaugucaaggagggagaaucuugggaguggaaugggagcagccuuuagaaugcugaugaccguggucuucucucauucuauuucuucuguuccuuuuuuuuuuuuuuuuuuccuguagaagaccuucuucuccgggugcuggccaucacuagcuauucuauaccugagagcauaaagagguaaggagauauucuucucauuauaaucuggcaccuucacuuccccugcuccaguuugaacucaucauggucuagugccuugccuuugguucacuguggccaguuugaccugccguagccugccugucuccaggagcuauugguacucuaaaaucacaacgacuuagccugagcaucuagaugccagaguacgcagaagcugcugaagguauugccauggcaacagacagaccugggcaacaggcaaggaagcuguguccuaggauuucuccuccccucuucuuucugguuuuuuuuuuuuuuuuuuuuuuuuuuuuuugguuccuuuuaagacaggguuucuuuauguagcccaggcuggauuuggcacuucuucagugccaaguuacaagugugugccaccuugcacaguucuugugcugggguuucuuguggcacuccucucauuaucucuuugcuaugcguggcuugcuuguguuucauauugagguacaagacuuggaggucaguagaacaauuagcagggccacuuagcaugccugaggcauggcugagaagagccuagaaguuuugaacaccccucuucccacggcagccucgagugucgucgcuguguuguggugggaaaugggcaccgguugcggaacagcucgcugggcggugucaucaacaaguacgacguggucaucagguguguggucaucccuccugcuucuuuuuggguccuggaugucccaaacggggcugccaaaaggccugguaucuccaguaauggauguucuuuuccugggccagauugaacaaugcuccuguggcuggcuacgagggagaugugggcuccaagaccaccauacgucucuucuauccugagucggcccacuuugacccuaaaauagaaaacaacccagacacgcucuugguccugguagcuuucaaggcgauggacuuccacuggauugagaccaucuugagugauaagaagcggguaaguugugucaggugggacaaagagauauggugauggggacgcucuccuggucagggcuuuaugucccacggaccgccuuaugaugcuccuaaaggauuggugaagggacauggugaaccaggcuuuccacagccagagccuugggcuucucgacaagggcauuguuuuguagggcugcugauuaacugcccugcucaagagucuguagggcugggguggcaaccagaggcccccugggcuggaggguugccuggaauaggagaacugucaggauguaugagaaaccugggaacaaugaagcugucccacugguaccuugaagcaggcagcauucugggagcuuucccugauggucccacaaagagccuuuucucucagugggccaucuggaugaaggcugaaccgacugaucuggcauuuauugcccaguauguugacagccuaaggcucaagucccugcuugccuacauaucucuaaagagguaguggucagaccccacacucuucacauguuaccuuuccuuccugauaagggggcuccucuugaccucuccuuuggucucucaggucugggacaagucuuaccucacuugacugggauuuucucuaucugaagaccaccagcuggaauagaguugagaaacgggccuucaccucuuuucaugucucccuucuaacccuacccccauaggugcgaaaaggcuucuggaaacagccuccccucaucugggaugucaaccccaaacagguccggauucuaaaccccuucuuuauggagauugcagcagacaagcuccugagccugcccauacaacagccucgaaagaucaagcagguggugacaagcuggugacaagaccaagcuggugggggggggggggagguauggggcuguggguggaaaucgaggagagaucauaagaauugggugcagcuugcaccuaaccuuugaagagugcuuccgcagcacgcugcccugauggacaguguguacuuuggaaaacuggguuaucccuaaaaauggaguaggugaaaggauuggauuugggcgcugacuuaaagaugcuuuuggcaggcucuggucaggaucuguaaauugguagcugcuggcacacucacuggcccuuaccugugggaacagcuugagucaguguaguuaauguuagacuuuuagccugcgguccuacauuggaacauacugaucuguuggagugaguggagacgaaguguugacagucuguccugcauguccuuagugugguaaaccaguuuagggagcugaagugguuuugggaguuacagcuuugauuuucacacucuguguccugguagucuucagcugguaggguuuaccccacauuguagcuuugcgaauauuauuucuguauaucuuagacucucucaugggggcauaggagacugcagaaggaggucaccagcaggcauuggcagggcucuuggcugugccacuuugugcgguuguuaggcaggucuagcguuaggaaauuucaguugcuuaucuuaauggugaggauaauacuugcauugaccacuuaagcuuaggcaggacuuaagacaguaauauaaaaugucaaucacagagauuggaacagagcagcuguuccuuucaguguuugcccuuugcuguuuguuaguucucuugagacaggcuggccucaaacucauaguaguccucccaaguuaugaguuuacaagaaugagccacaauacccagcuaauauuagccaaauuuuaaaaucaacauguuuauucucaacugucuauauuauccaacaucaugcaucacauggccacagugugacugcccaguggugagcccaaguucacgggcuuagagaguaagcugugaccgccugcucagaagagaugcccuguagcagaauaagcugccagucucacuguggagugacaaccuuucacacuagaguugcuuaagugugguagaagcacagaggggaacacauuucugcuguguuaucugggaaagucuacaguugaagugguucuguugucaguccuguggggaucauggcauguauuaggcgugaagugggaggaggcaguccauuuggugugcacauauaagccugccaauaccaaguuguucuaguucagauggcguugagggcaggaagggggauuucacuuaugacagggucucacuguguagaccaggcuggaaugcacagaaaugugcuugucucugcuucuugauugccgggguuacagggguggaccagcaugcaugcauaacguaugauagagugaaggcuuuagagggaaguaggagaaggugaggcucugaauccagcuccuggcagugggaaggaaaaagaaagggcuguauuuggcugugauauugcacugauuuuccauugcugcccaaugacagucagcguaguggccucaaauacacccuggcuuuggcucauggcgguagguucucuguagugucgcagguugacgauaagaacugacuuccuaucuggaggcuuuaugguaauuuuuuuucaaacuugucuuaggugaaacauguuuggguuuccaugguuuguaggacuagggucccccuguucuugcagacuguggucugagggaagagguacacucagcucuuggaggcugcuugcauuccgggcccuguagcucccuccaucuuuaagccacuggcagcucaaaucugacugacuucaccucugagcucagcauccagauuuagaugguuagguaauuaggucagugguuuccccucauaaaaacuguaugaaauaaugaacuauucuuuaaacauccuauuugcauauuucccaucucugugugagaaggcagucauaaaagagaacuggagguucuguuucagucaggguuacuauugcugugaugaaacgccacgagcaaaggcaaguuggggagaaguggauuuauuuugcuuacacuuccauauuauuauuuaaggaaguuggagugggaacucaugcagagcaggaaacuggaggcaggagcuggaggagugcuccucacuggcuuggucagcuugcuuuuguacagaacccaggaccaccaacagugggcugggcccuccuccuucaaucaguaauuaggaaaaugcccuacaggcuugccuauaguagugucuuagggggcaguuucucaauugauguuccuuccucuaaguugacucuagcugugugaaguugacauaaaacacuaaccauugugaguuccuguacaguuccguguccuagcaccuaugcuugcagggaggauugggaguuuuaugaguagcucuagguuuccuugguuuccugcuuggaugacugcucaguugugcucuacuuauuuaauacagagaaugucaggaggagggggagugugaugaagaccguaaggagcagagcuggugaggaggugauggccguguaauucugcaggacuccaaacuggauuccagagcacaggguguuuaacguggcagggguggaggugcaguaguaaacgucugaaaucccaguacuugagaggcagagguaggauuucaguguuagccucagcuacguaguaaguucaaagccagcgagagcugcgugagauccugucuuaaagacaaaaggcagcaaccguggaaaauaaggccuaccaagaagcaauggagagaaagacaguugaaagggaugccaggagaaaaucagccuuuaagaggccuuauggaauccaagaagugacucucucaggguaagugggcaggugaaauguucucuaaagcccacugucugagugaagcaaggcaagcuuccugaaguuugaauauuaaguccaccauugcuguggauaaauugggguggaaggaaugggaagcagcccauaagaugggcaggcaagguaucgcugacccugguuuacagaagggguauaucaucccaggaaagauuacacagccauggguguugaaccaccacauccaagggggagggcagagcccucuucccuucuuugagcaaguuauuuauauuugcuaguucuaguuugcucauuuauaaaaugaggcuaauaacaguaucugugcauauguguuugggagauccuguacuguaccguguugguacucagcaugaagccugacaccuauaaauacucgugcaacagauaguauuauggugaauguggcuauugucauucugacagccaccauccuccuggagacccagaucuuccccagaugugggaguuggauuaucuaguacgcuguugugucagccagacuuucauccccgaugucaccaacuuacuaauggaaagauagauuuuguucaaggucucagucgauuuaaucaguaacagcagggaggacgugguggaaugugagaagcaggaaaaaguacuuacacaggucccuuaucuacccuuaucuuaucccuacccaccuuuaggguauaucuucccucucuagucaauucuuucuauucuucacagauaccguccccgcccccaaguguacuauaguaauuuccuagguaguaaaguugauaagauauaagauaaacacaauagccacuagacucauaacaauuuaaacuuaaaacuuagcagcugaagagguagcucagcaguucagggcacuagaugcuucuggggaggaccuggguuuaguuuucugcacccacuuugguucaccagcaccuguaacucuaguuccagaccacccaaugccuucuucuggucucuagaggcuccugcgugcacaugguauauauaacucaagcaggcacaaacaucauuaagucucugcauuuaaaacuugauaaucaggaaaaaggacguggaccaaugguagaacacuugccuggaauacaugaggcccagguucuaccuccagcaccauagagaguucacaguuuucuugaguaauaaauccacuuucucaucuguguuagcuccauucagguaggugcuugguuaguuagcuguugcccgguuggauagcuaaggucaacgagaacugggcagagaacugacccugagguugugugagguagaugguggaggaggaggggauugugguucuuuaaaacucccucuuacucugucccucagaagccaaccacgggucugcuagccaucaccuuggcucuacaccucugcgacuuagugcacauugcuggcuuuggcuauccagaugccuccaacaagaagcagaccauccacuacuaugaacagaucacacuuaagucuauggcgguaagcaacccauuugggagcccagugagccagguuggcuaggaugacacaacuggagggauguuggguauaggggacacagaguggcucuggauguggucuucaguaucagagcugguaccugggcaucuggacaccacagcuggcauccucugcuuuugccacaugacuucugucuccuaucugagagccagcauaaggaagaaaaaucccaggaauccuggaaccagggagauggggaggaagaauuuucuaaagacagagugcuaccccucauuuuucccuggcugucuccacagggaucaggccauaaugucucccaagaggcuaucgccaucaagcggaugcuagagaugggagcugucaagaaccucacauacuucugacuuggaugggagcuguaacaccuugguucccuacuuugccaucugaguaggcccugucuacagcuuagagguuccuggugccaguacaauccaauugaacucacccucaauggagaggguguucuggggcuguccaggucuccagagaggcuaugccccugccuacuuugguggauuucaaauccagacaggguagucacaccgaggcuacaggagccuggcuaaaggggggggggggggugcuguuacuguggcauccccucucucagccagcacaaagagcuguuuuguuuuguuuuguuuuguuucguuuuguuuugucuuguauuguugguggugguugguuggguuuuguuuguuuguuuguuuuuguuugcuuuguuuuguucuugagacagggucugacugugaaacccuggcuaaucuggaacucacuauguagaccagacuggucuugaacucacagagauccaacugccuuugccucccaaguguugggaugaaaggcauguacuacgccuggccccaacaccaagagauuauuuaacauucuauuuaauuaagggguaggaaaaugaaugggcuggucccaggauguucaugaaagggacacaauacaguguucugcccacuuuuuaauaaaauuuacaugugauuggccuguuaaggcccaauucuagagcuggccucccagaaagauggaggcaucaagagugggaggguguccuccagagagagguugcuacuucccagcaggcauggggggagcauugacaaggggguuccaccuagaaggggccucaccuugaaaagagguuguaaaagaccauuaaaauauuuuuuuuucuaaaauggaag

SEQ ID NO: 4998 - RNA, 47801 nt, Mus musculus
auuuuacaacguacucacugggauaggcacauuucucaugugacauaucccuuuauugaggaccgagcauuagucugcucaaaauuaagaugaaugggugaacagcugggauaaagacauacagaauuacuuuugauucagcuucucggugcggaccuaaacauuccagucagaaccuguugaguguuuuaguuuccuuaaacuucaaccccugaaaugagccuucagcaagguccuguagagaaaagcaucagaaauuaaccaguagucagguugaaaauccaacaaagcaaaugaugcauuucucuguuucccagagcuguguugguggccagcggcagcuagaaguguguaacacacaguucuuccagcuuccacacugagcgggcugcauagugcauacugccacuaugacuaauugugaaauggccaucaaguacaucugcuugcuacaauuuuagcacuuaaaaaauuaguucuggacuugaaauauuuuaaagcuaaaaaacuagcagugguguuacugagaacauggcauuacaagcugaguugcugugguuugccuucugaaacgaaguaccaaagguuuuugugcuguagcuuucucaucguaaaguaaguuaaucgugcagguugagaccccuuccuuuucuuaaauguuugagaccacaaguauuucauuucagguuuggguuuuguuuuuuguuguuguucuuguuuuuuuuaauauuuagguucacacaaugugguaucuuggaaaugaggcauaagucugaaacaugguuuuuauuuauuuauuuuuuuuauguacacauagccugaugguauuguaaagaauauuuuuagugaaccugcauuuuuacuguaauuuguugucaggaauagaguuuuguacuuguuggcaucuuaucagggguccaaauguuuucaauuuuagaacacuuugaauuuuagauuuucauguaagagucaaucuauaauacccaauuaagguuuuagggauuaaauuaacuaauaguuacagauuguacaugucuuguaauaaguacuauguuuugucuuggucuguuuguuuguuuguuugaggcaagauuucuuugugcagccuugacuguccaggagcucugucuguagacugugaugccucaaacucagagauccaccugccucugccucccauguguuguauuaccacugcccagcaauuuuuaaauuuuuaaacaaaacugacuuaguauuugaauugaacacuaaaucaugaauauuccaguauucaaaacuuauauuaaguuucauuuacuauacuuucucagugcucaauggcuuuacuuggguuuaauuugucuaaguaauggauuuuuggaaccauguuuauggagggagggcacauaaauauguuugccuuccuuaguguuacuuuaaaucacauccccagagauugugguuugugugaaagaaguuaucgguuuuguuguuauuauuuuugguugguugguucucuguaaacauagauguuaggcagaaaaugacuucugccgggcaaugguggcgcacaccuuuaaucccagcacucgagaggcagaggcaggcggauuucugaguucgaggccagccuggucuacaaagugaguuccaggacagccagggcuauacagagaaacccugucucaaaaaacaaaaaacaaaaaaaaaaaaagaaagaaagaaagaaagaaagaaagaaagaaagaaagaaagaaaagaaaagaaagugacuucuauuauauaaaauagaacuuagugaaaauauuucagagaugguccaacccagacugucagcaaguagaaagcuuugagacacuaagaagugaaacacccuuaagaguaggaaggcugacagugguguaccuucuguguacccaacauucacaaagauucuggagucuagaaaaguuaaguuuaauuuuaucuaacuguccccuuuuauuuaagacugacuuuauuuuuaaaaguuuacaguauucuuuucacagucacaucagaugauuaaguuaaggcaagauuuuccaacauuggugauugaccuagguucccaggaccuugcuuucuggagaucauaaucaaagauuugaccagaaaggugaucuguguccucacucuugugauuuuuaugacuucuaguucccuaaagacuuuaauaucaaagaaaaggucauuaugugaaauggaauaugggguuaaggaacuuacagccuucuguuuccaaaagaaaguucauuacacagcuuuaauaaguaaugaagcuuucuaauaguaaaguccugcuagugacaguagggcauaauaacauauucagaacucuacuuuaauuaucuucuacauugccaguguugaaauauuacugcugggccacugagauggcucagcaaagccugccaaccugaguuugaugcuugggacccacaugguggaagagaccagaccuugaaaguuauucucugaccucuacacauaugcugagaaacaccaacauaugcacacacauacacacacacacacacacacacacacacacacacacacacauacacacacacacacacagagcuuauaucagacuuuaaaugucaccagcuuacuaaaggugaagcaguuacaacuuccacuguaguacuuauucuaauccuuauaacucuagugcugguuuuccugcaauugguguuuguggucuuuaacauauuuuugcuuauauugcugcuguucaucacaguggcuuaauuaaagucucuuccuuguuuagagagacaugucuacagucugagaagacagcuguuaacaacugagaaugucuaauagugagcaaguuguaugcuuguuguguugccaaguguaauugggcauuuaagcacuguuagcccacucagcuguggguuguuuuauguccucagugguuccuagaccuccuuguguaaaucacagcaauuucacaugaguugacaacgcaggauuuuggugggaggugggaggaaggguuucucaguaacagaagcaguguggcgguguggaacacugacacagccagagcuguaauuucaagaugaccucccuuaggcuaguuucauuccuuaaucauggugugcuuguuaacuaauagacuucugcuaagcagagggcaucccgcaguaccuuaguuggguauauggcuuauuaaaaugcuuaauguaugugcuguuguaaauuaugugcuuuacagaucuaaucaugguacaugauguuuaaucuauuuuagaaacuggauggcuucuacagggagccaggccucugauaaaaacaagauuuuuggauucuucaaugauggcgaaccccccaccaaaaagcccagguaaacaagagaaagggaaucagaggaauagaaaguuacugcuagugggacguguuuacccaguaucacagguguaucacuaguuaauaaggacuucauuucaaagacuacauuauuuuuacguugaaucuaacuuauuaaggugauuacauaguuuuaaaguuuuguugcuuuaaagcucauaacgcuacuacuccucagugauaaucauuuuccauuuuuucuaaucuugacaucuguuuugcuuuguuuuugacuguaagacugggucuugcuguauagcccaggcuggucuagaacucuugccucagguucccagaugcugagauugcagacaugcaccugacagcacauacuuuaaauguuauguggugcugcuauaugcgcucucuaguaauagaaaacaaggacuuacuugcuuuccugguucuugucccuguauugcugccccacaggcuucacccuuaucuucccauauguuuaucucagcauuugaucaaccaauucucaacauuuauaauauugugucuuuauaaguaguauuaauaagcccagcagcacucaggagacagaggcagagucaggcaggcuccuaugaguuugaggccagccuggucuacagagcaaguuccaggacagcuagagcugcauaaugaaauccugucuugaaaaacaaaacaaacaagacaucaauaguauuaguagccaagccuaaagugauaugauuaaaacauuaucuuaaaugguuugguuuuguuuucuguguuccuuuccuuuucaaacacugacagaagaauuagucuaucauaugcuggaaauguuuagaaacuugcuaguuuaauugauuccauggauucuuaccucuggccucaacccugcuggagucagcuccauaauaugcccuuuauuuuauuagacacuccauuuuacugaagcgugcuuucagguaccuuccuuaguaagaaugcaugggaaaauaauuguuagagauuaauaaaugucuuugucauguacauacaugcacuuaaugguaugguugagaauagaauuuuuauguaggaaaauguuuuucuuuuuuuuuuuuuuuguuuguauucucuuuuuauuagauauuuucuuuauuuacauuucuuuuuuuuuuuuuuuugaagcucacacuuuguuuuuuuuuuuuuuagguauuuuccucguuuacauuuucaaugcuaucccaaaggucccccauacccacccccccaauccccuacccacccacucccccuuuuuggcccuggcguuccccuguacuggggcauauaaagcuugcaaguccaaugggccucucuuuacagugauggccgacuaggccaucuuuugauacauaugcagcuagagucaagagcuccgggguacugguuaguucauaauguuguuccaccuauaggguugcaguucccuuuagcuccuuggguaauuucucuagcuccuccauugggggccgugugacccauccaauagcugacugugaucauccgacuucuguguuugcuaggccccagcauagucucacaagagacagcuauaucuggguccuuucagcaaaaucuugcuaguguaugcaauggugucagcauuuggaagcugauuaugggauggaucccugcauauggcaaucacuagaugguccauccuuucgucucagcuccaaauuuugucucuguaacuccuuccauggguguuuuguucccauuucuaagaaaggguaaaguguccacacuuuggucuucguucuucuugaauuucaugcguuuggcaaguuguaucuuauaucuuggguauccuaaguuuuugggcuaauauccacuuaucagugaguaccuauugugcgaguuccuuugugauuggguuacuucacucaggaugauacccuccagguccauccauuugccuaggaauuucauaaauucauucuuuuuaauagcugaguaguauuccauuguguaaauguaccacauuuucuguauccauuccucuguugaggggcaucuggguucuuuccagcuucuggcuauuauaaacaaggcugcuaugaacauaguggagcauguguucuucuuaccggcugggacaucuucuggauauaugcccaggagagguauugcgggauccuccgguaguacuauguccaauuuucugaggaacugccagacugauuuccagagugguuguacaagcuugcaaucccaccaacaauggaggaguguuccccuuucuccacauccucgccagcaucugcugucaccugaguuuuugaucucagccauucugacuggagugaaguggaaucucaguguuguuuugauuugcauuucccugaugauugaggauguugaacauuuuuucaggugcuucucugccauucgguauuccucaggugagaauucuuuguucagcucugagccccauuuuuuaaugggguuauuugauuuucuggaguccaccuucuugaguucuuuauauauauuggauauuaguccccuauccgauuugggauagguaaagauccuuucccaaucuguugguggccuuuuugucuuauuggcggugucuuuugcuuugcagaagcuuugcaauuuuaugaggucccauuuaucgauucuugaucuuacagcacaagccauugcuguucuauucaggaauuuuuccccuguacccauaucuucgaggcuuuucccuacuuucuccucuauaaguuucagugucucugguuuuauguggaguuccuuaauccacuuagauuugaccuuaguacaaggagauagaaauggaucaauucgcauucuucuacaugauaaccgccaguugugccagcaccauuuguugaaaaugcugucuuuuuuccacuggaugguuuuagcucccuugucaaagaucaagugaccauagguguguggauucaucucugggucuucaauucuauuccauuggucuacuugucugucgcuauaccaguaccaugcaguuuugaucacaauugcucuguaguaaagcuuuagguccggcauggugauuccaccagagguucuuuuauccuugagaagaguuuuugcuauccucgguuuuuuguuauuccagaugaaucugccgauugcccuuucuaauucauugaagaauugaguuggaauuuugauggggauugcauugaaucuguagauuguuuuuggcaagauagccauuuuuacaauguuuuucuuagacuucugcuaauaccucugauuucucuggugacagaaaugaguauucuaaaccaagaugggcacuguucugauuagcaguuguuuuagacaucaacuuaaagagggagugguaauuuggucacaauuucagagauuuucauuuauggucuguuggcuccauugagguagaauauugcucaaagacacguagagcagaguugccaaccuucugacuucugggaaucagagccagggaaggguccagaaaccagaaacauucucuuagaucccaucuuugugauugccuccaaguaggccuugugacucagagucucgcccaauuucaguaaugcucucaaauaugaacccaucagugauuaaccauugauaaggccaccuuccaaaaauccacccccugaacauuacugcauugggaaccaaaucugcgcuugaaccuugacagugggggcucuagacccaaaccaaaacaccaauuuuuguauugugugaucucuuuugccuuugcucacuagaaucuuauagaaaucacauuguucucauuaacauaaaaauaguaaaacgguauuuuguugugaaacuaaauauuauaguacuuucaagcuacuucuuuucuuaacuucauuucaaacauuuuguguuaaccugauauuaaacuuggauuaaacgugucucugcuuuuguauaauucuuguucggauguugacccuucugucauuagugugcuccuguuuucucucuuccucgccuuucucacgcuauggcccguccugaaugucccagcucucuccugcaucagccuccugagugcuuugauuacuggauucuucucucugccuggcucuggaugucuuguuguuuuguccuguuuuguuuguuuuaguuuuacuuucuuaaauguuuucucuguuuuucuuaaggauuucuaaaaauuucuguuacauuuuaaauuuucuucaguuuuguuguuacuguuuuuguuuuuugaagacaggcuguugcaaaugcaaucuucuuccccuuccugccuuaaccuccugagugaugccucuuuaccuacuaguuuguuccuauguaccucuuaccaugugggccuugugcaaaucaaaugaucauaguuuguuuauuuauauuuaagcugcugagcagcaguuagcaguccauguaacuaugguuauuagucaggauuuuuuagagaaacagaguggauagaaugaauauauuuauauauacauauauauguauauguauguacauauguauguauauguauguauauaagggggauguauuagacuggcuugcauguaugaucuggguaguccagugguaguuauugucccauuggagaggcugagaacccaauaguuuuucagcagucucagucugguguugaaggccuggggauuccugaaaaggcacuggucuucaguccaguagagggcagaaugagguagauucugaugucagugaagaacugcagccgugacagaguagaugaacuugccaccaggguggcaaggcagugccaaccuccuuuuggcuaucaggcugacaccauaacaugccauccacauuuggggugggucuuuccaccuugaauaaccugaucaagaagaugccuuucaaggugugcccaggggcuugauuccagauucugucaugcugucacauuggcaaccaguauucaccaucacaguacaaugaugagcuuuccucugcuuauuacgccuggagcaaguucagcaguugaggaccucuaaccugucuaaagcugugguucuuucugacauaauggccauguccccaaagagaaaucguuccaucucuugaauucagcgagacuggguccaagaaaagguugaagaauccuagagucuggagcuugccccaagggagauugguuggagacgucuuagauuucaugcagagauucuuccuucaucccucccuccuggcacugugcacaguguucucaaaugcaguccucuggcugacucucugaagacauacuuacugcugaguuuaagugucaccugccuacccacuugaacauguaccuaacauuccugagcuucuucagaggaaauuggguuuucuuauggaaccucuaaaguuaugucgccuucuggugucugucgucugcucugcugucauccugucuuaaccuacucuuuauacaugcugugugcaggaaguucagcccagcacugcuaucaguagcugagggcuuacccuugagagaccuccguauaggcaaagcugcaggaaaggauuucaagccaagcaaagcugcuguguuuauuuggacaagggguguuagcuggcuuuaauuuagugugggcaguuaugggaaggaacagacaguacucacucagugcaggcuccccaagaguuguagugaggugucuuuauaauggcuauacuuaaugauucuauggcuuuucaugauauauuucucagaguauaauuuacaacugggauuaaagauuacauacagcuggugagguaguguauacccgcaauucacacacuugugagauggaggcuggaggaucaggaguucaaggaacuuccaggcuaccugagauacuaucuuaaaggacacacaaacacacacacauacauuuugauuuagaaaaaugagcugacuuuacuuauuuuccuucucuuacugaaauuccuuuuaaagauuuguuuauuuuuaugugcagugauguuuugccugcuuguaugucugugagaguuccagauaucuugaacuggagcuacagacaguaaugagccgccaugugguugcugggaauugaaccugggucuuuuggaagaucagccagugcucuuaaccacuaagccaucucuccagccccugaacuccccuuuuuaaaugaacuugcaaaguagauuuuuguuuuuuaagauuuaguuuauguauaugaguacacuguagcuguacagauaguugugagccaucaugugguugcugggaauugaauuuuaggacccucuugcccuggucagccccacucauuccaguugacccugcucgagccagauuuauuacuauaucuaaguacacacuguagcugucuucagauacacaaguagaggacgucagaucucauuacaaaugguugugagccaccaugugguugcugggauuugaacugaggaccuucggaagagcucuuaacggcugagccaucucaccagcccacaagguaguuuuauaagguuguuugucuagauuuagguauggaagaggcauauuacucucuaaagucaagauuaaaaccuaaguaaguauguaguuaguucauuuguuguuuuuaacauccuuguucaacguaacucuuagaaaagagaauaugaucucuauagggaaucuuggcuuuauggugacaaagcuucugacacccaguuagauuuucaaguaaaagauuuguuuucccuuccuguguccacuuuauuuucccucucugucuugccuuaauacuucuuuaaaaaugacuguuagggccaucgugauggcuuugcagauggcacaaagccugaugaccugagucccugggaucagcaugucgagaagcgcgaacaacugccaaacguaguuccucugcuauccacacaugcacuguggcaugugcccacacacaaaguaaauaaugcaugcuuuggguauuaguauuauuuauuuaguuagugguuuagguagggaccauaaggcacaauauuuuuuuuugaaaguauuugauggguauguauauuugcauguauuuauguaucauuuuugguuuuguuuuugaagauggccuuuccuuuagcuggucauacauuuuugauccugcuaucucugccucccaaauucugggauuauagacuuuggucaucacauccaacuuucauucaucaucuugauuccucacuuuaaaacacacugcauuaugugcuccuaauagcuuuuaacaggguuuuucccaguagaggaacuauuuauauaugggccauuccuaguaucuguuuacagguuuuucuccuuauuaaaugagugaguguaggagcugagagugggacaggcaguucuggggcuguuucccacagcuucaacacugaucagguuucuguuuguucuauuuggaagagggaguaagguaagugaugguuuuaauguagucagugugagagggaaagggaguugagacaugcuuguccucaugcuguagucagugugagagggaagggaguugagacaugcuuguccucaugcuguagucagugugagagggaagggaguugagacaugcuuguccucaugcuguagucagugugagagggaagggaguugagacaugcuuguccucaugcuguagucagugugagagggaagggaguugagacaugcuuguccucaugcuguagucagugugagagggaagggaguugagacaugcuguccucaugcuguagucagugugagagggaagggaguugagacaugcuguccucaugcuguagucagugugagaggggaagggaguugagacaugcuuguccucaugcuguagucagugugagagggaagggaguugagacaugcuguccucaugcuguagucagugugagagggaagggaguugagacaugcuguccucaugcuguagucagugugagaggggaagggaguugagacaugcuuguccucaugcuguagucagugugagagggaagggaguugagacaugcuguccucaugcuguagucagugugagagggaagggaguugagacaugcuguccucaugcuguagucagugugagaggggaagggaguugagacaugcuuguccucaugcuguaaucagugugagagggaagggaguugagacaugcuguccucaugcuguagucagugugagagggaagggaguugagacaugcuguccucaugcuguagucagugugagaggggaagggaguugagacaugcuuguccucaugcuguagucagugugagagggaagggaauugagacaugcuguccucaugcuguagucagugugagagggaagggaguugagacaugcuuguccucaugcugucucacagcaggacucugcucugugccgugagaaagggcuguuuguugugacagaaaacaugaggcucccaucuucucagaagccugcugagcacccgcuccaagugaugcauagaacaaaaccaugcucagauuggccuccagauuuggcuuucauguugaguuuaaucuuugcuuacaaaauuuggcgucaaaguuucauugucuucauugucuuacauuucucaacaaacaaaaucaacuugauuuguaugaaaauauuuuuuugaaaacaaacauguccuuuugaaauuacuauugacuuaaaguauaauuuaguuggcauaacagaagcuguaauacacuugaaucugcuguaauguuagugguuuucuuagcuggagaagacuuugaaggagaaaguugauuuuaaaauuguuuuuucaggauuccugaaauaguuuauuacuuugucuuccaacaaaaacugcaguaauauuauagucuuucauuuaaucuaaucuggagaagucucagaaacuggaauccucauguuuacagcuaaaaauuacaaagugcaugccuuuaaucccagcacuggggaggcagagccaaacagaucucugugaguugaaggccagcuuggucuacaaagacaguuccaggccagcugagacuuacacagugagacccugacucaaaaagcaaacagugggcuuuacagcuauugaauagagagagccagcugcaucuuucucaaaugucuucgcaugugcuugggucuacuggacgcuccaaucuuucgacuuuuccuuuuucaggaagcugcuuccaagccugaaaaccaaaaagccucgagaacuugugcuggugauugggacaggcaucagugcugcgguugcaccgcaggucccagcccugaaauccuggaagggcuuaauccaggccuuacuggaugcugcuauugauuuugaucuuuuagaagacgaggaaagcaaaaaguuucagaagugucuccaugaagacaagaaccucguccaugucgcccaugaccucauucagaaacucuccccugugaguagucugcugucugccauggcaugugacauuuccugaaaccgugauuaguaugcuuacuuagcagggauauuuguuuauugcuguguauuuauaacauuuggcucuucugaaaaguagcuauuuuuagagccuguucgggguaaucauccugaccccuuuucacugugaugugcugagaacuuuguguauggagucaaggguacugacacacuuuugcuguuuucaacuuacuuuuucuauucucgcuauaaacaauguccuggcauccaugacuuuaaggacauauuagaaagauuuagguugagauuuuguguuuugagaaagcaucuugugcaucgguacuggccacaaaccugggugguuccuggguguuaggaguauagauaggcaucugcccuugccaaacuggagacacuucaaaaaguaguacucgcuuaugcuaguacuaguuauaugugcuagaaauguuaccucagugaaauccaaaggguauugauuuccaggccagcccugugaucauaacaaugccaugccacacagaacacacacacacacacacacacacacacacacacacacacaccacacgggcagugagcaauuguuagauacuuacuuagaauguuuauaugcaaaggcccuagguuugacccucagcaccaucccacucaaaauuuuuuggcuacuguauuauuuccaaagauaucguaaacugcaccuugggaaaagagggggagggggcuguacuuacucuuuaaaaguuagcuaccagaaaccagguggugauggcagcaugcaccuuaaucccagcccucauaggguuagagaaguugaggccuaaacuucaaaucaaguucuuaaaacacccagcagaaauugacugagggaaacaucuuuuaaugcagccagauggaguuuccaguagggaauccugggcaaagcagagugccuccgcaggugaggcuuccaaaccaagaacaaauagcagcagauauagagcacauuaucaggucacucaccggugcucaugauacccagaggaaacagacugggaagcugagggaguccacauagacucgcaguugagcuugcuuucuguggcugagcuucucauaacuggacuuccagccacucucucuuuccugcuguagaugcucucuuaugggaucaacaguaguaacuucuguugggaguugcugccuuacuauucugaagagcaugguguuuuauucuugggcuauuuuacugcucuucccuaucacagaauuaugggggcuagccugucuagcccagacuuggaagacacguugaaacaagugugcuugggucugaaauagcggagcugcucagugaguuucagcaacaugugacaguuuaccagucguguacauuguaccucccagugucucuuaugaauaucaaugcaaggaucuuuaaagggauagauccuaacuuaguauagcauauaaaaaagaauuguacaucaugagcaagugugcauuuuccuaggaaugcaaaguugauuuaacauguaaaugucaauauaaaguacaaagaaggucuauagacaguaaguaagaauucagguauguauauuaaagggauuuuuuugguuguugagacaggguuucucuguguagcccugacuguccuggaacucacucugaagaccagguuggccucgaacucagaaauccaucugccucugccucccaagugcugguauuaaaagugugugccaccacuagccagcucaaaggaauuuuuuuuuaagacgacuuaucuuuauuuuuuuauacaugaauauguugucugcauguauauuuguauaacaugucuauuugucuggugccuguggaggccagaagaggggcuuaguuucacuggaaccaaaguuacagaugguugugagcuggaaguuaccauucaugugagugcugagaaucaaaccuggauccucuagaaaaguaacaugugcucccaaccacugagccaucuuuccagcccaggagucuuuaucuuuuaggaaaugcaacgaaguaugggugagauuauuuaauacuuugauauugacucccaacagcucagugaagauaggaaaaacgucaugaucaugguuaaacuagauuggccauaugucaugauuguucacauugggugauugguacaugguggggagaggugcucauuuauuuauuugcuuuuuuauugcagugcuguggacugaacuuuucacaucuuaggcaggugcucugcuucuuuuguuuauuugggaaaaugucaguaucagaaaagaauguuagauuucuuuauaguaacacaacaugguuaauuggccccauugauugauccagcuccauguaaugaaaaaaugacauugugaagucaaggcagagagcuuagcagucagaaacggcaagaucuugucaucuaaacgcccuggaauccucggcaaaucaacugaccucucaccauuugcuuuuguacaguaaaugggguggggggaagauuucuggggucacacacugccuagagcaugauugagagguuggauccucagcaccaaagaagaaaaaaacaacauggccuuacuuuuucaugugguuuugugaagaauaaguggcauuagcaaugcuugccugacuauuugaacugaaguuggaggggcagagcagccuaaacacccuuuuucaucaaacaucaguuuuacuugaaaaaauggaacuagugcucaaaauaaacacaguagaaaucuuagugaccuugaaggagauggggucaggagggcuuagguuugcuuuuacucuaugugggacuagaaagaugaauuacgggguaaaguacaggaaauaguaugagugaaguggggaaauucuuagggucugagugggagccuaacacuuccuuuccacuucugaccucccuguuaugagaggccacugguggaaaauuuaguucuaugguuaccugcucuaagacaaaaacuuuuauuucaaaucuaaggaaaucaguacaaaaaucaucuuuguuauuuguaaaacaucucaaacauucaguuuaccaaaugaaggcucgggagccagacacuggggugaaagccugcuagcucagagagacagagaaagcacccagcugaccuuccuccucaaccaacaucccagaagaaaaaaacaguucuccuuuucuaugcugucuuaaauaccuuucaacucaauuagacccucccuucucuuuccuggguuuuuaauguuaacugguugcuugcucugccucuugaucuaucauugacuuuacuuaccucuaguuuacagaaagcugucagguuaaagguguguguuagggcugagccacaccacaacaagaaacagauuuuuuuccaguucauagucuuaagguucacagugugaucaaauauccuucaacacaucuuuccagccuggguuuacaccuuucuauaaucccagcauugggcaagcuagaagaucacaaguucaaugcuacccugggcuagaaugugaggucacaucuuaagagagaacaaacaagcagaaauccucaugcuuuuuaauauugcucuacaagguuugauaacucacaaaaguggacuaaaagauauguagcuaaggcaagugacucauggaauuuucgaguuucagucuucucauagaaacagaacaacaacagcaacaaaacaguugauguucuucacccaaggcuaacuuggggucuaccuaugcccuucuccuugugcucauaguaaccaagcuaugggaauauaguguguaugauuuuauauaugcaugggccaaguacaauauggaguuacaaaacacaacaaagaacuucuuaguaagcaguugcuguauuuauuaaauuugaaaccuaauucugcuguuuugaauaaguauugauacauacauugcaaaaaucaaaaggagguauagcugucuauaucuacugacauaccuuguuucuguugauguaucugcccucugcccuaauccaucauucacaguuuuuauauguacccuuccagcuuugugaauguuagcagaaauguaugcaucccuccuucacgguugccaucucucaaauaacacauacuauccucuagcuugcuuuaccuaacaguauauugugaucuuuccauaccauucuccuguauacagucuguaaggcaauguugucacgauggccaaauuccuaguuagcuucuaaaaagaagggggauggauagaaggagguuucauucugugguuaguuaucccuguuguuuugugcuuguggugagauagugagauaggacuucucacaauuucuuaauggcacaacuuuuguuuucauaucuuugauacuuugggcuuuggggacacauuaaagauccaaaugauagguuaugguucugggcaauaccagucuuccacuguggauugguagucuguugcuauuggagcuaacaaagcaguggcagacguguguauauauacgucauuuuaucugaugcuggacugauaaguaagagagcauucugcuuccuuaauaauaaucuggagcuagcauuuaguagcgguugacuguuuuguguagugacuaaguaacuagaguuaauacucauuacuguuugguaaggaguagauuuuuaaaauuuuacuuaguuuuacuuagauguauguaugcauacugugugugugccuggguccucuggaagucagaagaggguaucagaucccuuggaacuggaguuacagaugauuaugaacuaccauuuggaugauggaaaucuaaccugaacccucuggaagagcaacacguguucuuaauaacugagcucucucuccagcccugucuucacuguuuggucacguuauuaauuaaguacuguuagaguucccuauugacugccugugugccauagugugauagaauuguaauuguguagugaaacuagauaaacuuuggagacugugaccuacauucuuagccaaauaaguuauagaucccuccaucuauuuacacacuaggaaagaaucccuuuagcugaugacagcaggggccaguaagaagccugugcuguguaguagagcaguguagaaccauaucggacagagcccauuaaacuauggcuuguuuccaguaggacaaggcauaauuuuaacuguguucuaaucuuuucacugaggaaauagcacuuauuugguaaguaaugacaaaaaaauugguuauuucauaaaaugcuguuacauuaaaaggaacauuggcauguguuuauguaucugcuuaagugauuccauggaaacugaaacauuucaauauugauagacaaggaaaccuggaaaguauaggagacuacuucaagggaaccuagaaggagcugucuauuccaaggaguuuuaaauguuacucccuggcagcuagaugcaguaacuuacagcuucaauaggaaccaugcaugcuggcuugcaccaguagcccuagcuucucuggaugcugagagaagaugaucauuugagucuaggaauucaaggauagcuugagcaauguagcaauucuuccucugagcuuaucuaaugauauaauaucaagaauagaguaggaaucagauguuuguuaaaauauuucaucuaguuacuuucucaugucaaauuucuuuuguuccagggucacuguauccuugguuauaaaaccaacuucucacuugaaguugguuauguauuuccucaguccuuagggauauaaacucauucauuguuuagcagugguauacauucugaaaaacacguuauaggccuuguugcugcuaugcacacuuguagaguauacuuaugcaaaucaagauaacuaugauaucauuuagaugauaaguugccuguuguuaugcagcagaaauuuuauuuacauacacccuaaaugaagcuagaaagguaauuaaacauauuuuaaauggauuauuucaaauugauuagugguuaguauuuauuauuauuuuagauuuuucuuuuuuugcuggcuauccuagaacucacuauauagaccaaucuggcuucaagcucacaaaaguaugccucuuaaaugcugggaaugaaaguguguaccacuacaccuaguucuuuuuuucuuuccuuugcccuuuuuaaaaaaaauuuuuuuuaauguuauaugcuugaguguuuugccugcuuguauguauguguaccucauguaugccuagguucgacagagggcauuagauccccuagagcuagaguuacaggucguuccaagccaccugauguggcgcaucaaaugcucuuaaccacuuagcuaucucucuaguccaguuaauauuuauuuauaacuguguauaugugggugcaagugccuguggaguucagaagaaggugcugaauucuuuggaauuggaucuacaggcaguugugagccaccuggccuggauacuggaaaccaaacuuagguccucugcaagagcaguacacaagcuuaaccuuggagccaucucuccagucccugaguuuaguacuuuuaauaacugauagccauggauauaauccaucaguacauacccaaagcucugggucccauccccagcacuguaaaaaacaaauaguugcaaaaugcaaguuuuuaauuaugaaguuauuuuaaaucuauucauaauuuugcuguguaauagguauucuuuauagcaagccuguaaacagauugcugaauuaggucaggacagaacaauacaaggaaguauuagauguuuuuuuuuuuuuuuaauuaagcagccaaauaucuagaacuagaaaaagagaugcuaguggauauacaggcaguucaagugccuguaaccuagcacuuggggcuaaagccagaggaucaugaguuugagaccagugucaggcaacuauauaaugaguucaagcuagcauggacugcauauuguucccuacauucccuauuuucccucugucuuuguuagguuuucuguuguugugauuaaaacaccacauccaaaaguaacuuggggaggaaagggguuuauuuuagcuuacaauccauugucccugugaguuagggcaggaacugaggcagaggcauggagaagcgcugcuuucugguuugcuccucauggcuuuaucagccugauuuuacuuccuucuuuacuucuuucuuacuuuccucuguuuauuuaguuuuuuguuuuguuuucggguguuuugcuguuuuguuugagacagucagucucucuguauagucuuggcuguagaagaccaggcuugucuugaguaucacugccuuuaacccccaauauggggugggcccugggcccucccacaucagucauuaaucaagaaaaugcccuacagauuuaccuaauuugaggguaauuguuacuuugcuuucuaucuucaucccuuagucaugaucuguuguccauuugcuucuuuuuauaaaaugacaaauuagaagcaggcacgacagcacauguaaucuuagcacuugggaggcauagacaggaagauggcugagagugaggccagcuuggaauucuagcuggaauucacaaagugaauucuaggccagccaggaauccacaacaagacccuuucuuucuccaguucuaaacugccuauuuaaaaggcuugugcugauuugcaucugaugugguaguacugaucacuuacuguuugcuaagcauugcauuuggcaugugccauccuacuuuauuacagugagagugauguuuuaaguauaaaguauucaaaauguguaauucugcaacugaaacaaguuaacaaagcaauuugaauuggguuuguuugucuuucaaaucuuccacaccuacagcguaccaguaauguucgauccacauuuuucaaagacuguuuauaugaaguauuugaugaccuggaaucaaagauggaagauucuggaaaacagcuccuucagucuguucuccaucugauggaaaauggagcccuaguauuaacuacaaauuuugauaaucuccuagaacucuaugcagcugaccagggaaaacagcuugaaucccuugaccuuacugaugagaaaaagguaaaauguuaaucaguaacuucaggguaguggauuguaucuuccucagaaaagcugccuucuggucauuaugcuaguauuuauguagcagggguguuuuuacucuucacauugcuaugaccagaauacccaacaggaacaaccagaggaggaaaggcuuacuugagcuauuucauggaguuuugggccucacaguaaaggcacagugaagaggcucccuuuuguggugggagcuagaaaguggaccauaaucaagaccagguuuuaacaucauaaaucucuccccuaguggucuauuuuuacuagcaaggccccacccccccaaaagugcaucaugaguugggggccacauuuaaaccauaagccuauggcagauauuucuaguuagaauaguaauaguaagaaagaaacugcucuuccugcuuguacuuuugggguuaguuguguuuugagguaaaaucgguauacaauaaaauacaaagauuuuuaguuaugaauauugacaguuuuuucugaucauagggagggauuaguuaauuaaaagacuagagcagugguucaguuaguauaugcuugcacuauuaugaaguauggccuuguuggaggaagugugacacuguggggguggacaauagauccucuuccuaaccacaggagagccagucuucuccuggcagaagaugaacucucagguccuccugcacuaugccuaccuggacauugccauguuccuaccucaauaauaacugacaaucucugaaccuguaggccagccccaauuaaaucuucuaagaguugccuuggucauggugucuguucacagcagugaaacccuaacuaagauaguugguaaacuugugugccuuacaagcacaagguuccugggcuugcaggucaguuaucuaagcaaacuuugggaguuccaagccagugagacaaagaacagagaaauccucccauucuugaucacuaacugaggaaaugccuuacagcuggaucucauggaggcauugccucagggaggcgccuuucucugugauaacuccaacuuuugucaaguugacacacaaaaccagccaguacaauugagcccuugucaacuugacacacaaacaucacuaguaagacucaacccuuaccuuuuuauucauccccaagaucuaaauaacuuuaaaaacccacagucuuuacaaauucuuacauauuaaaauuucaaucccuuuaaaauauccaguaucuuuuaaaacucaaaguuuuuaaauucaaagucucuuaacuguaggcuccacuaaaauacuuucuucaagagggaaaaauaucagggcauagucacaauugaaaggaaaaucaaacucugucuaaugucugggaaccacagucacucuucugugcuccuccaagggcuucuccagaucugcccuuuguagcacacacuuugucuucuaggcuccagcugccuguauuccacugcugcugcuguucuugguggucaucucaugguacuggcaucuucaaaacacugcugucuuccgcugcaacuaggcuucaccaauggcucucaucguggugucaagcuucaacuccuuugcaugaccccguuaguccugggccagccauugcaacugaggcugcaccuucaccaauggccuucccuggccucucacagugccgagccucagcugcucuucaugacugcuuuaaugccuucaaaaccaguaccaccugggugacucuuacacauuaccaaguccugauguagcacgagguacgaccuugacuaucucuugaacacagccucugugcucucagaaaauauucccuagaagauuucaccucaaugauucuagucucuucuuaaucaccacuaauuuuuuuuucuuuucuuucuuucuuucuuuuuuuuuuuuuuugguggagacacgguuuccaccacuaauuucuuagcuccagcuaaccagcaucaguagucccaguaaugcaaagguuucacuuuaguaguucugguaucuuguuaaucauagcugauuuuucagccucagcuaaccaaaaccacagaaucuucacaaucaaaauaacagccaggagucuuuaaucuucccucugaaauugcacaagcuaggccuccgucuucuguacuguuuucaauauuaucuuccaagcuccuacagaacaucccacagagcucuuaacaucccaagggcucuuguagcucaaaguucuaaaguccuuccacaguucuccccaaaacauggucagguugucacaggaauaccucgcuauacugguaccaauuugucuuaguuaggguuucuauuccugcacaaaacaucaugaccaagaaggaaguuggggaagaaagacuuuuauucagcuuacacuuccacacugcuguucaucaccaaagaaagucaggacuagaacucagcaggucaggaaucaagagcugaugcagaggccauggagagauguuacuuacuggcuugcucagcuugcucucuuauagaacccaaggcuaucaaucagcccagggauggcccucccuccuugaucacuaauugagaaaaugccccacagcuggaucucauggaggcacuuccccaacuugaaggcuccuuucucugugauaaguccagcuuuuaucaaguugacacacaaaaccagccaguacaacuacagauuggggauugaggcaggugugguggugcauugcuguaaucucaggugagaagauuuaaaguugaaggccagccuggauuaaauaaugagcaaaaacaggauguaaacaguugggcauagugguacacaguuuuaaucccagcacucaggaggcagaggcagguggaucucugcauuugagaccagccuggucuacauaagaguuccaggacagcuggggcuucgauagaaagauccucuggggguuggagaagagaaaaagaagagggaggaggguuguaccagggcuuggaccauucauuaccaguggaaacuaucauucuucaaauaaugugagauucuaguuucugauaguaacuuucaaagagaagucacuagauuugcugccaucauuccugacagucauaacauagaaauuggacacaccagguuuucaaauucuugucccauggcuguaguuaugucaaaagucaagggcuggugagauggcucagggguuaagagcacugacugcucuuccgaagguccugaguucaaauaccagcaaccacaugguggcucacaaccauccgaaaugagaucugacgcccucuucuggaacaucugaagacagcuacaguguacuuacauacaauaauaaauagaucuuuaaaaaaaaaaaaaagucuaguccucaggcagccucuuacacacugugacuuugaagcaagugccacccuggucaagcuguguaugaauugugcagguccuggagugggcucaggagaagcggaagcuaagugugcuacacauccauggggucuacaccaauccuagcggcauuguccuccacccagcuggauaucagaaugugcucaggaacacugaaguuaugguaaguaguacugggcuugacucuggaagucacuccugaagacauuuuaaagucaauucuauguauuaacaggauauuuacuuuucaaaacaacuagagagucagaccuuccuucguugucucuugggugugcauaccauccuggggaaugcagaaacuuuaugugucagaucauaggauugguaugcacucccucuuugucauuaccuucacauaucaagaaugcauuagucuccuucaucauugggcuucuuaauaagucuaugcccaaaauaauuuaggcagcuuuuuuaaaauguuaaaucauagauuauaaaacagacccuuuaccuacucacaccugaguauacuuggaaaauuuggaaaacaauuugauuaggaugacaaauuggagauuuucuucuuuguguuugcugaucuuuggguuucaaguuuuggacuuguucacauacauguacaugucuaauaaaacagaaacacuuuuuugguccagcucggugcuagagguuuucaggacagagucacauggaguauuuacaggccagagccagagaaagaccaggaagugugaugcuuucugaaguauaagggcuuuauccuucuuuaaauaugaccaucauugauauugaggaaaaucauuuauguuucagcuugugugugugugugugugugugcguauguguauacucuaugcacagauacaaauguauauacacaugcacagugguacuuuaguaaucagacuuccuuuaacagaauuauguuuucugaugcucagugguucuguuuuaaggccaaucaagaacaaguucgaggacuggcaagauugcucagugggugcagcacuugccacacaaugugaggagauaguucuagcccuagcagugauaugaauaccaaggacaguguaaucccaacacuuggaagguggaggcaggaggagauccuccagaucagcugucuagucaggcuagaugaaucuacaagucagaguccaaguaagagaccugccucaguauauaaaguggagagcaauagaaaaaaaauuuuuuccaacaucaaauucuggccuccacauauuauauguaacauguauauaaacauacauacucaaaagauuuaaaauuagcaaauuuuguucagaaaguggaaaagagguaagauacaucaaagacuaauuacccaagaacauaaaucuuacaaaaaauuaaaccugaaagaccagugccaaaggggugaaacuguuuagaagaccuacagaaggaccagacagauggcucaguggguaagcacuugugcaagccuugcagucugucccuggaauccauguaaaggugggaaggagagaaaugacuuuauaguuguccuuugauuuccacaugcauucuaugguaugguauggacacucauauacauacaccauacauacaaaauaauacuuuguuuaaaaagaaaacuuucgggcuggcaagauggcucagcggguaagagcacugacugcucuucugaagguccugaguucaaaucccagcaaccacaugguggcuuacaaccauccauaaugagaucugaugcccucuucuggggugucugaagacagcuacaguguacuuacauauaauaaauaaagaaaucuuugggccagagcgagcgggaccagagagagaagaaaaaauguuugaagacaacuagaguguacuuacauauaauaaauagaucuuuaaaaaaaaaaagaaaacuuucagaagaauaucagcuaaaaaguacaaucuuagaccagacaucauauugucauaacuaggaaauaaaaccuuguaaugauuucccucuuaaaucuugaucuguggguuucugcaguaugcuaaaugacaaacuguugacuuuugcuuaagccauaucaugugucugucuucugagucauuaacauguuguucucuuuuucuugaagagagagauucagaaacucuaugaaaacaagucauuucuuuucuuggguuguggcuggacaguggacgacaccacuuuccaggcccuguuccuagaggccgucaagcauaaaucugaccuagaacauuucauguugguucggagaggagauguagaugaauucaagaagcuucgagaaaacauguuggacaaggggauaaaggucaucuccuauggaaaugacuaugcugaucuuccagaauauuucaaacgacugacaugugagaucuccacaagaggcagaucagguaagggaaggccaaagagcaaugacccuuuguuugugaugaauaaaaacacuaccaagauagggaauguauaguguaugaccaguuugggaaggggugagagugccauuuugauaauggggaaagaaaaacaugcaaggauucuuaucuucaagucaacuuuccucagcacuugcaucuuaaaauuaagccaggcuaccugaauucagucucuuaaccuacuuuggaaaguaguccuaaagugguccuuugaccgccauacaugugcucuggcacaugcaugccccacacucacacacucagacaugcaucacacacacaauaaaaaaaaagucacugaagggcuguagagagaugguuuguuguuaagagcacuugcuguucuuccagaggacccaaguucaguuccagcaaccacaucaggaggcucacaucuucacacacacacauuuuugaagaugcuuaguucaagugagaugcaauuaaaauuuagauuucaaaauguagauagaugaccauucagccuuggcuaaguuuaucaugaaauauucuuuauauaucaaaaacuuuuaaaaccuuauuucagaaauuccagauaauuauaauuuaucccauaagaaacuuuucccuuuuuuuucagagcugaggaccaaacccagggccuuugcacuugcuaggcaagugcucuaccacugagcuaaauccccaaccagaaacuucuccuaaagaaauguguuuugcacaugcuguuuaagauaucaaguguaaccaaccauggugguacauaccucaugguauaaucucagcccuuagaagucuuuggggcuggaggaucaaaaggucaaggccaggcuggacaccauagcaagaucccagcuugguggaggagccugggauuuagucauucugacucucuaauccaauucuauagacacagucuugcuauauacucuuguuaaagaaccaugguuuuguuggguuuggggguagggguggguaggaggauuuuuuuuuuuuuuuuuuuugcuuguuuuguuugauauagagauucacuagguagcuuuguuggccuagaacuuguguagaccaggcuguccucagagaucuaccugccucugccuccugagugcaggcuuugaguuacuauguaguccaaguuggccucacacuuugaauccuccugucucaacuguacaauucuagcaacuacaaacauauucccacuaugccucaccugcuucaagcuuuuuuauauauaauuuauuauuuuauagucauugguguaaugcgugugugaagguaucaaaaguccuggaacuggacuccucaggcaggugugagcuucuauguggacuaggaauuaaacacagguccucugaagaacaacuacugagccaucucucuagcccuccuucaaacauuuaauauuuuaucaauuugaauguuucuuagacaacacaauaaaauacagguaaucuaguauguaauauccuuaaaucuagucccagauuucuuuucugaaucagaugacuccaaggaaaauccuaacguaguaaaaauuucuuucaaguucugucagagcaaugcuucgauggaaugagauuuuuuuuuuuuuuuuuuuuuuggcuuucgaacaggguuucucuguguagcccuggcuguccuggaacucacuuuguagaccaggcuggccucgaacucagaaaucugccugccucugccucccgagugcugggauuaaaggugugcgccaccacgcccggcuggaauaagauuuuuuuuuguuuguuuguugguuuuguuuuucaagacaggguuucucuguagcccuggcuguccuggagcucacuuuauagaccaggcuggccucgaacucagauaucugccugccucugccucccgagugccgggauuaaaggcgugcgccgucguuaucacugugguggcucauccccuguaaucccagcauuuuggaggcuaaagcagguuuguugagaauucuggacguuuuuugaguuuguugagagugcugggauuaaaggugugcgccaccacgccuggccugauuguuuuuuaaacuagggacacacacucaagggcuacagaaucgauccacacugagauccucuaccagaaagaugcuauaauaaaacaaaaucuggacaacaguaucuucugcugcacucaacuuuagguuaacauccugaagguuguggaaugguacagauagcuauagcuaacaggcucucuagaguggcuguccacaguugccagucaagccauucuauuuuuaaaucaaagguuuuccauaugguauuauuauaccaggaaguaauuacugauuuaaccauuaauaaaccucugauuuaaccaguacuuuuuuuuucaguuaugaacaaagcuuauuagucuuguguaccuuuuuagaaaacaaaaacacaggguuuuacucuguacucucuauuuuccugaaaauagcucuguaauacagacuggacuugaacucaugaucuuucauaauccuuacuccucuaagaccuaaguuuauagacaugcagcaccaugcccugcuuugcauuuauuaaguacauacauauugacuacaugaaauauaacuagugaaauggagauguaauuuuuaguucagauuagcugugugaaccuguugggaauagaguaagcagccaugguuuguauguaaaauguuuuaggggcuagagagacagcuaauuugguaaaagcacugaauguucuggaggaccuguguucaaaucccaacauccauauggugguucacaacugucuauaacuccaguuccaggaauucugacaccuucuucuggccucccucggguaccagccaugcacauggugcagaaacauaugcaagcauagccauauacauaaaaaauuacucuaaaaaguugaaacaaggguuuuuuuuuuguuuuaacaagcagucuugcuagacauccaacuuccaggaaggcuagagcuuuagaggguuuggaacuauaaccuaacauggcaacauagugagauccauccaaacaaaaagcaacuuuagugcaauaaggagucuaaugucccuguuugauaugacugucugaagguuauucuuaaccucaccuugugucaguccuaagugucucuuuagcugugcccugagcuccccuuaguuuucauuucugccauuaauaguuuuagcuuucccagggacugccaagauaguuauggguaaaggcauuugcugccaaguuugacgaccugaauucuauuucugcaauccacauaguggagaaaacaaacacucaaaaguuguccuguguagugacauuuuuugaaaaaguuucagcuucaucuaaugucuauaccaauauucucuuuuuagcagggauggcaagagaaggucagcuaaaugguucaucugcagcacauggugaaauaagagguauauuauuuccuauucugucagucauauuauagggaauuauaauuugucucuccuaccugucuugagauucuuugaaucugcucuuucugaaaaguuaggacugagugauuuaaacaccugcagcuucagauauguagacuugcucuauggaacuuuauugucuuuuguuucuccauaggcuguaguacuugagcaagcuggagaaaucaccacuagaccaugcuguggggccuuccuguggauguguuaacaagcaaacuugcaagaacucaacagagcucccaggaaguaccaauacccagaaguugaagccugggguagaauagggguggcaguguugcaccuucccuucaugcuggcuguuucuugauacucugcugccugguccaguuuaacacccaaugacaucaggacccaaugcagcuccuaccuaccccaagacuggacaggcuuaucuacacagcagaccaaugugaugacuccuggcuauggcugcagcucugcaggacuugaggagcaagaagucauggagucagugggcucuuguugcaguuuuguacuccacuugguuuuucaauugagcuuauggcuuuuuuaaaacaugacuugaagcucuaguuuucuagaucuuuuacaguguacaguauuuuacauaacugagcuguauuaaaagcuuguucauuuacuugccagaacucuggcucuacuuugaagaguuacuguuaaaaacuggcauucuucuauuuucaucauaggguggugauccuucucaggacaggcacuuacccaauuccuuagagcacuacuaguuccuaucaugcccuugccaaaaagaagcucaagaacuauauaguuaguaugaguuagcauucuuauuuuauauccuguauaaaauaauaugaaccuaagaggcaauuucuuuaugaaauuuauuuucuuauauaaauuauguauuucucugggcagacagccuucaccuuauugcacuaguagcacaucuguaauaccaaacuacaggacaagucuuaacaagagguuuguguucuucaacguagcacuugucuaccaggcacuguagaagagaaugaggaaaagccaggaccugcccaggaggcugagggugggguggguacgggacaacaggaauccuucucaacaaucccuuucucccaggaaggaaacaugcaaagcuuccaucuagauuuugggagcaggcacagguuggaaggcaacucugcuccccguguuucugagagaagugggcacucgccuuucacucauuuguaacaaggccuaacugaugcuuuggggcaacaaucggguguagaguucaucaccagauuuauaauuagcagcaauuaagaaugggccaccaucacugccacagugagguggcugucauccugacaccagggacccagaagcuguauucuucuagauagaugccauuaagauccagagcuggcucuggaauuaagccauuagagcugggaccucaaacugcuccuuaucucaccauggcucugugaucacacuaguuagcaacacuccagguguuggguuuuucaaccauuggucaaagcuaugauauggagucuguaggcagagugaaggggaugccugaguaggaagagggagggucauugggcagugauuguaacaugauuaggcccuccuugcagaaggagguagggcugaacaaaggauuggguuagaaggagcugcaagucuccaaagcuccccucacucugccuuuguacuacacugaagacaaguugcucacauacucuaaagcacauucuugauauaggaauagggacuuggggcaagcggcgauuugguauuaggcaagagccacauuaagccuucaugagggcagccaccacagccuuggcauuaagacugcguaggucacaguaggucuggccaguacccacaaagacgauggguuugcuugugauguaugucauagagauagcagcucccaccugaagaagagaaaauggauggccaaucaaucaacucaagcccuguuuucacucaacgccuccauuuccuuuaaagucagccauuccuccuucccagucucauuauccagucauccacuuuuaccuugucaucaauggugucaaauuugguaagaacaaugccaucaaugagccgaggugucugagccauagaauggucagccaaggcucuguugaacuugaccuagaaagugaaaagguaacauaagaacccaucuaauuugccaaaguuuaaguucuaaagggaacugggcccaaacccucucaccaguugauccacagcuucguugccuacuaaggccuccccuacaaacagcaccaagucagguguauugacaguaaugaguuuggccagggcagucaucagaggggcauugucuugcaugcggccagcagugucuaccagcaccacaucaaagccuugguuacgugcuagaaagagaaaagcagucaacuccaagcaaguaacucacucacacuaccaacuucucaagacuuccuacacugcuaugugaaaagucacccaacugucacccaugcucacugccagcuuccuaagauguccaaguguggguuauuugaaaagccuauccuguuuacuugcccagacucuggauuugguuacaagguaacguaaggaaaaaccuguccuauucuuggccaccaccaaaaccauucagggaaaggaaagaaguaggaaaaagaccacauucagguuuacaguuaggauacaccagcuuuccuuuacacacauuacuacccaaaaccacccacacaaguaauuuacccugacuucucuaguaauagccuuagucugugcaaauucccaggacaaggacacaagcccccuugguccccacacuguaccaaaggcaauggcuuccauggcaaugccagcagcguccuugccauagccuuuuucaaacaacugcaccaucguacggccaccaugcuucucggggggauggagggcagucaggcgccggguguguguacgaagcugcucaacagccccagcccgaaauguaucacaggcagcaaugaggacacuaaagccauucucuaaaagccaaaaggaaaucugcaaaaaaguuaaagaaaacugucaccuagacccaggauucgaaagcacaggguggaaaagcaggcuguggaacugagcugaccuuggcaagauugguagacuucccuacuccauuaacaccacagaagguaacaacauaagggcgcuggcgacguugggcauccaugauaucccggagcaugucuacacgacgcuguggcuguaggaucuguacuagagauuccuggagagcuugcuugacuguugaagucacagcuuaaaagggggauggauggauucaaucauaaagucaaauauacuugauacccaacaucuuucugaacuaauggaguuaagaccauaguagguuuucccucagaauucagaucacacuguucuauuacuuuauuaucucaauuaacuguccuguuagguccuaaaggcuguucuaucauagaaguuugggaacucaaacaugugugccaaaaggcacauaccaaagcugucugacugcaucaccucugagacgcacgagcacuuugugacuuguggagauacuuacugcuaaauguccccaucacuuucccuucuaauuuguuggcaacagauucacagagcuggacagcaaugucagcagccacauucuuagcugagaagagaaggacagcugugaguuccgagcuaacaaugaucgggucucaagagcacagcuuagaaaaugguucuauuccuaaugaacuaugucauaguccgucagucaagccaguccuccagacucaccaaugagaugaucacgcaucuugucuagcacagauuccaugucuucucgacucaagcucuuggaacccaccagacccuucagcaucccaaacaugccacccagaguucccuugguagcacuacaauuacagaagaucacaaguaugcguuaggccagcaggcaggagguaugggucaucaauucugcauccacaccaccucccaccugaaauccuucuaccuaggcuugguauuuugaguggccccuucaucaucugagcugcugcaauccagaucuugaagcugucccccaggcccaguuccucgaaucuagagaacacaggcaaagaaaagaggugugaucaagaacacuaacagcugaggggaagagcccaggauauacccuggcaacauuauuugagaccuuagaaaaacccacauauaguucauuccucucucaaauccagauauacccuccagauguuuccuucccaauuucuggccaauggugaucuucacucugaccuuuaugcaucuuaccaaguugauaucuucagaaagggcugccucuggaguuccauugguggugggaguacuguaauccaagacuuccuuguuagcacagccaccuaguucccacacccggggugcuuuuuugcccuucuccuuuggaguaucugacuuuguagauuuacugcaaaggaugacauaggaaggaacaugagaggagaguccccuggccccagcacagcuggguaacagucaccagagacaggguaacagugcugaccuggauuuguccagacccuugccaugcuucugaaugaacuccucucucuuccuacggaucagcuccucuuuggaaaguucuccauucucaggucccgcugagagaccugacuuuucugcaggggcuguuuugcuaguagccaaagugccaucagaaccuguuaaaagaaaccucacuggaggaaaagaaacauaaaucccaaccacccagguaauaacuacaguucuuccaaauccuaaagagcaacuuggaccaaacaccuuggagacuacaaugccucaagggagugauaggguggugagcauuaaguuaaaggaggcuagcaaugucaaagaguaccacagaguuuuauaauacuaugcuaacaucuuguaugcccuagcagggucaggaaacucaaacacaccuuccuuuuuggccccccuuuuuuuguuguuuuuugcuuuuuccuuggucuuuuccccccguguuucaaucauggaccucacagguuucuuagcuuuuucagaaucuucaaauuucuucaugguagugggagcacggaucuuacugcucuccucugcuucacuaaagagaaaagagacuaguuggucuuucuacccauacaagaggacaacucugacuuaagaaaaagaucccacauaucaaaaggacuauaagaaacaagcuacaaaaugugacugguuugaacccauguaaauauugaugcgccaccgacaggcaggcacucuuaaaucaugaaaauuuucccuuugaacggaggaaagccucucaccgaaggagccgcaggaagucauuuuggaaaucaaaugugccauucaauagacuuaaagcacucuguuguuggaucucugugcgauacuuaucccggaacagucggugcacaucaucuaucaacuugucuacauaggucagcgugaggaucuucugaaagccaaccuguuuauggaaggagacggagccaauagaucuccuuacaugccagcccagaauggaaggaagccaacucaacccaagccuccagagauagguuuccugccccgggagagccaagcuuacaaucuuacccagaagucgcuugcuuucuccccuccacauuccuaacuuuuuucuaucacuuuaucacauacacaauacccacaauuaauuagguucaucaguggggaugcuguugagaacauaacuugucuuucuaacauacccccacuuaccacaaacaccagcucaaacugguuguccaguuuauacuugagugugagagccucaugagugaaagaguuguuaccgccccguuccuggaaaaagagcguuucagcagucaggcuacauccacagcaaaaccagacuuuggacuacguuugggaaauaaccagauauaauccugcccucaacaagggaguucugggacauuucuagcaccccgugagaaaaaaagacagacagacagacaccagguaaggacaagggguaaagcugggacaggagacaggacacgugggagccaggaaguaaacagucauauauaaacaaucagaucuucuagcagcugugaaccaucuacuguuccugaaagguguucucgcauccacaguuucacccaacgucaaaacagcagaaaaccacgcugcucggaugaguggagagggaguucgaguccauuaggacgccagaacguggcuagagccccggaaacgggaggaguggggggcgucgcaaaguuucgggauacugugauccaggcaaggaagucgauccuggguggccgguaaccgaccaguuugaggagaucagaacggaaagugcggagugacuacuggaaaggggaccacagucugggucugagggacgacagcccggaguucugccccgcgggggugguaccugcagcaguacggaacgaaucaacgcguugacgggcccggugcacgagucgcucacgcccuggaaacaccagagcacaagcccgcccuucgagaagauggugaagaagucaagcaugacggaagcgggagaagacuugaggccgagaccggggccgggaacucgggccgcguccgccgccgccgcuuccugcugcgccaagcgcgggacacgucacaccagcagcccccggaaaccgguucagccgcacuuccgcuacgagccuccguggucccgccccuuucccgcucagggcgcgcgagaugacguagacucaagccugaccaauagcacacaggggcgggacuccagaggcgauagcuccccuauagcguggagggguggagccugaagagcacugccggcuaaucggcgcguucgugucuauuccccguggcgcggaccgaugacaggaaggacagagucggcuugaggggaacccaccucaagcugaaagaagccgggcucuaaggccauguuucgcagagcgcugcgucuuggcuugggcccgggccucccauaccgggggcuacgcacacgcaaaggaggcuuuacucuggguaaagcugagggcagcagugguucuggggagcccaaacccuccauagaugugaccuucaagguucgacccccugccucgugcgggcgggacagcgaguuagcugggggaagggguaggcuugccuacuaaaggucaaagagccgaggcaaguguauggcucucaaggaggcacuucccaguggacaaugccauauaaauggaagcuugcuggcgaugauggauaaggauaagaaaccauuacaaaggugcccggcuuuagaaggcugugcaguaugaaguauacuagggacucguucccugggccuggcauaucugagaaugggguucaggagggagagagaucugcaagagcuaaauaaugugagucacaucucgcuugauggggaaacagaaaguaauuucaggaaguugaaucuuccaguguuagagauccaugauauuggggccuggugggacaaagaccaaacaacaaaguucuaacaauacugcugcauaugaguugaucuuaugagaaaggaugacauuggagguguggcaauccaaaugccuauuucagccccccuuuuccuguacccauccuccaacccccaaccacgcagaaaagaacauaagucaucuaacuguaacuauguccugcagacugggaugcaaaggugucugacuuuaagaagaagguugauuccauccugccuggaaagaaauaugaagugcuguaugacaccagccaccugcccccagaacaggcggauguggucaucauaggaggugggauucuuggucugucuguggccuuuuggcugaagaagcuggagaguagaagaggugccauucgggugcuggugguggagcaggaccacacggugaggucagggaguaagggcagucaucuuauugaggacacagacuguggcauugagggcagggacugugcuuuggacuuuggagcuuaagaaauaguuccaggcucuuccucccucaacaaagacccgcagcaauaacauuguuuuguuggggaaggggaagagacuuugcuacuguuguuuaaucucuuuggagaugggguuucaauauauggcugaagcuggcccugaacucagcauuuuccauucugugccucccaagugcuccgauuacacgugcuccagaacauuuacccauacuugcuccuugaaaaaugauuccccuuugcauuuaaauguauaacugacagcuuccauugcaggauuccauuauauauuacaucaugacagucuacgucgguuuuucuuuucacaguauucacgggcuuccuccacagggccuucugugggcgggauuuggcagcaguuuuccgugccugagaauguccagcucucacucuuuucaaucaacuuucuccggaacauaaauguauguacaguaagauuugaaggcuggggugggagucccuucuuuagcccagagaucaguagccuagcugguaaggggaaccaaggagaagaguguguuugaggcaacaagauauugggauccuugacugucuuccaguguuggugccuagagaaggguuuguccugaucugggccacugcuccuggagcuguggugaggccagggagguucccuuuugucagccuccuuggagagcagcucuuuuucuuugcacucaggaguaccuggcugugguggaugcuccuccuguggaacuucaguucaacccuuccggcugucucuugcuagcuucagaaaaggaugcugccaccuuggaaaacaaugugaaaaugcaaaggugggugcccagcacugcccugagcugcuucuuggcuucacauacuucacugagcucuuauaccaaguuagaaaucgggaagcugaaggucaagucauaagaaucuccucauuaguagcucuuauuaucaggaaaaaugggccuauuuaaccuucaaggccccaugacgaggacuaucgcccagucguggacacuuagcacccauguaagauacucccaaaccuaacaaaccagaaucucuagggaguggccaggguacugggcuucuaacaagaauccuaauuuagggaucagcaaauucuauaaagggccagacaguaaauauuuuagguuuucuugucauuuugucucuguuucaacuuuucugcucugccauuauagcacaaaaguagccacagacaaaaaacauagaaauaauugagugugguccacaaauaaaaguaggcagcagguuggccuuagcacauugagcuucacaucaauuaaggguugaacaucuuugugauaugguaugcacaggcucucuucugauaugcugugaaucucacuagugaaaccagauaaaugucugcggaugcuaacucauuaauuaauuuaaucagaacaucccauuuuacauguggggaaacugggacaagaucuaguaaagcuggcauugagccucaguuuaaacuagacacuggcucauaggaguguuucuuggcacucugauucccuggccaguuaguguucuagaggagacacucauucugagggacaagguugugcuaggcagcagagaagaaaguguuuuacaggaggcaguggugcgugguuccccaccaucuugugaaaggagauagaguagggcaaggaguugagaguacugaagggagagaggaauguagaaaaggaaaaaugagccuucacauccagcagucaagagaaauggggcauuugggacagacagaacugagugaacuggacguccucuccuggagucaggguccauguuucuccccucagaauauucucccuaacacauuaacugagaugcacacauuucucuuaggcaggaaggagccaaagucugccugaugucuccugagcagcugcagaccaaguuucccuggauaaacguagaaggaguagcucuggcgucuuauggugaggcucaccaucaaagcacgucuuucuuucccugaagauggagauugaaggcuccuuggguuggaaggcucagugugccaucuccauacugaaggaggaccacuuuccuccugaguaacagggucugccccaaaccaugcuacuucucuggccuucagcaugacugaacucuaguagaguuggucaagaugacuuucccugcuucuaaagcccuaaagaagugugugugugugugugugugggggggguuauacagugggaaaaggaggguaccagggcuucaugaguuuucuuuuucuuuaugucaggguuggaggaugaagguugguuugaugccuggucuuugcuccagggucuucgucgaaagguccagucaaugggagucuuuuucugccagggagaggugacacgugaguccaaagucucauucccucugcuaugucuuauaccuaggacaaggccuagcccaggcucugccuuucugcucacaggcucaccuaggguuggugugagaggccaucuucugcuaagcaguucagcuuucuucucacuacacugcccuauuccuggauagccaaguuuauuuggguuucuugauaucucuugaguguccauggaaaagcacugauccuucccauuuucuuuccuugaaugagcaguggugguugcggagccaggaguguggcuauugguagagugcuugccuagcaugcaugaaacccuaagauccaucccccuggguuauauccccauaaacugggcacagugcugcaugccuguaaucccagaacucuggagguacaggcaggaaaauaauaaguugaggguuauucucuacuacauaggaggucugagacuagucuguguuacaugagacccuuucucaaaagaaaccagaaugacccccuauuucccuuaagggcaguguguguguguguguguuaauuacuguucuauugcuuugaagagaucccaugaccaaggcaacucuuauaaaagaaagauuucagcuaggggaugcucggagcuucagaagaucaauccaucaguaucaucauggcagggagcaugguggcagcagaaaugaugcaaaagaaguaucugugaacuacauccugauccacaggcagcaggcagagagaaagauagacagacacugggccuaguaugggcuuuuaaaaccucaagaccuauucacagugacacaccuccucccacaaggacacaccuccaaauccuucccaaacaguucaucaguuggggacuaagcaugcaaauaugagccuacagggccauucucaaucaaaccaccauuuugugucuuuguguuuaucuuugugucuguuuauccaggaaaacuuguucugcagcugcucaggagacaucagacagacacagggagagucuccugaggggagaaacaugggaggaaguccagcucacucauagcucucugcuuugccccaaauggcccaucaguauauguugauuggaacacuagagcuagaacccagggucucaugcauacuagguauauacccugagcuaacccuuccugaagggcuuaauuuuuaauuuccucccugcagguuucaucacuucaucuaccccaaugaagaccccaacuggggaacauguagucuugagaaggaucaacaauguccauguaaaucccaaguuguauugugcuuuuuauaaaguggagggcaagaagggagauaaucuacucagaugucggucuucuaccugcuuacagcacugauaaaaguugggcuuaaagggaaauaaacaugucaggauccauugugugcccuuauuucccucacacacagcccaacuuccuuccuuuuacccucugguuccuacaggugaaaauggacaagagccuggaguaucaaccaguagaaugugcuguagugaucaaugcugcaggagccuggucugggaaaauugcagagcuggcugguguugggaagggacuuccuggcacccuccagggcaccaagcuaccuguggagccaaggaaaagguagcuaccgucagggcagcuaaggaugaaaaagaacuguuacaaaaguuuaggauguauuuguguguguacaaguguggucugggcagaggguuggugaguguuauuccugcaaugucauaacucaccugaucgugacagguaugugcacuuauggcacugcccacagggaccaggucuggagacaccguugguugcagacauuaguggagucuauuuccgacgggaaggauugggcagcaacuaccuagguggcuguaguccuacugagguaaguuaaguuucaaggagacauaaacaagaugccauuaaagaggcaagccauugggaagugguggggaggcuuugcucuccuucgcguuagaauuggaauccacugaagggauugauuauaggaaucagaucuugauuccaagcaauauagaaaccuugucuuuaccucuuacuuaggaggaagaaccagacccaacaaaucugaauguggaccaugacuucuuccagaacaaaguguggccucauuugguccagagggugccaucuuuuaagacucuggagguaacuaaaggggaauaauuguuucuguuuugaucuguuguguucccuccaacuaacaauugcuaagaaaccuacuggaucuaucccaucacaugggcccuuuagcagaugauccugagcaaggguguggguugagcaugucuggcuuuaccaagaaccucagcaucuuuugcaccugcagguacagagugccugggcugguuauuaugacuacaauacuuuugaccagaauggcguggugggcccccacccacuaguugucaacauguacuuugcuacgggcuucaguggucgugggcuucagcaugcaccuggcaucggacgcgcuguggcagaaaucaugcuagagggucacuuuaagaccaucgacaugagccccuuccucuuuacccgcuuuuacuuaggagagaaguuacaggaguacaauauccucugagugugaaaacugucucugggccucaccagcccaggcaucacucugucucacgcuggcuuuggucacugucugagucuccccagcacugugccagggauacaucccuuucuucaccaucccuuaaaccaggccucuuccccggugucucuggacauggaaugagcauaggcacaaagacccagaccaguggaaagugaugaagugggagccuaggacugauuguagccuaggcugcuucacuaccuaaacaguucagcuggcaucccaggcauggugcccaggacuggccuccuuccuggugcugaugcagagaaaucugaccagagccaaggcacagaacauucuaggauaaccuggcccaaauuuauugacuugucuauuaaccuguucuuuaaucuggccuuauguucuuccuacuuuucuucucaugguagaagcuuuugaaguauugugccauuaaaaaggcagcuuugggggcuggagagaugguuaagagcacugacugcucuuccagaggugcugaguucaguuccuagcaaccacaugguggcucacaaccaaccaucuguaauggaaucugauacccucuucuacucugucugaagacagugacaauguacucacauacauaaaauaaauaaaucuuaaaaaaaaaaaaaaaggcagccucuugagaguguuucuuagauccucugugggaggcaucuuguuugcaagcuacuauccuguuacaggagcagugguucuagggaaagaaaugguucuaguuagcuucuauaaaccuccagcuucugacuaccacauucagucuauagcaggauucagaguagcuuucugacuggaucauggagcuuuggggaaagaaggagccaggaucugaagagccacacugagaagcuuggauuucaccucggcagaaacccagcagauuuuuaaauauggaagcaacaugaucggauuuucuuuuuaaaaaucugucuggcuaggguguagcccagugguagagugcuugcuuagcaaguggauggcccuggaugugauccucagcaccaacagagaggagcugggggaagucacugguccccuugaagagaacaaagauagcaaagcaggaagcaggcuguagacaaaggcuguuuagucuacuuaacagauaacagucuuggugggaaacccguggagcaaugugacaaugaacaugaaauagagucaguguuucccaaguuucuggcuuaauagucaaacaggcaccauucuuaccaaaacgacagagggaagaacagcaaaaugaguggucuggugugggacaaacugaaagaaaagugccugugggaggugugaggggugauuggacaaauugggugggcagucugaguguagacaggugauaacggcaucaacaaaggaaagcaaagcauuaaggacaacacagaaaagcugggguacccacugacauuuagagagaacaggugauugcugaaaguggcccaugaggcaggagaaaauccaguuaaauggaaucaugaagacaagaagcaggcacuagaaugauaugucacaugacagcugggcuuagcaccuagcaggucaguggugaccagggaaugcaaucuaaggcacagagagaaguuacagaagagagggaaccagaguugagcuuccuaggaaaauggcuccuuccgaaguccuuuggaguaaauaaaaaguaaaagagguagacaccauauaggggaggggacaggagaggagaugggccagcuaggaguauagagccugaguguggcuugaagagagccagaaauuaggcaguaagcaaaagaaaacucaccagaagguagugcugaaauauuagaagggucuugucaugaacaggguggacaggcuuuaggcuaaagagauaggucagagaauugguuagcccuggauuauagagguacucuguagccgacuuuuaacaaaccuuuguaucugccaugaaucuggagugauggcaccuaagcuuugaaguacccuuuugucagcgacuguuaucugagauuuguaugggguuauuccuuugaagguuucuuagagcuuuugcccaucuuagucaggagauaauguuucccacggcugagaauugcuuaggugauaguucuuucaagauagcaagauagccccuaaaucagauaagagguuuugguaugcagaaauugacuugcuaaagaugccuuuuauguaacugaaaagagcuucaaggcagcuguggguuucagucccacagaggcuccucccacccacccaccccacccccccccaccccacgcugcuaagaagccugaauucauccuguaguggcucucuuccauugaucaguccauguaacccaccaacauucacagugccccauagugauuucagcacagcaucagucuaaggguucaaagaaauagauguuguaaucagugcuuaaggaaaccccuacuuccacagggcuuuaaucuugucucaugagaaagccuuuauggacaugugauugcaucugcuuugcccuuucaacuauaugaggggcugggccaagcccucaucuuuguccccaaaucuagcaaccccacacuuucuccuguacucugcccaucgaagcauuccugcuggacccuaaagauccuuccuggccccaggggguuuauacugcaaugagagguagggcagauggcucaagaugccauuuaggccugacagcuuaguuucaauccccagaacccaaguuaaaaugcaugguaugguugcauaugugugcaaucccaggguucaauaugucaggaaaguagagacaggggaauugccuggaaccucaagagccagccagccuggaguacauaggaugguggagacaagagauauccuaccucaacaagguagaagagaaccaacucccaaaagcugcccucugaccuacacacaugcaauaauaauguguaaaaucuuuauuucauuugugcguguaugcugggggugggggcagaugacaagggaguccuucccucaagcuggaguuacauacaacugugagccacuggauaugggugcugggcaucaacucagguccucugggugggcagguacuccagccucaguuucuuggccagguagaguggcccaagccuuuaaucccagaacuuagaggcaggaagaugaaaaaaaaauucauucauuuuaauuacaaguuugaagcuagccuaggcuauuggggaggaaaucuuuccuuacaggaugcaaaaaugaaccuggcuggaagagaggcaguuuucacaagcacagcugggcagaggccaaagggagaagcagagauguccucgccaaggagccauccaccaagugugagcaacugcuggguguccagcugcuggggguugggguggagggugggugugagacagcucuuucccaaaagcuuuuaucccuaacaggauaagaaaugguuuauucggggcuggugagauggcucaguggguaagagcacccgacugcucuucugaagguccagaguucaaaucccagcaaccacaugguggcucacaaccauccguaacgaaaucugacucccucuucuggagugucugaagacagcgacagugugcuuacauaaauaaauaaauaaauaaauaaauaaauaaaaucuuuuaaaaaaaaaaggguuuagauaugcuaaaaaaaaaaaaaaaaaaaaaaagaaaugguuuauucuugagccauaccugagugaccacgucccaggaauauagauuuagguuauccuaaacugcauguuucaguguggaaggagcuucacaacguuuuaaauuguuacagaacaaagucauaaaucaagccaaguuuaaaauacauugucgggcacaucgcagaggcaguacagcaagacuggggcuggggagaccuuugcuguaggacucagguguuaucugaugauagcuuucggguugggcagcuagggaucugcucaagguauggcuggccgauccgugggguuuagagcuagcugagccuccggacaggcaauauuccuaucucuccaacucacugcaguucuaaucaguaagucagccuuugcagacacaauugcuuuccaggaauucuuaugaauauucaucucucacaacaccagcauccagagaauguaauuuugaugaguaaaccuagaaagaucauucaugaacagcgccacggcaucaacugccucccucugaacaaguuacagguuggcuuggcuggagagaaaaagaaaucaagagugggcuaauaaggccuuacaccagcccauucuacuccugccaccugcaguauuucaugugaguugguuuuagguugguguuuuaauaacaauauucccuuggcguuucacaaagcucacagcaggaacucuaagaaguggaggcagaggacuuaaauauuucaucagggcuuaccaacacuuugcccagccacccuuuuuuugcaguuauuuugguacccuuggaaaugcaguugaaaugccauuaggaaaucccugcccugaaggccagcacuuuuggccagacugauuccagccugugggcagcaaccuuaaugggacccauaucccaguaaaagaacggaccucccaggggcuagccggcuucuuuguccacuuaaccuaccuuacuuaaggggaugaaagucucauuuuccccaaccgug

SEQ ID NO: 4999 - RNA, 6850 nt, Mus musculus
cuuuuuuuuuuuuuuuaagauuuauuuauuuuauguaugugaguacauugucacugucuucagacagaguagaagaggguaucagauuccauuacagaugguugguugugagccaccaugugguugcuaggaacugaacucagcaccucuggaagagcagucagugcucuuaaccaucucuccagcccccaaagcugccuuuuuaauggcacaauacuucaaaagcuucuaccaugagaagaaaaguaggaagaacauaaggccagauuaaagaacagguuaauagacaagucaauaaauuugggccagguuauccuagaauguucugugccuuggcucuggucagauuucucugcaucagcaccaggaaggaggccaguccugggcaccaugccugggaugccagcugaacuguuuagguagugaagcagccuaggcuacaaucaguccuaggcucccacuucaucacuuuccacuggucugggucuuugugccuaugcucauuccauguccagagacaccggggaagaggccugguuuaagggauggugaagaaagggauguaucccuggcacagugcuggggagacucagacagugaccaaagccagcgugagacagagugaugccugggcuggugaggcccagagacaguuuucacacucagaggauauuguacuccuguaacuucucuccuaaguaaaagcggguaaagaggaaggggcucaugucgauggucuuaaagugacccucuagcaugauuucugccacagcgcguccgaugccaggugcaugcugaagcccacgaccacugaagcccguagcaaaguacauguugacaacuagugggugggggcccaccacgccauucuggucaaaaguauuguagucauaauaaccagcccaggcacucuguaccugcaggugcaaaagaugcugagguucuugguaaagccagacaugcucaacccacacccuugcucaggaucaucugcuaaagggcccaugugaugggauagauccaguagguuucuuagcaauuguuaguuggagggaacacaacagaucaaaacagaaacaauuauuccccuuuaguuaccuccagagucuuaaaagauggcacccucuggaccaaaugaggccacacuuuguucuggaagaagucaugguccacauucagauuuguugggucugguucuuccuccuaaguaagagguaaagacaagguuucuauauugcuuggaaucaagaucugauuccuauaaucaaucccuucaguggauuccaauucuaacgcgaaggagagcaaagccuccccaccacuucccaauggcuugccucuuuaauggcaucuuguuuaugucuccuugaaacuuaacuuaccucaguaggacuacagccaccuagguaguugcugcccaauccuucccgucggaaauagacuccacuaaugucugcaaccaacggugucuccagaccuggucccugugggcagugccauaagugcacauaccugucacgaucaggugaguuaugacauugcaggaauaacacucaccaacccucugcccagaccacacuuguacacacacaaauacauccuaaacuuuuguaacaguucuuuuucauccuuagcugcccugacgguagcuaccuuuuccuuggcuccacagguagcuuggugcccuggagggugccaggaagucccuucccaacaccagccagcucugcaauuuucccagaccaggcuccugcagcauugaucacuacagcacauucuacugguugauacuccaggcucuuguccauuuucaccuguaggaaccagaggguaaaaggaaggaaguugggcugugugugagggaaauaagggcacacaauggauccugacauguuuauuucccuuuaagcccaacuuuuaucagugcuguaagcagguagaagaccgacaucugaguagauuaucucccuucuugcccuccacuuuauaaaaagcacaauacaacuugggauuuacauggacauuguugauccuucucaagacuacauguuccccaguuggggucuucauugggguagaugaagugaugaaaccugcagggaggaaauuaaaaauuaagcccuucaggaaggguuagcucaggguauauaccuaguaugcaugagacccuggguucuagcucuaguguuccaaucaacauauacugaugggccauuuggggcaaagcagagagcuaugagugagcuggacuuccucccauguuucuccccucaggagacucucccugugucugucugaugucuccugagcagcugcagaacaaguuuuccuggauaaacagacacaaagauaaacacaaagacacaaaauggugguuugauugagaauggcccuguaggcucauauuugcaugcuuaguccccaacugaugaacuguuugggaaggauuuggagguguguccuugugggaggaggugugucacugugaauaggucuugagguuuuaaaagcccauacuaggcccagugucugucuaucuuucucucugccugcugccuguggaucaggauguaguucacagauacuucuuuugcaucauuucugcugccaccaugcucccugccaugaugauacugauggauugaucuucugaagcuccgagcauccccuagcugaaaucuuucuuuuauaagaguugccuuggucaugggaucucuucaaagcaauagaacaguaauuaacacacacacacacacacugcccuuaagggaaauagggggucauucugguuucuuuugagaaagggucucauguaacacagacuagucucagaccuccuauguaguagagaauaacccucaacuuauuauuuuccugccuguaccuccagaguucugggauuacaggcaugcagcacugugcccaguuuauggggauauaacccagggggauggaucuuaggguuucaugcaugcuaggcaagcacucuaccaauagccacacuccuggcuccgcaaccaccacugcucauucaaggaaagaaaaugggaaggaucagugcuuuuccauggacacucaagagauaucaagaaacccaaauaaacuuggcuauccaggaauagggcaguguagugagaagaaagcugaacugcuuagcagaagauggccucucacaccaacccuaggugagccugugagcagaaaggcagagccugggcuaggccuuguccuagguauaagacauagcagagggaaugagacuuuggacucacgugucaccucucccuggcagaaaaagacucccauugacuggaccuuucgacgaagacccuggagcaaagaccaggcaucaaaccaaccuucauccuccaacccugacauaaagaaaaagaaaacucaugaagcccugguacccuccuuuucccacuguauaaccccccccacacacacacacacacacacuucuuuagggcuuuagaagcagggaaagucaucuugaccaacucuacuagaguucagucaugcugaaggccagagaaguagcaugguuuggggcagacccuguuacucaggaggaaagugguccuccuucaguauggagauggcacacugagccuuccaacccaaggagccuucaaucuccaucuucagggaaagaaagacgugcuuugauggugagccucaccauaagacgccagagcuacuccuucuacguuuauccagggaaacuuggucugcagcugcucaggagacaucaggcagacuuuggcuccuuccugccuaagagaaaugugugcaucucaguuaauguguuagggagaauauucugaggggagaaacauggacccugacuccaggagaggacguccaguucacucaguucugucugucccaaaugccccauuucucuugacugcuggaugugaaggcucauuuuuccuuuucuacauuccucucucccuucaguacucucaacuccuugcccuacucuaucuccuuucacaagaugguggggaaccacgcaccacugccuccuguaaaacacuuucuucucugcugccuagcacaaccuugucccucagaaugagugucuccucuagaacacuaacuggccagggaaucagagugccaagaaacacuccuaugagccagugucuaguuuaaacugaggcucaaugccagcuuuacuagaucuugucccaguuuccccacauguaaaaugggauguucugauuaaauuaauuaaugaguuagcauccgcagacauuuaucugguuucacuagugagauucacagcauaucagaagagagccugugcauaccauaucacaaagauguucaacccuuaauugaugugaagcucaaugugcuaaggccaaccugcugccuacuuuuauuuguggaccacacucaauuauuucuauguuuuuugucuguggcuacuuuugugcuauaauggcagagcagaaaaguugaaacagagacaaaaugacaagaaaaccuaaaauauuuacugucuggcccuuuauagaauuugcugaucccuaaauuaggauucuuguuagaagcccaguacccuggccacucccuagagauucugguuuguuagguuugggaguaucuuacaugggugcuaaguguccacgacugggcgauaguccucgucauggggccuugaagguuaaauaggcccauuuuuccugauaauaagagcuacuaaugaggagauucuuaugacuugaccuucagcuucccgauuucuaacuugguauaagagcucagugaaguaugugaagccaagaagcagcucagggcagugcugggcacccaccuuugcauuuucacauuguuuuccaagguggcagcauccuuuucugaagcuagcaagagacagccggaaggguugaacugaaguuccacaggaggagcauccaccacagccagguacuccugagugcaaagaaaaagagcugcucuccaaggaggcugacaaaagggaaccucccuggccucaccacagcuccaggagcaguggcccagaucaggacaaacccuucucuaggcaccaacacuggaagacagucaaggaucccaauaucuuguugccucaaacacacucuucuccuugguuccccuuaccagcuaggcuacugaucucugggcuaaagaagggacucccaccccagccuucaaaucuuacuguacauacauuuauguuccggagaaaguugauugaaaagagugagagcuggacauucucaggcacggaaaacugcugccaaaucccgcccacagaaggcccuguggaggaagcccgugaauacugugaaaagaaaaaccgacguagacugucaugauguaauauauaauggaauccugcaauggaagcugucaguuauacauuuaaaugcaaaggggaaucauuuuucaaggagcaaguauggguaaauguucuggagcacguguaaucggagcacuugggaggcacagaauggaaaaugcugaguucagggccagcuucagccauauauugaaaccccaucuccaaagagauuaaacaacaguagcaaagucucuuccccuuccccaacaaaacaauguuauugcugcgggucuuuguugagggaggaagagccuggaacuauuucuuaagcuccaaaguccaaagcacagucccugcccucaaugccacagucuguguccucaauaagaugacugcccuuacucccugaccucaccgugugguccugcuccaccaccagcacccgaauggcaccucuucuacucuccagcuucuucagccaaaaggccacagacagaccaagaaucccaccuccuaugaugaccacauccgccuguucugggggcagguggcuggugucauacagcacuucauauuucuuuccaggcaggauggaaucaaccuucuucuuaaagucagacaccuuugcaucccagucugcaggacauaguuacaguuagaugacuuauguucuuuucugcgugguuggggguuggaggauggguacaggaaaaggggggcugaaauaggcauuuggauugccacaccuccaaugucauccuuucucauaagaucaacucauaugcagcaguauuguuagaacuuuguuguuuggucuuugucccaccaggccccaauaucauggaucucuaacacuggaagauucaacuuccugaaauuacuuucuguuuccccaucaagcgagaugugacucacauuauuuagcucuugcagaucucucucccuccugaaccccauucucagauaugccaggcccagggaacgagucccuaguauacuucauacugcacagccuucuaaagccgggcaccuuuguaaugguuucuuauccuuauccaucaucgccagcaagcuuccauuuauauggcauuguccacugggaagugccuccuugagagccauacacuugccucggcucuuugaccuuuaguaggcaagccuaccccuucccccagcuaacucgcugucccgcccgcacgaggcagggggucgaaccuugaaggucacaucuauggaggguuugggcuccccagaaccacugcugcccucagcuuuacccagaguaaagccuccuuugcgugugcguagcccccgguaugggaggcccgggcccaagccaagacgcagcgcucugcgaaacauggccuuagagcccggcuucuuucagcuugagguggguuccccucaagccgacucuguccuuccugucaucgguccgcgccacggggaauagacacgaacgcgccgauuagccggcagugcucuucaggcuccaccccuccacgcuauaggggagcuaucgccucu

SEQ ID NO: 5000 - RNA, 6850 nt, Mus musculus
agaggcgauagcuccccuauagcguggagggguggagccugaagagcacugccggcuaaucggcgcguucgugucuauuccccguggcgcggaccgaugacaggaaggacagagucggcuugaggggaacccaccucaagcugaaagaagccgggcucuaaggccauguuucgcagagcgcugcgucuuggcuugggcccgggccucccauaccgggggcuacgcacacgcaaaggaggcuuuacucuggguaaagcugagggcagcagugguucuggggagcccaaacccuccauagaugugaccuucaagguucgacccccugccucgugcgggcgggacagcgaguuagcugggggaagggguaggcuugccuacuaaaggucaaagagccgaggcaaguguauggcucucaaggaggcacuucccaguggacaaugccauauaaauggaagcuugcuggcgaugauggauaaggauaagaaaccauuacaaaggugcccggcuuuagaaggcugugcaguaugaaguauacuagggacucguucccugggccuggcauaucugagaaugggguucaggagggagagagaucugcaagagcuaaauaaugugagucacaucucgcuugauggggaaacagaaaguaauuucaggaaguugaaucuuccaguguuagagauccaugauauuggggccuggugggacaaagaccaaacaacaaaguucuaacaauacugcugcauaugaguugaucuuaugagaaaggaugacauuggagguguggcaauccaaaugccuauuucagccccccuuuuccuguacccauccuccaacccccaaccacgcagaaaagaacauaagucaucuaacuguaacuauguccugcagacugggaugcaaaggugucugacuuuaagaagaagguugauuccauccugccuggaaagaaauaugaagugcuguaugacaccagccaccugcccccagaacaggcggauguggucaucauaggaggugggauucuuggucugucuguggccuuuuggcugaagaagcuggagaguagaagaggugccauucgggugcuggugguggagcaggaccacacggugaggucagggaguaagggcagucaucuuauugaggacacagacuguggcauugagggcagggacugugcuuuggacuuuggagcuuaagaaauaguuccaggcucuuccucccucaacaaagacccgcagcaauaacauuguuuuguuggggaaggggaagagacuuugcuacuguuguuuaaucucuuuggagaugggguuucaauauauggcugaagcuggcccugaacucagcauuuuccauucugugccucccaagugcuccgauuacacgugcuccagaacauuuacccauacuugcuccuugaaaaaugauuccccuuugcauuuaaauguauaacugacagcuuccauugcaggauuccauuauauauuacaucaugacagucuacgucgguuuuucuuuucacaguauucacgggcuuccuccacagggccuucugugggcgggauuuggcagcaguuuuccgugccugagaauguccagcucucacucuuuucaaucaacuuucuccggaacauaaauguauguacaguaagauuugaaggcuggggugggagucccuucuuuagcccagagaucaguagccuagcugguaaggggaaccaaggagaagaguguguuugaggcaacaagauauugggauccuugacugucuuccaguguuggugccuagagaaggguuuguccugaucugggccacugcuccuggagcuguggugaggccagggagguucccuuuugucagccuccuuggagagcagcucuuuuucuuugcacucaggaguaccuggcugugguggaugcuccuccuguggaacuucaguucaacccuuccggcugucucuugcuagcuucagaaaaggaugcugccaccuuggaaaacaaugugaaaaugcaaaggugggugcccagcacugcccugagcugcuucuuggcuucacauacuucacugagcucuuauaccaaguuagaaaucgggaagcugaaggucaagucauaagaaucuccucauuaguagcucuuauuaucaggaaaaaugggccuauuuaaccuucaaggccccaugacgaggacuaucgcccagucguggacacuuagcacccauguaagauacucccaaaccuaacaaaccagaaucucuagggaguggccaggguacugggcuucuaacaagaauccuaauuuagggaucagcaaauucuauaaagggccagacaguaaauauuuuagguuuucuugucauuuugucucuguuucaacuuuucugcucugccauuauagcacaaaaguagccacagacaaaaaacauagaaauaauugagugugguccacaaauaaaaguaggcagcagguuggccuuagcacauugagcuucacaucaauuaaggguugaacaucuuugugauaugguaugcacaggcucucuucugauaugcugugaaucucacuagugaaaccagauaaaugucugcggaugcuaacucauuaauuaauuuaaucagaacaucccauuuuacauguggggaaacugggacaagaucuaguaaagcuggcauugagccucaguuuaaacuagacacuggcucauaggaguguuucuuggcacucugauucccuggccaguuaguguucuagaggagacacucauucugagggacaagguugugcuaggcagcagagaagaaaguguuuuacaggaggcaguggugcgugguuccccaccaucuugugaaaggagauagaguagggcaaggaguugagaguacugaagggagagaggaauguagaaaaggaaaaaugagccuucacauccagcagucaagagaaauggggcauuugggacagacagaacugagugaacuggacguccucuccuggagucaggguccauguuucuccccucagaauauucucccuaacacauuaacugagaugcacacauuucucuuaggcaggaaggagccaaagucugccugaugucuccugagcagcugcagaccaaguuucccuggauaaacguagaaggaguagcucuggcgucuuauggugaggcucaccaucaaagcacgucuuucuuucccugaagauggagauugaaggcuccuuggguuggaaggcucagugugccaucuccauacugaaggaggaccacuuuccuccugaguaacagggucugccccaaaccaugcuacuucucuggccuucagcaugacugaacucuaguagaguuggucaagaugacuuucccugcuucuaaagcccuaaagaagugugugugugugugugugugggggggguuauacagugggaaaaggaggguaccagggcuucaugaguuuucuuuuucuuuaugucaggguuggaggaugaagguugguuugaugccuggucuuugcuccagggucuucgucgaaagguccagucaaugggagucuuuuucugccagggagaggugacacgugaguccaaagucucauucccucugcuaugucuuauaccuaggacaaggccuagcccaggcucugccuuucugcucacaggcucaccuaggguuggugugagaggccaucuucugcuaagcaguucagcuuucuucucacuacacugcccuauuccuggauagccaaguuuauuuggguuucuugauaucucuugaguguccauggaaaagcacugauccuucccauuuucuuuccuugaaugagcaguggugguugcggagccaggaguguggcuauugguagagugcuugccuagcaugcaugaaacccuaagauccaucccccuggguuauauccccauaaacugggcacagugcugcaugccuguaaucccagaacucuggagguacaggcaggaaaauaauaaguugaggguuauucucuacuacauaggaggucugagacuagucuguguuacaugagacccuuucucaaaagaaaccagaaugacccccuauuucccuuaagggcaguguguguguguguguguuaauuacuguucuauugcuuugaagagaucccaugaccaaggcaacucuuauaaaagaaagauuucagcuaggggaugcucggagcuucagaagaucaauccaucaguaucaucauggcagggagcaugguggcagcagaaaugaugcaaaagaaguaucugugaacuacauccugauccacaggcagcaggcagagagaaagauagacagacacugggccuaguaugggcuuuuaaaaccucaagaccuauucacagugacacaccuccucccacaaggacacaccuccaaauccuucccaaacaguucaucaguuggggacuaagcaugcaaauaugagccuacagggccauucucaaucaaaccaccauuuugugucuuuguguuuaucuuugugucuguuuauccaggaaaacuuguucugcagcugcucaggagacaucagacagacacagggagagucuccugaggggagaaacaugggaggaaguccagcucacucauagcucucugcuuugccccaaauggcccaucaguauauguugauuggaacacuagagcuagaacccagggucucaugcauacuagguauauacccugagcuaacccuuccugaagggcuuaauuuuuaauuuccucccugcagguuucaucacuucaucuaccccaaugaagaccccaacuggggaacauguagucuugagaaggaucaacaauguccauguaaaucccaaguuguauugugcuuuuuauaaaguggagggcaagaagggagauaaucuacucagaugucggucuucuaccugcuuacagcacugauaaaaguugggcuuaaagggaaauaaacaugucaggauccauugugugcccuuauuucccucacacacagcccaacuuccuuccuuuuacccucugguuccuacaggugaaaauggacaagagccuggaguaucaaccaguagaaugugcuguagugaucaaugcugcaggagccuggucugggaaaauugcagagcuggcugguguugggaagggacuuccuggcacccuccagggcaccaagcuaccuguggagccaaggaaaagguagcuaccgucagggcagcuaaggaugaaaaagaacuguuacaaaaguuuaggauguauuuguguguguacaaguguggucugggcagaggguuggugaguguuauuccugcaaugucauaacucaccugaucgugacagguaugugcacuuauggcacugcccacagggaccaggucuggagacaccguugguugcagacauuaguggagucuauuuccgacgggaaggauugggcagcaacuaccuagguggcuguaguccuacugagguaaguuaaguuucaaggagacauaaacaagaugccauuaaagaggcaagccauugggaagugguggggaggcuuugcucuccuucgcguuagaauuggaauccacugaagggauugauuauaggaaucagaucuugauuccaagcaauauagaaaccuugucuuuaccucuuacuuaggaggaagaaccagacccaacaaaucugaauguggaccaugacuucuuccagaacaaaguguggccucauuugguccagagggugccaucuuuuaagacucuggagguaacuaaaggggaauaauuguuucuguuuugaucuguuguguucccuccaacuaacaauugcuaagaaaccuacuggaucuaucccaucacaugggcccuuuagcagaugauccugagcaaggguguggguugagcaugucuggcuuuaccaagaaccucagcaucuuuugcaccugcagguacagagugccugggcugguuauuaugacuacaauacuuuugaccagaauggcguggugggcccccacccacuaguugucaacauguacuuugcuacgggcuucaguggucgugggcuucagcaugcaccuggcaucggacgcgcuguggcagaaaucaugcuagagggucacuuuaagaccaucgacaugagccccuuccucuuuacccgcuuuuacuuaggagagaaguuacaggaguacaauauccucugagugugaaaacugucucugggccucaccagcccaggcaucacucugucucacgcuggcuuuggucacugucugagucuccccagcacugugccagggauacaucccuuucuucaccaucccuuaaaccaggccucuuccccggugucucuggacauggaaugagcauaggcacaaagacccagaccaguggaaagugaugaagugggagccuaggacugauuguagccuaggcugcuucacuaccuaaacaguucagcuggcaucccaggcauggugcccaggacuggccuccuuccuggugcugaugcagagaaaucugaccagagccaaggcacagaacauucuaggauaaccuggcccaaauuuauugacuugucuauuaaccuguucuuuaaucuggccuuauguucuuccuacuuuucuucucaugguagaagcuuuugaaguauugugccauuaaaaaggcagcuuugggggcuggagagaugguuaagagcacugacugcucuuccagaggugcugaguucaguuccuagcaaccacaugguggcucacaaccaaccaucuguaauggaaucugauacccucuucuacucugucugaagacagugacaauguacucacauacauaaaauaaauaaaucuuaaaaaaaaaaaaaaag

SEQ ID NO: 5001 - RNA, 418 nt, Mus musculus
aagcuuccugucccggccgccaucggagagcagcagccauggcucugugcuaccccauggccgugggccucaacaagggccacaaggugacaaaaaaugucaguaagccgagacacagccggcgacgugggcgccccaccauacacaccaaguucgugcaggacaugauccgggaggugugcggcuucgcgcccuacaagcggcgagccauggaguugcucaaaguguccaaggacaagcgcgcacucaaguucaucaagaagagagugggcacgcacauccgcgccaagagaaagcgggaggagcugagcaacgugcuggcagccaugaggaaguuggcggccaagaagaauugaugagcccucccccaauaaaagaugguuccuacaaaaaaaaaaaaaaaaaaaagaugaaaagg

SEQ ID NO: 5002 - RNA, 1154 nt, Mus musculus
ugggucagcagcagcucuauauuccuggugccaugaacguuauuagggccucaaggguuauuuaagggucucuucgaugcacgggucugugcaagaguuaagguggucguuuauuacccagagaggguuggcagugaaauuccacggauacaacugccguaccaugucuccucaggucaugacacaguucugaucuucuguaggggaaugcuccaagccaggcaagguccuccacauccagguggaucauucccaaacccauuuuuaucacggaucauuucacagaaacuuuccgccaugggaacucacagcugaagcguguuguuuagagcggaaaauuuggguguaauagcauuagugaguccagucuccucacaugaaccuuugccugcgacaucuccuugcucccuuggccuguccacuccucucugccugagucacaacaacagucaacaaguuggacacacagcuucuugaugugccaagugcucccacgugcaccguggcauucacuccuuuggagagccuugccagacguguaauuguuagcuccacccaucagaggccagaacugaggauucaggaggccacagggccagaucagggagccaggcgucaggaccucuaacuugaacucuuauauucucucuguggaaucugccaagaggaaugugagcacucugaguagucuagcaggcaggaagggcuugauggaacaggcuucuaacugggcucuuaauggggaccuugugggggccaggagcugguagggcacccuuuugagaaucacucuccccugaaaugcuuucugauuuucagguauaaggagucaccccuccggauacaugcuaggccuaaguuucuccguuuuuacuuuuucucaccugccuaguucuucucuccauuuugcacuuccucccgcuggacacucauaucguugcuaugcaucuggggacaggggguacuggcucuccuccguggccuugcuguagcucuggcuuuugcuguagaccaugaagaccccaggggaaguuucccaugacgcuguucccuucuccucagacuggcugugugacaucaaucaagaauccagauccuuccuggcucugugccgcagaacaaagcauccaggugcccaaaucuagacucaguga

SEQ ID NO: 5003 - RNA, 1154 nt, Mus musculus
ucacugagucuagauuugggcaccuggaugcuuuguucugcggcacagagccaggaaggaucuggauucuugauugaugucacacagccagucugaggagaagggaacagcgucaugggaaacuuccccuggggucuucauggucuacagcaaaagccagagcuacagcaaggccacggaggagagccaguacccccuguccccagaugcauagcaacgauaugaguguccagcgggaggaagugcaaaauggagagaagaacuaggcaggugagaaaaaguaaaaacggagaaacuuaggccuagcauguauccggaggggugacuccuuauaccugaaaaucagaaagcauuucaggggagagugauucucaaaagggugcccuaccagcuccuggcccccacaagguccccauuaagagcccaguuagaagccuguuccaucaagcccuuccugccugcuagacuacucagagugcucacauuccucuuggcagauuccacagagagaauauaagaguucaaguuagagguccugacgccuggcucccugaucuggcccuguggccuccugaauccucaguucuggccucugauggguggagcuaacaauuacacgucuggcaaggcucuccaaaggagugaaugccacggugcacgugggagcacuuggcacaucaagaagcuguguguccaacuuguugacuguuguugugacucaggcagagaggaguggacaggccaagggagcaaggagaugucgcaggcaaagguucaugugaggagacuggacucacuaaugcuauuacacccaaauuuuccgcucuaaacaacacgcuucagcugugaguucccauggcggaaaguuucugugaaaugauccgugauaaaaauggguuugggaaugauccaccuggauguggaggaccuugccuggcuuggagcauuccccuacagaagaucagaacugugucaugaccugaggagacaugguacggcaguuguauccguggaauuucacugccaacccucucuggguaauaaacgaccaccuuaacucuugcacagacccgugcaucgaagagacccuuaaauaacccuugaggcccuaauaacguucauggcaccaggaauauagagcugcugcugaccca

SEQ ID NO: 5004 - RNA, 1291 nt, Mus musculus
uuuuuuugguuuuugguuuuuuuuaacuugugaguuuucucuuucuuauuaauugaaauguggaaauaaaaaugacuggguuugcaugggaacauuuucugacauagagaggaauauggggccuggguuuuauaauugucaagaauauaggcacaugagguauuuaaauccucauuauuucaaucaucauucaacucuuucuuuugauucauauccucuauaaguauugaugagguauccaaguuagcagugccaucauuacaguaguuccugucaauacagcaaaacguuucucucagcaggucguggaacauuugauacauuccaggugcacaggguuuacaauuaagcuuggcauaacgaaaaagguauaacccuaaaaagaagaaaaacgaaugucaucaacaugccuccuucuagaaccucauaauuuuuuuuugcaauuaauaugagcccaggucuguggcugcaucucaucuauauaucucuaguucuauucagccaaaaugccugucuuccuccagagucacgccuugcucucugucuuaagaaccuaugagaucugaacuucccucugcaucuuaaguccaaaauguguggguagaacuggagacauuuuugcaugugcuuuucaaaggcuugcuuaccugugaaacgaucauaauaauaauaguuuucugugguacaaguccuguuuuguguccauaagucaaacuuccagcaugauuucaugccauugcggcauuuuaacccaucaugaugcgaacagagauuacaaugucuaagcacuaaaggaaaagaagauuuuuaauguuagaucuguggaaaauaacuacuuuagaaagucaaaauuauacaaacccaacgagaagaaauguggcacucuucccccacccccugauauuauuaauggcaguaaugauuuccuccaagaguucccuacucauucacaaaucaaaacuuuagaaagaagacccagaagcaguaagugagguauggagaggaacaguguguaaaugguucaaaaacuucuccucguaugguaguaugauuuuuccaauaaaugcaagccaaauauacuguacaguuaaaugucagcacucuuucuccugugaagagaaggaaaauucaccuuaagucauuucauaguagccccacagugaaguauaaaaaucuuuuccuccuauagcauaacauucucuuuucuuuccaggccuuaccuacauccauaaggagaauuaugaaaacacucagcagaagcuucuggaacauaauugggccuccuucugaa

SEQ ID NO: 5005 - RNA, 3057 nt, Mus musculus
auaaaauaagaaauaaaauuuauaaggcauauaacauauuacagagcacccaacaacauaugaaaauauaaauguagaaggaaaaacgaucuaaguacaugauguagaaugcaucgugagggcuucagucauggucaguagacaauucuuuuuuggcaugcuccagggugaagacucaauaaacaguacugaaaaagagaaaguuguaaugaugucaauauuuuuaaauauaugaauauuuauauacauauauauaucaccuauucaaaaauuuaaaagguuuguaauauauauuaauacuugauaguguaagcaagcuauauguuugcaggguggcauaggauuucuagcaguuucuuuuguguauaauauuuucugcacuauuuagguuguauaaaaguauaaauguacugguacaaauacaaaaguaaaaauuccaaacagcaccaacuucaauaucucuagaauuacuaggaauaaagcuaaacaguagaacuuuccugaaggauaaagaugaccauguguaugugacuacacaguggaaaugaacacugccauagaagucuucucagacugucauaucugauucuaaucacuagaucacuagauggaacugagaaugucugguccaucaaauacaaaucuggcuauacucgugagaccauuuccagaaaugagguaaauguuuuugaccuaaccuauugacuuaaucuaauaaugcaguugaaauuuucauagauuauuuagagagguauauccugcuugguggaaggaagccacugggaacgagccccuugugguugaaaauuggccuggucccuucuuauugcacccagcuugugaaggucaagaguugaauauuucuggaccaauacagccucccauugugagauagaaaacaucucaaauuaugagcucaauaaaacauuucuccaaaacaucauuuuguuaaggucauggcagugagacacuaccuaaaacauacuccuaagucuauggauuagauugaagacauacaaguuaucauuaucucacuacauuggcagaaacagaaucuucagagggcagguuucaggacugucauauucaagccauuuaaaaaaaaaaucaguguccagugcccagcgcuguguucaucagacaggauguguuuguugaauuaguguagaaaggauagaaggaggaacuuguaccauauguccauuguguuggagggacauaggggaaaagggaagggaaucauaaugugagaaugaggaaguacuggggggggggaugugggaagcagggaacaucucucuagccuauugaacuugugacauaucaacagcuaauucuaagugcaugcaacugcuauguuugcauagugugggcaauagacugccaggguuaugacguuacagaugcacagggaacuaauacaggcucaccuaaaauccaacacugcaauuaagugucagauuuauaguucauugcagaaagaccuuuucuugcagcacuucauuuuuacuguuugaucuccagucugcacagucccagugaagcaaauguuagcacaucuuugguuuccaaacugaauuuugccaucuggagaggaagaaaaucaugaaacaaaauauaaauaucaguggaaagagugagucaguauagagucacaucagaaauacaagcauaucugaggaggacucucugggacacuauuccucaaacccuaaccuaacccucagguaggacucaauuccuaaaagugcugaguggaauuuuagacucuaauuccuaccauaucagacuauauauucacccagaaauuccccgaagaucuuccagauacauuucaaaacaauuuugucuucauaauucauuuguuugucugaccaauauucagugacagccauuaccaaaagcaaaagggccugucucuccuacucuuccuggcaaagacauuuuccuucaguaucugcauuugccaucaguauccuggagcuggauucaucauuguagggcaaggaagaugacucucagaggucccaggccuuacauaccuuuaaggguuaugagcgaggcacauuucucuccagguuuagccugacagcaaccuucuccacucucacaaauccccugagaauugauccuaucacacgugauacaugucaaagcugaaaagaaaaaaaauccaguguaagagacucauucagauagcaaacucaagcaccaaugggagcugagcauguagauauggcaaauaaauaagcaauagccaggaaaugagcugaguacaugcugagcuaacacuuucaugaagguucaugaucaaaggacucugaaaagggaaaguuggagaagagauggaagguuccccaaccucaaacuaugagaauggaucaaguuaucagaaugagaaucaaagcucugauguaggaugccuaaugcaucacacagcauuagguuugugaggcaucuaaaagagagagauggcagaaaggguccagauuuugacauugucaguuaagauuguauucauuggcacauacagcaaagggaagaauaucuccuacagaaaauucucaaaggaauccuguuuuuaaaacauaguauucuaucaugccagauuggauaaaucauuuuuuuucauuauuuucauccuggcaaugaccuuuguuucucacuuccaauccaaguuuaggccaauuugcauguaaacuugaggaacugaagauauguauuccagagaucagauaugaaggaagguggggaggaucagaagaagaagagggcaacagggagccaaagaaaguacagagagaaggacaagaaagcaucuuugagugugcacagcagaagcaaggggaggaaguggauauggauaugggaaugaagaaugguaaguucuaauguuaucuuaguuucuacuccccacaucuccaaaauccccuaauguguugcagcagucugucugcccaccaguaucgaccacaaucaucugccaggaucuuaccuugcgaggacaucaccagcaaagacaggaccagcaggagcugcaagaugugcuuucccauu

SEQ ID NO: 5006 - RNA, 1545 nt, Mus musculus
uuuauaguuuauugcagaaagauuuguuguugcaacaguucauuuuuacugucuuaucuccaaucauaacagucccagugaagcaaaggucagcacaucucuggcuuccaaacugaauuuugccaucuguagaggaagaauuucaagagacaaaauguaaauaucagugggaagagugagucaguaaagagucagauggaagguaugucagaaauacaagcauaacugaggaggccucucugggacauuaucuuucaaacccuaacuuaacccacaggugcaacuguauuccuaaaagugcugaauggaauuuuagacuccaauuccuacaguaacagacuauauauucacccagaaauucccugaguaucacccagacaacuuucaaaacaauuugccuucacaauuuguuuguuggucugacagucaguggcagcaauuacaagaagcaaaggggucuuuuucuucuacgcuuacuggcaaagacauuuuccuuccaucucugcauuugcuaucaguauucuggagcuggauucaucacuguagggcaaggaagaugacucucagaggucucagaccuuacauaccuuuaaggguuaugaacgaggcacacuucucuccaggucuagccugacagcaaccuucuuuccccucacaaauucuccgagaauucauccuaucacaugugauacaugucaaagcugaaaagaaaaauaauccaguguaagagacucauucagauugcaaacucaagcaccaaugggagcugagccuauggauauggcaaauaaaauaagcaauagccaggaaaggagcaggcuguaugcugagcuaacacuucaugaagguucaugaucaaaggauucugaaaagggaaaguuggagaagagauggacagucccccaaccucaaacuaugagaauggaccaaguuaucagaaugagaaaucaaaggucugauguggggugccuaaugcaucacacagcauuguguuugugaggcaucuaaaagagagagauggcagaaagggacccgagucugauguaguccgacaggauuguauucacugacacacacagcaaaggaaaaugucuuuccuacaagaaauccucacaggaauccuguuuuuaaauuuaguguucugucacaucagauuggauacaucaauuuuuuuucauuguuuucauccuggcaaugaccuuuauuucucacuuccaaucaaaauuuaugccaauuugcauauaaacuggagguacugaagaugcuuaaauauuucagagaacagaugugaaggaagguagagaggaggagaagaacaggguggcaaggaguuguacuacagaaagaacagggaaguaucuugcacagcagaagcaaggggaggaaguggauguggacaugggaaugagcagggucaguuuuaauguuacucaauuuccuguucuccacaucuccaauguccuaacaucugcuagguucuuaccuugcagggacaucaccagcaaagacaggaccagcaggagcugcaagacgugcuuucccauu

SEQ ID NO: 5007 - RNA, 18586 nt, Mus musculus
uacagagcacucugugucgcuuaguuugagccuuccucccuggggcuccgaggucaagagcaggucgguuuacguacuuaacggugcagccuuugcaggcucugaguggcagggaaccuggguucuuggcccaacugguggcgcagucuggauggaggcuucggugccucuguggagcaacguaaggcguggcacacgccccgugccauuuccauuucauucggacucagagaucaguucucaccaaagcagucgucaauaccaaaucuggucagcuugugucuuaacuacggccacaucagaauuucagccaguauuagaaggaaggguccuugcgcggucggucuacugaagucgcuccucugcagagccugggauaggacaacgcgcgccggcccgcuuuacggcagaggugugcgcuuuugcgacagcaugacgcaagcagguuuuggcgggaaaagcugugcauuuggauuccuguggcagcuggcaaaggacugcuuggugagaagggcguccugaacagugggaaagaacuccagcaaaggacccagagggcuuguuuaguguggacgggcgcggggagggagugguccagacuagcagagaggugggagggccgcccggagcccgggcuggagcggguggcccguggcucuccagcauaaagggaccagagcgauuguaaggcuccgggguucgcaugcuuucccggcucuaggggucccugccucccgcuucucuccgcggcuuggccccgcccuguucccucccggugcuggggacacgugccguuggggugggaauuggaagugagcgggugggaggaggggcugcucuggcaguaauuaccguaguuacacccagcugcuccccacccccgcacccugaccugcccgcaacucccuuuccggaucauucacccgaaagcucuugucuugcaacccuggagccaagcaagugcucaguuuugcauaaaggcggacggaggacaaacguggaaacaggauuugugauaaacaggacaaaauguucaaguucaguauuaugacguggguaaauaugguucagauguaagaugaaaagaaagucgugcggaaucauagcaggagacauggcucaguggcauuacaggugaugagaguuuacacucauccccaguauuuucugggauccugcauuuuacagucgcugugcuuggagucauggcagugccuuuuguggaagacugggauuuggugcaaacuuugggagaaggugccuauggagaguaaguuugaguccucauuuuaauuuuuuauugcagugugugucugucugucugucugucugucugucgugcuauggugcgugcaccuguggaggucagaagacaacuugcaggagcugguucuguugaagguuuggagggaucauuaggccugacagcaagaggcuuaaccugccuggccauuaccauggucuuccuaauuuaaauauuaccuguuuguuugcuuuaguuuuccaccuguugucugaguacacacuuuaaaaaaaguccuuuauuucaaguggcaaagagcauggauauucgcauuuguacaucaaggcucugagugagugaagcacauccacaccuguuccuccucuuuugugaugguagacauugaaccuagugcaucacucaugcugggcuuaugcucugccaugagcuacauuucuaggccuguaaaacaccaaauuucuucuuacauuuguuuuuguucagaucaaaaucuuguuaaauugccuagguuggccuugaacuuguacacuguagccucccagguagguaugacaagccugugcuugacgguccaauuucuuuucuuucuuuuuuuuuuuuaauuuuacuuuuauaaaauuuucuuuuauaaaagaauuguuuuccuaacaaaucaugugucuuagaauuuuaaaugagauaaugaaaagacccuggcggcauccugccuaauuucagaucuccacacucagcugauccugguuguauuuguguucuuuuuuuuuuuuuuuugguuuuuugagacaggguuucucuguauagcccuggcuguccuggagcucacuuuguagaccaggcuggccucgaacucagaaauccgccugccucugucucccgagugcugggauuaaaggcaugugccaccacgccuggcuguauuuguguucuugagcaagcuuuaugugccuuuguuucuucaucugaugauagaauuaaugguucuuaccuuaaagauguguucaguaguuggcucaggcauauaugcaugagauuaauaaguguaaaguaaugcuguuguauuacuagaucauguguauaugugauguauuguagacuugcuauugucuuucaaagcauggucaguuauuagauaacuugcaagcacaagguuuccaaguuuccaagacuuucuuggagcauuaauggcaaugcuucacauuugucucaaugcgucugagaacauagcagaggccauuucauuuuccuugaugaagaaaggaagaauaguuugggguguguuacaucuaacuuuuugaagcuuuuuuucuuaagauuuaugcauuuuuaaaauauggaugaguguuugcccacagagggccagaagugugggauucccccagaacuggaaauuacaaaugauugugagcuaccaugugggugcuggaaacggcugaggucugaagcaagugcucuuacaugcugagccuucucuccaggcccccccucagguauccccaccccucaguuuuguuuguagagagaauaaauaucucauuggcaccaaacuccaagagcucugcuugccucugcuucucagagacaccuccacccgcugcuaggguuuugcuuuuuuuguuuuuuuucuuugaaaguuucuuuguagucuaggcuguguuugaacuuggacccuuuugucucuagaaugcuggaauuacagguguguaucaguaaucuuuugaagaguuaggagaaagggaauucugaggugaaaauguuguaacuuuuucucucuuucuuuuuaagaguucaacuugcugugaauagaauaacugaagaagcuguugcagugaaaauuguagacaugaagcgggccauagacuguccagaaaauauuaagaaagagaucugcaucaauaaaauguuaagccacgagaauguagugaaauucuauggccacaggagggaaggccauauccaguaucuguuucuggaguacuguaguggaggagaacuuuuugauagaauugguauggaaaagauuuaagauaaauauuuuacugaacaccuucauacguugugugugcugcuggacauuaaacccaccaucuuuccacaggcccuucaacuggucuacuacucaaccauguucucagcuguuucuuugguuuuuagagaaaagguuccucucuguaacccuggcuguccugguacucacucuguagaccaggcugaccuugaacucagaaauccaccugccuuugcuuccugagugcugggauuaaagugugcaccaccaccacccaacucucuuagcugcauuuuuaaauguuagcuagaucaauuuuauuucagaauugguuauguaacaggaaaauuggaggaagagucaggcauucuugacuuugugauguaaaaguuuuaugauuuaagucugugauguagugaaauuguacaugacuucccuguuggcagucauugggaacuauuuaaaauuauuuauuuauuuuauggcuguuuuguauucuguguaccaugugcacaccuggugccuguggaggcaugucugaugcuauaagaggcuugaagaggguacuggauccccuggagcugacaaauuguugugacucaugugcgugcugagagccaaaucuuggucuuauagaagugcagccagugcucuuaacuuuugagccaucuuuccagcccugaacuuuguguuagaagaaguagggagacauuugaaggaaaugaaguccacugggguuaguauaagauuaaaauacuuuuaaauuacuuuccuaugauguuagcuuauuuuuauuauuuagcaucuagggagaugugaguuauuuagugauguauuuguuaauggacuuaagucuuuugauaguaugcauuuccguuugcuuaaguauaaacauagugagauaugaauuaagagccuguaugguugaugccugauuauaaucuuucaauagacuauaauuguuucuuccagagccagacauagggaugccugaacaagaugcucagagguucuuccaccaacucauggcaggggugguagguacuacagccucuuuccccuugcuuaaaauuagcaucaauaaugugaguugcuaaauucuacuguuuugaccucccacuuagguuuaucuucauggaauuggaauaacucacagggauauuaaaccagaaaaccuccucuuggaugaaagggguaagauuaauauuuuguuaauucuaucugucugucuaucuauugcaugaguacugugucuguauguacaccugccucucagaagagcacaucagaucucaguuuagaggguugugaaucacuaugugauugcugggaacugaacuuaaagaucucuggaaaagcucuuaacugcugagccauuucuucagcccuuguuaauguuauauuuuagguuaaucauauagaccugugucuuaguuaggguuuuacugcugggaacagacaucaugaccaaggcaacucuuauaagggcaacauuuaacuggggguggcuuacagguucagagguucaguccauuaucaucaaggaaggaacauggcagcauccugguagccaugauucaggaggagcugagaguucuacaucuucaucugaaggcugguagcagaauauucuuuuccagauagcuaggacuaggguauuaaagcccauacccacaaugacauaccuacuccaacaaggccacaccuccuaauagugcuacucccuggcccaagcauauaccgaccaucacauuucacuuccuggcccccauaggcuuguccaaacacaugagucuauggaggccauaccuaaacauugcauacauacauuuccccauagucuguagcagucuuaacaauguuuaaguccaaagucucuucucggauccauccaguuacuuaacuguaauccccaaagcaagauagagaaccaacugggcaaaugccgaacucugcaucuccaugaacucugcaucuccaugucugaugucagcaguuuucagauuuccaauuccuuuuucauuuuuguuuacugcaacaaacuucuuuuccugggcugguucuacucccuguuagcagcauuccucaggagauaaccuauagcucugacaucuugaaaaucuuggggucuccaaggcagcuuaaauguuacagcuuuuuguaccagugucugggauccacacaugaucuucugggcuccucuaaagggcuucuccaggucugccguuuguagcacucuaagcucagguugauccacucaacuguuguggucaucucaugguacuggcaucuccaaaacacugcuggcuuuugcugcaacugggcuucaccaauagcuucucauaggcuuucuucacagggucaagacucaacuccuuugcauuacuccuucaguccugggccaucaacugcaacugaggcugcaccuucaccaauggccuucuuuggucucucacagugcuaagccucagcugcucuucaugaccccuucaugccuucaaaaccaguaccaccuaggugacccuuacacauuaccaaguauagcugcagugugagguacaaccuuggcuaucucuggaacacagcuucuuugugcuuucagaaaacacuuaccagaagauuucaccucagugaugcugaucuaucucucucucucucucucucucucucucucucucucuuaaauuuuuuuauuggauauuuuauguauuuacauuucaaauguuauccccuuucuugguuuccuuucuggaaccacuccaucccaucccugcccccugcuucuaugagggugccccccccccccccaccucaccaucccagcauuccuacauuggggaauugagccuucacaggaccaagggccuuuccucacauugaugccagacaaugccacccucugcugcaugugugacuggagucauggaucucuucauguauacucuuugguuagugguuuagucccugggagcucuggaggggucugguugguugauaugguugauauuuguuaugcuauuagccuuuuucuuacauaucugaucuauaugaguauguauauacuuuguuuuguuaauuauuuccauauucauuguauguauauauauaugagaucuuguuguuuuuugauggacauuuauaacugauauuacaauauccuuacauuugugaauguggaauuucugcuguggguagguauggucucagugagaauuguuaguucaaagagugaauguuucaaauuuugacacuuuggccagacugcuuuuuaaaaaaggcuguacuuauugauaaucccucauaauaggauuuuucuuaauuucuuaaaucccuuugcuacaacguucucugaugucuauauuuuuauagccaggauaaccacaguuuauuauuaaugucucacugauuuuauuuccuaccugcauuggcugacacagugccuguuacuugcauguaaggaagccaugcuuaguuaccagcuuugcuguugacuccuuauccuccacagucucagugaagggcuuuacuaugcugucuuccuggguguguuuccaggagggcaucuacagcauccuuauuuaaccugcugccaacuaguuuuucuguugaugauaauucucuuucuuuaagaagauaaggucuuugcuaaguugaguauaaaugacgaugccuuuuacuuuuucuucuuuuccauauacauaguuuuauuuuguauuaauuauuuuacuuauuuacaucucaaguguugccccuucccuguacccccuugaagaguucuuccucccuuccccccucccccuccccucugagaggguucuuccuccguuaucccuccacccuggggcaucaagucucuacaggacuaggcacauccucuccuacugaggcagcccuacaaggcagcaacauaugugcuggaggggguggggguggggguggggguucagaccagccuaugacauacauagauuucuuuugcucauuuucagguagaaaaguucuauaagcccuaagcaaaaccaguguuacuuccaguaauuuauauauguguauauauauuugcaaaucuuuuacuccaaaguugucucuuuuucuuuugguuuagauaaccucaaaaucucugacuuuggcuuggcaacgguauuucggcauaauaaucgugaacgcuuacugaacaagaugugugggacuuuaccuuauguugcuccggagcuucuaaagagaaaagaauuucaugcagaaccaguugauguuugguccuguggaauaguacuuacugcaauguuggcuggagguaaggauauauaaucaugagaaaacuucuuuucuccaaaaagucagauuucucauaccaaaauaauaaagauuaaauaacccuagggaaucuuaauucuguaauagaaaagguugugagcccagccuuuaaucguggugcaucuuuccagcucuuuaauaguuuuauguuaguguuuaacucaucgccuagggcgauagguacuaaguaccguucggugaguguguuauauacagauuuauuucauauagaacuugaaggcuugaagucuggguggugaaguugccagcauggucauuuucugagggcccucucucuuccugccuuacaguugaccaccuuacugagaggagagacagacucuuuagugucuucauaaggacccaaaucccacuuuugagggcuuucauacucaugacccagucaccccacaaaggccccaccuccagaaucaucacacugggaaugggagugagugaucuggcugcaaacagugaucuugguuugauuugguugauuugccuggugaggcugaugugggcucaguugaagaggacaacuuuuccuggauagaagaggguuagccuucgguguauugaguagcuuugauucccugcuagauccuccaaauaagcucucacauucauuaucuuggggguugagauuuugguauaaacuguagugggaaauaaacuuuuaacccauuauacuuuauaucuuauucuuaacuaccuugaaacuuauaacccagagguuuauuuucaugaaguauaaccauuaaauuaaaaaaucucaacacuuccuuugggguuguuggagauuaaacccagggcccaauaccugacaggcaagaauucugucacuaaguuguaucuccaucuuuaauaugauaccuuugaaaagaguaaguuucuaugaaacuuagcaugaaaaccauauugaauuacuguggagaaaaauuguauucuuuuuauguuguucauuuuccuuuuaugugcuuauuuuucuugacauauuuguuacguaacuuuaugaacacucaaaaacuguaacuuguuuuauuuuuagaauugccgugggaccagcccagugauagcugucaggaauauucugauuggaaagaaaaaaaaaccuaucucaauccuuggaaaaaaauugauucugcuccucuggguaacuaacuggguuguuugaaaguauugauccuguggguaauagugucaugguaguugauuuuuuucuuaacucucucccccccuucuccuucuuuucuuccuccuccuccuucuuuucugacuuuuuucuuccuucuucuucucuguaguccuuuuaacuaccuuagaaaauguaagucaagagggaggaagggaggaaaggagggagggaacaacucuauaauuguggcauuuggaaauacacuuuuaaaaauauuuuuaaaaaaucuauauaucaaauguauacuguauguauauuaguuauaaguauaugcuuuugcaaaagguaaauccuauuucauaacucuuuaguugugaugcucagcauuuuuccacaucuuuaauuaugggccuggaucauauuuuuaaagacugaugguacucauuauguggauauauuuuacucuuucaauuuagagauuuagguuucuccuuaauuuuacuuuuauagaagaaguaugauaaguguccauguuacuugaugcuuguguauccuuuauuugauuaaaguuuuuucuucucccacaagcaagacuggagggcuaagagacuauguauuuccccuuuuaaguguugccccuuauuuuacaaauuuacuuuuuaaauuuguaccauuuugucauuuauucauguuacuuuuuugcuguauuuugaaacacuggguuucauuguauccuuggguggucuggaacuuacuauguagaucaggcuggcauggaacuuacuauauauauaaucgaccaggcugacuuucauauucagagauauuggucugccucugccuagugaauacuggcauuaaguacaccacuaugcauggcaaaaaugaauuuuuuaaaccaauaagacuguuuuuuaaagcuuuuuaaauuuugcucuguuugagcaaagaaguuuauaguuuuucuuaauccuuugagggucuuuucauaacgcauuaauguauauaacguuuguugcaguauuuccuagaguuuauuauuuaauuuugcuggcuauuuuaaugugcagauguuuugaguuuuucauaccuaaauucuugucauuuuuggcuuuugacuuacauugucaugcuuauuagaaaggucuuuucuacucuuuuuuuuuuuuuuuuuuuuuuuuuuguaaaauuauuugcauucucauuugguguuucuguggguuaauuuuuauguuugauuguuguuggcuuugauuuugaaacggucuuguuuagcccaggcugacccugagcucaguuguguaggagaggaugauuuugguuuuccagacuccaccuucagaugcuagcacgcuugucuguuuugggagacaaggucuguguuggcccaugcuggccugaaucucaggcuggaccugacuguggcaauccuucugaaagcugggacuaaaagcugagucacuuuucauuccugguuuaaaagaauugauuuauguaugauuuuuguuuuuuaaauguaggagugcucuucuguauguacaccuacauugccagaagagggcaucagaucccuuuauaggugguucugagcuuaacugccgagccaucucaccaccccccuggauuauguuuuugauguugugauguuggggauuguacgaguuccuuuuaaaauuaauauauauuuccuaagcuggccucaagcauucugccugugccuuucaacuauuaagguuguaggcguguaccauguuuuuggcuuuuaugccuuaagguuugucuaaucugcgaaccccauuuacaaauacugucuuauuuucuuuucagcuuugcuucauaaaauucuaguugagacuccaucagcaaggaucaccaucccagacauuaagaaagauagaugguacaacaaaccacuuaacagagguaaauauagauacuuacaaaauaccacaaaccagugugguaaaauaacuguggucuguccaaaugaagauuuuaauaucuaguaggaaaaacaaauguggaaacuauuuucguucaugaacagcuaaaaagagugcuauaucucaauguuugauggacucuaauaaaacaagauuuauuuuccucaugaggaaaugauguaaagucuaaauuuugaagauuaaaguguuaauaggugaggcauauuugacuugagcagaagcagcagcauuuggucaaaucuuagauuuagugggucaaguguauuugaagaacuuaaaagaucaggucaguauaacacagacauuguguuucuuguucaucauuagccagugguacucaggaaaugcuugcggagugaguggguagagaugcgggggagguuugaauugauuugggaaaggcagauaaccaaguuauaggacggccuuucugggcuguguuuaggauuuauccuggaacucaccaucacuaggacacguuugaggggcuuuaagcaagaaaaugacaagcugauguguuuguuuuuuuuuuuuuuuuuuuuuuuuucauuuuuuauuagguauucagcucauuuacauuuccaaugcuauaccaaaagucccccauacccacccacccccacuccccguguuugguuuuaagaguguuucuuucugaauacuucauuauuuuuugaugagaaugaagagauuacguaaugugggauuuggggcuggagagauggcucagcgguuaagagcacugacugcucuuccagagguccugaguucaauucccaccaaccacaugguggcuuacaaccaucuauaacaggauccgaugcccucuuuuggugugucucaagacagcuacaguguacucaucauauauauaaaauaaaaauauaaaaucuaaaaccaaauguuuuuaaaaaaaaguagugugggauuuuacaguagggguuuagaugugagaagaugguagcuuggaauauguuagugguaauggcauuguagaaaggugauggguuucaaagaguugaaauuauuggacuggugagugcuuagauuauaauagauuuugaagauaucauggugacucccaagugcuguucugguaacuuuggaggagaaacuuauuuuauggagcugaguaagcucuccaggagagagagagggagggagagaaaggggaggagagagguggggugacagagggaggggaggggagagggagaaagggagagagagagaggagggggcagaaggggagggagacagggaggcaggugaggagagggggagaaagagugcgugugugggcacguguguguguguguguguguguguguguguauguguaagagaggcauaagaaguauauuugcagauuugguagugacauacuguguuauuuuaugucuguugacauuaauuuuucuaaauauaggauaguauaucaugcuaaguaauggaagggugggugguaucaauuucagaagagaacagaaguuuugaaauaauucuuucuuagaaagugugaggagacaaguagcaugcccugauguagucuagcugagggccuuauucuguauugacugucauucuuuacugaguuauuuaaaaauuuuaaaaguucuagucauugagcuagucuuuugucgaacaucauguuacccauaaaauauggcauuaaaauuguggccuuugugaagcauuaguguaacauuccuuuauuuaaacauaaaauuguuuaaaagaaguuuauauuacuuugcagucuauaaauggauuuagauguggcuuuauucaaauugcuaguuggauuaaguacuugaauagaagauuuguauuuguucccuuuuuuuuaaggagcaaagaggccacgcgccacaucaggugguaugucagagucuucuaguggauucucuaagcacauucauuccaauuuggacuuuucuccaguaaauaaugguuccagguaagacuuacaaaaauuaaauuuuucucacccccacccccuuuuuuugagauaaugucuuacuaaauaaccucaauggaacuggaacuggguggcccacccuggucuugaacuuguauaacuuguauugauccuucugugucuguuuccugaguguugugauuacaaguuuauacuaccauggauuggcagauuaagcccuuuucuuaaauguaguuauuccccacagagaauaaaacaugaauauauuuuaccuaauaaugcaaauaauuuuaccaaaaugagaaugaaugugugauauaagaaaauccugguagguuuuauguaaagacauuuuuagucugacucuguauccuauacaauuauagucccagguaacugcuaauuggaaggcugaggcaggaggauagauugcuaggccaggccaggccaaucuaggcaacaagauguaaucuugucuuaaauaaacaaacaacaaacacaaaaaugaauaauuagaaagaaugaagccaccuuaaaaacagagacuugaagccauucuuuucuucucuuuuaaugucucagugaagaaaccgugaaguucucuaguucccagccagagccgagaacagggcuuuccuugugggacacuggucccucgaacguggacaaacugguucagggcaucaguuuuucccagccuacguguccugagcauaugcuuguaaacagucaguuacucgguaccccuggaucuucacagguaaggaacuugauuuuuucaaauaaauaacuugcuuuuuauuuuuguugucuuaaaucuuagguauaugguauuaauacuuuuaguugauacauauuauuuggauaaguaagaaauaauuagaggaggccauuaagggggaagaagccuaagcuaaagaagagaauuucagacuaauugcuguaaacuggucacacuggauugauucaguucucuucucugaugugcagaaccccuggcagcgcuuggucaaaaggaugacacgauucuuuacuaaauuggaugcggacaaaucuuaccaaugccugaaagagaccuucgagaaguugggcuaucaguggaagaagaguuguaugaaucagguagguuuuguuaguuuucgauauuucuuuucccauagaaaauuaaauauuugaguaaaaacuauuagugaucagugagcauucuaaaaauauaaauacuuugaaaaagaaacaauugaaaguuuuaagaguuuuuuuguauguuuuuuuuuuuuuuuuuugucuugccuuguguuuucaaaaaccucugaaguuaguauuuuauauuaagcugcaguugaagaugugccugccuccauguuuggggucuuggugcuggcucuuggcugcccucuuucucucccaucggucaucuugcccgagcugcuuagagcuacuuaccgacacuaucgugucauuauuguucuaguuuuucagccucaaauagcuucucauugucuuucuuguauuguuuuuuuguuuguuuuuuuauuucuuugagauggguuucucuguguaacagagcccuggcuguucuggaacuccuguagagccagcuaaccuggggcucacagagaucugcuuacucugccuccugagugcugggauuaaagguguuugcuaccaugcccggcucuucuuguacuguaugugauaaucuuguuuucuuucucauauacuugacugauugauuggcuacaguauuggggauugaacccaggcauuauguaugcugggcaagugcuuuacuacuaagcuacaccuccagucuucacucuauuccuauuccuuuugauugguuuuucuuucaauucugcuuugcuaaaauaccuuuuuuuuuuuuuuuuaaacuaaaaguucacuuagacuaaaguucuaacuuauagcuugguuuagguuggagagagagacagcuuuguuuguuuguuugucuguuuguuuguuucuuucuuuugguaagguuuauuuauuuauuuuuuaauuuuacgcucauguguaaagacugugaugguguacauguguaugucagugucuguggaaacaucagauccuuuggagcuagaauccuagguggccgagagcccccugacaugggugccaggagugggagagagaguggcaagugcuuuuaaccugagccaucucuccagccuugaaauguaugguguucuucaugauacucuguuaagcaagaauuguuaagacuauuuucuguucauguguguauguggcuugaccuuauucuuuauugccuuagguuacuguaucaacaacugauagaagaaacaauaaguugauuuucaaaauaaauuugguagaaauggaugagaagauacugguugacuuccgacuuucuaagguauuuuucauagauuuuauucauaguauuuuucuauggaaauauuucuauguagcuuuucaaaauggcuuuauauuuuacuuucagugguccaccucccucccccacucccuuucucucucuugccugucauuuaauuuugguuuucauaauaacuguggaaauacuauaugcuuuuuguuuugugguagcuuuaguaaugacuccaaaggguaagagugguaaugcuggcaguuuuauuacagacuauuguuauaauuguucuauuuuacuacuaauuauauuacucuuacuauggcauauuuauagauuuagcuauguauacauaggaaugcagaugguauaugccaugugaaguuccauccuaugugguuucagacuuccucagaaaguuuuccacaugaauauguuauaacuaguuaguuggcauuuguaaauauauuauaacucgauuuuuuucauuuaguguuauaaacauugacuuuugcuaucaucuguuuucguaaaauguuacuugguuguuucucucugucuccccuucucucuugcuccuuaguauaaaaauguagagggcuagggaugaauuacaguuuguagagugcuugcuuuagcgugcacaagcucugagauuggauccucugcacagauaaagccagguauggcaauaucugccuauauucccagcacucaguaggugagaacuaucagaaacucaaccaguuuucagaccagcccuacaugggacucuguucucccuaaauuuuuuuuuuguaauauauacagauaaaugaaaacuaaaagaaaaaaauuaaauuauaccuuugacacuuacaauuuaugauauuuuggaauacuaaauuauuuugauucauauauaauaucuauuuuuaaaauuauuuacuuuacacccugcucacugcccucuuuccaaaucuuccccaucucccucuccccuucuccucugagagggugggggggggggaagggcuggggcucccacacccacccuguaugaaugucuccucgaggccaggcacuucugcucccacugaggccagacuaggcagcccaacuagaagaacauauccuacguacagaagaccuacuauuuuuuuuuaauaaaaguuaugacauuaaaaacuuguacauuauaauauagugaacuucacagauuuugugauuaauaccauuuugcuccccuauuauuuuuaguuuaaaagucuauucuguauuaaaaucaauauaaugucuguuuucugauaguucaugugugguucuagaaaggguugaagaguaauucauguucuguaugugggagacugguugaaauaauucuuuucuagauuuuugauauaguuaaagguuucuucucuaguaaaacccauaaauuguuauaaaauccuguucaaacaagucagauuuauauggaaugcauaacuaagcuggaauguuggugcauaccugcaauccaguauucucagaaaagaaccgagaggaggaggcaagaagaacuggacauaguuaaggguguuuguuucuuuggucaggaaugagaaugugcuuuuuugauacaaucuuuuuuauauuuuuaaaauauuuuuccuaaaauagggugauggauuagaguucaagagacacuuccugaagauuaaagggaagcucagcgauguugugagcagccagaagguuugguuuccuguuacaugaggaagcugucagcucugcacauuccuggugaauagagugcugcuaugugacauuuuucuuccuagagaagauuauccuauucugcaaacugcaaacaauaguuguugaagaguucucuucccauuacccaaacaucuuccgauuuguaguguuuggcauacaaauacuacuguauuuuaauuguauguaaugcuuuggggaaaggauggaucaaauucauuagguauuucuccagcugucuuuaaauugucuggauuugaaaccaaguuaugggauacuugaguuugccagcuuuuauacccauguaguaguaucacuuuugaaaaaucaaaagcuuguuucaucccaagcaaaauauuuucuucucugccuauuuaauuguaaggaugaauaaacacagaccauauacaguugauugguucaugaaugaggccagccacaaaaauguguauguuaauguauguacuguauuuucaguuuggguauaugugcugcacaagggcuugaccaauuauaaaacuuuuuugaguuaaaguguuuuaaauugcaaauuuuccuccuggcguagcuugucaaauauaaagacuaauuugguuggauuuucacaaaguugaacauaaacucuagugcuuaagugacauuacucuaaaaauuacacacuuaaacaauuuuuucuagauucacagccauauuuuaauuacucuagaaauaaacuauuuucaaaaucaauaucuaacucugaacuuauuggccagccaccaaguuucuagaugacacugacugaaaaggggcgggaguaaggaaaugcaggaguugaccggauccuuguuccucaccuuguacacucacuuaaacuuuguuuuguucauaaaauuuauauuaaaauaugaauauaugauugggguccuguauuccuuuucauagauaaauuccaacauuaguuagucugaaagcugagaacauuuaaaauuuuauggcucaaguuuauuucauguugguauaugcuguugucacccacuuaacucucccauccccaaaaguuaacuugaaccuaacucuauucagucuccuguuucccacuuguagucccacugugguaaaagucagccaucuuguuaaaaacguuacuuauucgaaccccaagucccaucugcgcuguacuguuuuaugucauugucuucuucaucugaugguaugcaguacugucuuccgagccuguaucucucaagucaugauugcuuuccgccauuacuuggcaccuacucaacuauauugcuuuggucuccaugauuuugaauauucuuguacuucauauaaguagaauuguauauuugccucuuaguguuuggguuacuucauaacaacucuuuucaggauuuaucuauguuauaacauaucagguuucauuccuuuuggugacuaauacuccauauuauguaugucugugcguguguguguguguguguguguguguguguguguguauguauacucuuucauaugaucaugcauauuuggauuguugccaccuuuuguccauguaauugauacuggugugaacaugaauauauaaguaccugcucaaguauguuuuuaauuuuuuguguauagacccugagguagaauugcuaugucauaugauaauuguguguuguuuauuuuuuuccgcuuauaaaauacaacaauuuauuuaaaauuuguaacaacuguuuuuugaaacaggaccucacuguguagaucagacuggccuuuggccugugaacucauuguccagcccaggcuguuucuuuuuuuccugacucugucucccaaauacugugauuacauagcaugccuggcccaacuugacuuuga

SEQ ID NO: 5008 - RNA, 37783 nt, Mus musculus
aaauauacaucgacggaggcuagccaaugcggagcgggcagggaggcgggccuuggcugcugucaggguugagugcgccgcugaacggauggcagggggagcagaguggguuccugaggagcauccgugaggugagaaacucugggguagcgcuagaggauuagcggcaggugccgcgcgggcuguuggccggcccgaacgaggugcuggacacaagccuguagagguggggagcagagccugccugcggccugggcggaggagggggcguggagugugagauggggacguccaggcauuggggcaccagacgaucugaggaagggucuuggcagagcaaugcacucuggccaugagggcguggggcacaggauccugggacuagcuuggaagggccacgcggagugugcugagauaguggguucgaagucagugagggugcacaagaugacguggaaacguaugugggaaaaccaccgaggcugcagcccuagaauuuagagcucgggugggucaaggcuugcagacacagcugagaagcagagagaugaugagcagauaagaaaagcguccuuucccuuucuguacccuaucgguguguggagauugccaagaacgguaugaaaacucgcaguguuuagcuuuaaaguccagguuuuagcacucucgcugccuuugcuuacucuucagguguguggaucauauuagcucagugguguuuaguuuccaugucacuuaucuccugagaacaacuacaaacccaagagaugggacugaguuguucacuucccagaauuagugcgugauaagccuucccuuuggaauuauaauuaaucacaccagcccaaacugcucuuuugguauaguuaauuaaaggaaagauguuagacuucgcagugugagucuucguguuuuccauuuuguccaguguuuuccuuuugcaacccccuggucccuggaaagaagggaacaagauaaugcaguuuccccuuucccagcauaguuuugaacagugcuacguuuucucaguugccacacucuuuguuucuuaguccuuaacauaccaauugucuauaauugaucaccauucugaacugucugcagauugcuucccuuaccaccauuccaaaauuuauucuggucuagaagaaacaaaauuauuauuauuauuauuguaauuuugcucuagauuuucaucuggugcuccaaguucucucugggucaugaaaugaguuacagggaaauagaccugagcaguaguuacaguuugaacuuugaaaaugaauauguaguggguggccugaguauauuucucucuugagugcauggauugaacuugcauuagugaccaccugcucuuuaguuggccagagagcaugcacacugggauuuggaacagaaaaaagcuuguagccaaucaauugaggcuuagauuuauagcuggaaauuaugucuagucagucaugauuucuagauuucuccuuucacuucaguaaguaauguucauuuccacuuucccucccuucccacuuaccuuccugcccaaauuaccucccccucuuuccccaccuucagccccacuuaacuuucucuguggcagggucucacauuaacccaaacugacucagaacuuaacuggguccaugcugaacucaacaguacagugauccucuuccucaguaucaccaaguguugggaaucuagacaugggcuaguguaccuggcuuguacgcucuccucucaugcccacuuauguuuccgugauuauuuucuuuuucccuuuuaacaaguaccuuuguuugguuuucccucuuucuauuuucacguccuuuucuacuuuccuuucuccuccacuucuguuucuuucugauccuugugucuuacuuuugcuaguuguacuugguugcugugcaacuaggaaacagaauuguggguggaauauauauuucuuuuuguaguacugaaagauggaaaccagggcuuuuuugccuucuaggcaaauacuccguuguugaauuacaugggcagcccuuuuaaauaauuuuaucuugggacaggcucucucuaaacuggagccuuugauucuucugucccagucucuuaaauaccugggauuauagacguguggaguguguguuuugaguacucuuuuuuguucuuuuauuuuuggcagaaaggcaauauaacuagguuacugguaacucugauuggccuagaaugugcuuuguagaucagauuggccugccucuaccuucuaaguauugggauuaaaggcgugugccacuaagcauggcucucccuuuuucauuuugacauauaaaucuaauaauguuugcuucuucccuguacaucagucuguagucccagguuggguuaccucugugguguuuuuuguagcucacguauauucuaugguucuuaaccaucauaaaagauuaaagcuaauuuaaguaaauuuaguauauucaguaucuuacagucuugacuuuuuccauuuuagguauuugaauaucaucaguugccacccauugaugucaagaugacuaagcuuggauuuuugcgauuguccuaugagaagcaggacacacuucuaaagcuucucauccugucgauggcugcuguguuaugugagucugcguacgcuucuccccuuggagcugggaugaugagaacauuaaaaacagcuuuuaaaacauggcuuauucuuuuagcagauggcuccuccuuuuuuuuuuaaaauuauuuauuuauucuauguauaugaguauacuguugcuaucuucagacacaccagaagagggcaucgauccuauuacagaugauuuugagccaccaugugguugcugggaauuguacuaaggaccucaggaagaauagucagugcucuuaauggcugagcuaucgcuucagcccaagauugcuguucuuuuugccauuucucagugguauaauuuuuuaaaaauuuuauauauuuuuuuuacuuuacauccaguucacuguuuccuuucugugucacuggcauaauuuuaugaagacaaaauaacucaagaaauguaaaccuuaggcuguugauaggaaaaacaggaaguauucugugcugguucuguuuucucauugggugaaagaaaguagaagcuaucagauguugaauuuaaaaaaaagaguauucuuuuaaaauuuuacgugcaaugguguuuuugcuucuaucuaucuaucuaucuaucuaucuaucuaucuaucuaucugugugaggguguugaauccccuggaacuggaguuauagacagguaugagcugccauuugagugcugggaauugaacccagguucucuggaagagcagucagagcucuuaacuguugagccaucucucuagcuuccagguguguuguaaaagauuuaucuucaacucuguugucucuaauaguugcuaguacuaucuugacaugaucuaggaucaccuaggagacaagcccagggcacugcagugaggaauuaccuggaugagguuuauugaggucggaaagaccaucuaaaugggaugaugcuuuucugggcccugaauugaauugaaaagaggaagagagcagaacaauuaaugcuucuuccugauuggucucagugugaucuguugcuauaagcucugccaucccucuucucugcauauugcucccucauccuagaacugugagcccaaaugaaccuauucucucuuacaucaggguauuuaucacaucacuaggaaaaguaauuuguuugaggcagaguugcuacuuacccaguuuggcuucaacuccucucuuggucggucuuccaagugcuggcguuguaagcaaacacaacugcaccuuaguauuucucaaauucuuuugaaaauuuacugcuuuuaaagcuuucucagcucuucaugagucaaauauauauccuugcuugauaauauuccaagauuaaaauaagagggagaugaguaaaagauguaaaaaugggcaaaaucacaugaaagauggccaaauucaguauuagguaaauaugaucugauaggcuuuguguaauacaacaguuaaaaguaucccauuuaagugaaaacauguagacacuuuugucagacuuguagugucucuucuagguggugagaaguggaugaagauuucauucaagaacuauuuugcgucuucugacuccagugcuaaagaauuguagcuuccccauaaugcugcuguuuaccuucucuuguucuguaauagcaugccacuaauuacaauauucauucucuggauuuuguagcuuuuucuacucgucuuuuugcugugcugagauuugaaagugucauccaugaguuugauccgugaguaccuuugcucugacauuauuuccuucuagagauguugaaguuugugcguuuuuuauguguuuauguuccaaauaguucuucagugguggagauuuuuuucagcacauuuaaaggaagacuuugucaagguuuccaagugagucuuaagaucucaaaaauguaauagacuuuguuguuaagccuugaggucuggcuaggcuaagagaaaucuggcuuuuuauuuugaccaagugcaguagugcaccuuaagggaaagaguccuggaguacauuuaaaucuagaaaggauauuacaagucaugaacuugagaucauaacuucuuuuccauuuauuuauauaguagaaauugggcuuauuauuaaauucuauggcauuaaaaauauuaaagcuaugagagcaugguauugugacaaaugccuaucauccuggacuguauagugagagucucucucaaaaaauuaaaaaaaagccaauacaaauuaaaauuuaaaaaauuugggcuuaguggcacauguuuuuaauccuagcacuugggaggagaggcaggcagaucucugagaucaagaccagguugguuuacauagugaguuccaggccagcuaagccuucaaggcaguaccgugaaauccugucucaaaagaaugaaaugaaacaaaaaccagugugggcuggagaugguuaagaguacacacugcuuuugcagaggguccacauuuaguuuccagcacccggguaagauggcucacuaccacgaggccucugacaucuugagacaccuucauaaacacauaguuaaaaaaauaugcugggcgugguggcgaacgccuuugaucccagcacuugggaggcagaggcaggcggauuucugaguucgaggccagccuggucuacaaagugaguuccaggacagccaagguacacagagaaaccuugucucggaaaaaaaaaaaaaccaaaaaauaaaaaaauaaaaauaaaaaaaauauauauauguugaaaaaaaaacccuucgaagaccuaaauaaaaaaaucuaagauuuuguuuauuagauuaaaaaagauaugguaaagccuucaguaguauuaauaacuaacauuagcugcguguggugguggugaugccuguaaccuuaggacccucggggccaagaggcgagaggauuuuggcaaguuggaagucaacucuggauacauagguccuaggucaucuggagcugcauagaaagccccuaacuccaacaaacaaacaaaccaacccaaaugggcucagugggugaaggcacuugcugcuaggauucaguuagauccccagaacucaugguggaaggaaagaguuaauacucaaagguugaacuuuacucuccacauacagcaugacaccaccuccccuacccccuuuacauaauucuuuuuaaccuaacauuuucuuuuuuuuuuuuuuucuuuuuuuuuuuuccauuuuuauuagguauuuagcucauuuacauuuccaaugcuauaccaaaagucccccauacccacccacccccacuccccuacccacccauucccccuuuuuggcccugguguuccccuguacuggggcauauaaaguuugcguguccaaugggccucucuuuccagugauggccgacuaggccaucuuuugauacauaugcagcuagagucaagagcuccgggguacugguuaguucauaauuuaaccuaacauuuucuaagcaucuuuuuuucuucugagaacuauuuuacagauuuucuuuaaauuccccaaacaaugaaaugcggcacaguuuuuccuucugcugaggaggagacugggacuguguccacaguuccacauuuacuagaugggagccaugguuugaacguagcuuugucugauugcagacuggggucauuguuaauagugccuaaaauugaggcuuaugaaacacuuggaaaugagaaguacaguuuuuugacuuacugaaagcuuaaaaauaacacguuccuauuuaauaacauugcuucaaaaguuuaaggccuguacuuuguuugcaaaaaaaacuugucauuuuguuuuguguacguauuuuuuuuuuuuuuuuuugguuuuuugagacaggguuucccuguauagcccugcuggcuguccuggaacucacuuuguagaccagacuggccucgaacucagaaauccgccugccucugccucccaagugcugggauuaaaggcgugugccaccacugcccggcuuguguacauauuuuaaagaauuuggaggccuuggauguauuuucuuugaggaguucugaauaauuuuacuuuuucuuuuuuucucaugaggacacuguguugguuaguuuugacuguuaacuugacacacuaaaaucaccugggaagagucuuuguuguuuguuuuuuugagacagggucuuacuuugucacucuaucuguccaggagcccuauguggaccaggcuggccuugaagucacagagaucugucugccuuccuccgccuccuacucacuggaacuaaaagugugugccaccacaguagccuuggcagagagucuggaugaauuaucuacgucagguuggcuuguaggcauauuagcgggggacugucuuuauugcuaauuaguaaggaagacccaguaaaugacaucauucccuagaucuugaauaguuuaagagaaaaauaacuuaaaagcaggcaagcaggcagacaaacagacaagccuguauguguucgcuuauuucucugcuguugcccggggaugugacuagguguuuaacuucuuugcuagcauggacuguuaccuggaauuguaagccaaauauuugcuuugucaccuuuguuguuuuugucuuaaucuaaauacauuacuuuuuuuguuuugcaguuuuaaaaaauaaaugauaguuagugucuuuacucucuguccacucuaaugccuacuguuuuuuuguugucagaguauuuuaucacaggaacagaaaugaauauacaacucauaccguuuucuuugcuuuccuuuuuuuuuuuuuuuuuuuuuuuugagauagaguuuuauguaguucaggguaguucuaacccgcucuauagcacccuccuuguagguaauguacaugauuacaguaacacagugacugccuucuagaacccucauccuuucucucucucugauaguuaccagaauaauauaucugugaggaacaggaggacugagcucuaugucauccgcugcuucuccuuaccucagcugucaaaacuugauagaucaaggagaaaaagaggguuagggagguaggcugggaagugaugaucccuaguuagagaccccauucauucacuugauuuuguucuaccuuucccuuccuuuucacuuagggaaaggcucuaaaaaacugcucauguuuaguccuuaacauuucuuguuaaacacuuuuuauguuaugcuaggcugguguucauauauauuugaaauaacaugaauggacuuuguuagaaguuuaaacacucauuaggaaguucuuguuauuaugugguuaacuuuuucuucguuguucauuugguguuauaccaauaucuuuauagguauuuauuacuuagagguuucuauguguccuugugugcuagaggaagaaaacguaugcuagucagaucuacuaguucaugccucagaagucuuguguuuugggugauugaauucuuuugcuggcuuuguuaucuaccacaggcuagccucuugaaguguccugucugagugcuuuguuauggacauuagauuuccaguucauuuccuucagagaaaagcagugcuguaauugauacaagugugagauagaaguagagacuuaaguuaauauaaaugauuuugauggcuuaauuuuugguaguaaacuuuuuucaaguaaugcaguaucccucagugucauaaucugaaaaacaaacucauugcaaaguaagacauuugagagcagagaucccggggacaugguucuuuucuuucuugcucuagguacuuuaauuaucggacuacccgguuucuggcugaggagggguuuuauaaauuccauaacugguuugaugaccgggcuugguacccuuugggccgaaucauuggaggaacaauuuacccaggugagggggacaggauuuguuguguuuguaaggauggugugguguuuguaugcugugaaacagcucuuucuguuugcuucaggaaacuuguaauuucauucugauuauagauuuccaaaaguugaucuuaugaaggaaaugugugagauaguagagauggggggaggggaggauuucuuacgcauucuggaucucugaauccuuaauagagaaguguagacacuuaguaaaguugcuaugauaguauuucuaaugguuggucaagacuuggauugaugcuuucuuguuauuuucuuaccaggacaaccuaaugggauuacuuuuuccuguuucagguuuaaugaucacuucugcugcaaucuaccauguacuccauuucuuccauaucaccauugacauucggaaugucuguguuuuccuggccccgcuuuucuccucuuucaccaccaucguuacguaccaccuuaccaaagagcucaagguaaaggauaugagugacaggaagcuugggagugaauguuguugaaucucuaguagaugcugggcgggugggggaauccagaaccuuaggaggacagggaguuuugaggggagauguguacaaacaucuacuuacaccacagauagggaacucaaugacaaaccaaaguaaggauaccuccaaaguucaacuuggcgaacugauuauuuuuauugggauuaaagaaauaugggugagggguuacuuaaauaaaagcaggaaugauuuaaaaaaugccagacacaucaccaaaagucuaccccaguauggguggcagcucacaaaagcuggaaucccagagcuuacugcaugacuggcaagcagcuugacagauuggagaguguuucuuccaagcagcucaguuugucugggccucuucuaggcagcuuggcaggucugagccucuucuaggccacucugcuuuucugagaaugucucugagcaguucuuacuguuuauauacacuuggggagccaggggccuagugauucucauuuguuuccuaaagcuuuugaguuguuuacuuuuggaauuuaagguaguuaaauuccaaaaugccucucuuuaaaacagugguuuuuaaucugugggucaugaccccuuugcaaaucucugucuccaaaaauacauuacaauuuauaacauagcaaaauuacagguaugaaauagcaacaagaaauaauuuuaugguuugggguccgacaacaugaacucuauuaaagggcuacaguauuagggaagguugagaaccacuguuguagaacuuuuucugucuuaaggagcuucccuucaguguggcugguuagaucuugaaggaaguuggaaauuuuuacacacuggggagccagaggcuaaagacaaaguuuguugaguugaauuaguggagaauaugugcugucuuauaauuugcaacuguuugaccuuuuaagauauuugaaacucagacauaaauuguuaaguaaagaaauaaaaacagcaguuaauauguaaaauugucauguuuagauuuuuaaucccucaccaauauaaggaagaaggaaaaaaaacaaccuauguguuuuccacagugguuauuucuacuggaaauaggcguuuagcaguuauuuguugauacauuuuaaaaagcauuuugaaauucuaaagcauuuugucuugguaaugcugauucucccuuuucagguuccuugcuaaccuugacucuuuggacucuguucuuagucuguggccuuaguuuuagggagguaccugagaagugaccagcuagcaggagggcuuggggagccagggucagugugcaagccuucauccuucagugugauaaucagcaaacaaguaguuuugcuuauuuacuuacuuauuucugaguaugguuuuauucugaccuuacagguugccugguuacccuccaacuuuauggucuaagcuccugacaucuuuagucuagguagauucucacuuuuuauugaguuguuuggagauaagguuuucauauggugcccaggcuagccacagaauugccaucuuuaugucucugcuuuccaagagcuggaauuacauguauuugcuaucaugccuaguucuuuuuuuaacuuaaauaauaacuuuauuucuuuguuuuagauuuggcuuuuuuuuuuuuuuuuuuuuuuuuugugaucuauagucacuguuaggggauuaauaagccuguagcaaaguaagccauucugcugcaaauucuguuuuuguuuuuguucuucuuuuagacagagucuuacuguguacuucuggcugaccucaaacucaccugccucugccucucugccucucugccucucugccucucugccucucugccucucugccucucucugccucucucugccucucucugccucucucugccucucucugccucucucugccucucugccucucugccccucugccucucucugccucucugccucucucugccucucucugccucucucugccucucucugccucucugccucucucugccucucucugccucucucugccucucucugccucucucugccucucucugccucucugccucucugccccucucugccucucucugccucucugccucucugccccucugccucucucugccucucugccucucucugccucucugccucucucugccucucucugccucucucugccucucugccucucucugccucucugccucucugccucucugccucucucuuccucucugccucucucugccucucucugccucucugccucucucugccucucugccucucugccucucugccucucucugccucucucugccucucugccucucucugccucucucugccucucugccucucucugccucucugccucucugccucucugccucucucugcuucucucugccucucucugccucucucugccucucucugccucucucugccucucucugccucucucugccucucugccucucugccucucucugccucucucugccucucucugccucucucugccucucucugccucucucugccucucucugccucucucugccucucucugccucucucugccucucugccucucugccucugccucucucugccucucucugccucucugccucucucugccucucucugccucucugccucucucugccucucugccucucugccucucugccucucucugcuucucucugccucucucugccucucucugccucucucugccucucucugccucucucugcuucucucugccucucugccucucugccucucucugccucucucugccucucugccucucugccucucucugccucucucugccucucugccucucugccucucucugccucucucugccucucugccucucugccucucugccucucucugccucucucugccucucucugccucucucugccucucucugccucucucugccucucugccucucugccccucugccucucucugccucucugccucucucugccucucucugccucucucugccucucucugccucucucugccucucugccucucucugccucucucugccucucucugccucucucugccucucucugucucucucugccucucugccucucucugccucucugccucgguuaaaggugucugucaucagauccaguaggcucugguuuugacagcuuauguaauuguugguauuauuuugaggcagggauguaguccaagcuaaucuuuuguagccaaggaugacuuugaaugucuagucuuuacauaaucuuaccaacucucaaauucugggauuauaggcauaugccacuuugcuugguuuaugugguuccagggaucaaagcagggcuucauauaugcuaggcacauagacacacuacuagcugagcuacaucccuaauuaccuuccuuuuguauuuucuguuuuuuguuaguuuuagaaagaaucaugcucuuacuuagguuuaucuuuucuuugccuauuucugcugagauuacaggccuguucgacuauaacagcagcucauaugauguauuagucucaguguguuuguacucaguguuagguuugauguuuuuauucagaauugacuuugaagguuuuggcuuuguugugugugugcauuucuagcaucucuuaacaaccuugggaauaauugaaugcucucaaugugcuccugauuagacagaguagacuuguagguccucaguuaucuuagaggcaugucaguguugacuucuacucuuccaggaugcaggagcugggcuucuugcugcugccaugauugcuguaguuccuggguauauuucucgaucuguagcuggcuccuaugauaaugaagguaagauuuagaaugcugaaggagauguguuuacuuuauuaucuacugaaguuuuacaaggugcugaauuuagguacauuucuauugcuuagcaauaauaaaacuggaauuggcgagcagauuagaauugggcgggaagggaucuuagguagguacucuccuaucaucuggucuagagagguagcugggaacuuuaaaaacuuaauauuuauugcuuauguaccugcaugcaaguauauccaugcuuuuauguacaggucagaggauauuucgcagcuuucaguucuuuucuaucaugcaguuuucaaggauugacuuuaagucauuagauuugguaucaagugccuuuacagacugagcaauccugucagcucuagcugggaaccucuuuuauuuauuuauuuauuuauuuauuuauuuauuuauuuuuaaagauuuuaaaauuuuauuuauaugaguacacuauagcaguccuuagacacaccagaagagggcaucagaucguguuacagaugguugugagccaccaugugguugcugggaauugaacuuaugaccucuggaagaguagucagugcucuuaacuacuaagccaucucuccaacccuagcuaggaacuucuuaacaagccuuuguuuccucucugaacucacauuuaauuguuuuaacauuaagaucauuguucuuauuuucuuaguguaucuuaaaauuaacaguaacuuuuauuggcuuauauucaaugcaacauauauuuguuuaaacacauucggaaacauguuaguuauuauaaagaaagguaaugaauuagauuauuuuguucuauaauuaugaaacuaagagauagauaauagcuguugucucauagucuguuaaggaauauaauaauggguuuauaaaaauaacucuagcugaguaugguugcauuuaccuauaauucuggcacuuaagcaggaagauggggaguucaaggccacccuugacuauauagugagcucgaggccugccugggcugcauaagacauuguuucagaaaauaagaacaaauuaaaaaaccccaaagcugaaccugauacuacauuccuguaaucuugguauugaaagugaaaagggaagauacugaguucaaguccagucugggcuucauagugaguuuuagucuagcuuuuucuacauagugaauuuuagaccauccggggcugccuagcacaaaacccuuauuuuauuuuauuuuuuuuuaaagcucucuaacacucuacuuugaugaugucuagagaagagaaauuaauuugauuuuuggugucaaaggaaagcuuuuugaaaaugguuaaaauugaucugggccaaaugugggaauccaugagacaauuuuuuuccaggggcagggagugugaguggugguagagcuguggacugaaucuagggcuuuaggaaugcuagauaaguaaguguucugcuuuggagccaggucacccaccagucaacugugaaguuugcagcaucagaacaaaggguuuaucuuuauuaacauauauuaguggugcuguaaccucccauauacuuaugacuagcuagauuuacugcccacaaauaaaacaguguuauggccaauauuuaccaguugcuuucuguauucuaaguauuauucuaggugcuuugugugcugcguuuucuuuacaaugacuucaauaaauagguauuuacugaaaacuccuugggcugcaggugcagcuuggugggugagcauuugccuagcaugcgugaggcccuguguuuaauccccagcacuugggggauaaaauuauacucaagaccccuucuuacaggaagcagaggcaaagggaaguaaaauaguuugcccaaaaucauacgugugcugaauaguaguuuagaaacuugaaucuaaauagugugcuccagaauugucuucuuuuuuugaagguuuauuaccuuuuugauuauauguaaguaagugcaagugccugaagaggacagaggaggggcuuaaaucaccuggaacugcaguuacagaugguugugagccagcagaugugggugcugggaaccaaauuuggguuuucugaaacagcaguauuuguucuuaaccauugagccauuccuagguguguuuucuuagauauuccuaaguaguuuuuuuuuuuuuccucccccacgguuguggguauguugagauaggguuucucuauguaauucuggcuguccugaaucuuacucuguagaccaggcaaaccggaaauucagagaucuacccgccucugccuucuauguauuaggauuaaaggcccaguuucuaaacaaguauuguuaacauuguguuaguauggguuuugaaucucuguugucuucugcaggaauugcuaucuuuugcaugcugcuuacuuacuacauguggaucaaggcagugaagacugguuccaucuauugggcugccaagugugcccucgcuuauuucuacaugguaacuuuguguguguguguguguguguguguguguauguacguauguaugcauauacaugucucuuuguccuuuucuuuuuucuggugcaaggauuugauuuaucacuguuacaucuccagcuugucuacauauuuuaauuuuuugggggguguucaagacgggguuucucuguguagcccuggcuauccuggaacucacucuguagaccaggcuggccucaaacucagaaauccaccugccucugccucccaagugcugggauuaaaggcauggcccacuacuguccggcuaaguuuuucuuuuuuuuuuaaagauuuauuuauuugauacauaugaugaguaccuuuguagcugucuucauacauaccagaagagggugucagaucacauugcagaugguugugacccaccaugugguugcugggaauugaacucaguaccuuuggaagagcagucaguacucuuaaucacugagccaucucuccagccccauauuuucaauuuuaaaauuuucuuuuuucaccuaguucucuuugauauggggucuuauguauccuugguuguucucuccucugcugaggaugaccugauccuccugccucuacuucuugagagcugggauugcagauguguaccauaaucuaugcuuggcaagcucucuacuaaccuagcuacaucuuagcccucuguuuuuuuuuuuuuuagucugcuaauaaaaauuuucaaauucuguauuacuguacuuccuauggguauauguugguuuucucauauuuuuguuauauuuuccuuaaaauuucucuuuccuaauacauauuuuguauaauuuuacaucugucucuugacuuucuuuauaucucugcuucuccuuagauuuugugugugacauaauuaguuucgccuauauuuacacuguagcuugguauauacaguugaacauguugugaguggugcucaaagggacuguucuauccucacaggucucuucauggggaggcuauguguuccugaucaacuugauuccucuacauguccuggugcuaaugcugacaggccguuuuucucaccggaucuacguagccuacuguacuguuuacugccugggcaccauucuuucuaugcagauuuccuuuguugguuuccagguaaaccugagacuuuguagaauuuucugcagccaaauguuucugaguagcuucuuagaauggcuucucuuaaaaacaugaauuacaguuuguauuugaggcuguuuuuaacugaaacagcagaaucauugguuauuagaaucugcuucuaauagcaugucaguauuugcuguaugcucuuugaauuuaguggcucuuuggcuugagauugugugaggaggaggaggaggaggaggaggaggaggagagccuguuuaguuaaacaagguugacuuuaauaaucaaaguuuaaauuucaaaaaaagguuaaaauuccagcccuuuuaguggaaaagaucccauuuaguagcagugagcucugaucaucuuaauggggccagugugagcucuugaaacaguaaagcuucgaggcuagccugaucuacagacugaguuccaggacagccagggcuaugcagagaaacccugucucggauaaaagaaaaagaagaaguaaagcacaaaccuuuuacccaaguuccaacauacaguuaacaggacacuguguguguuugguuucuuguguauaguucucaucuuuaaagauaaguacuuuuagucaauuaauuuauaaaguuugcuauuugguggaauguguaagagauguaauaugcuaauccuugaggaagcuggaaaaauacauacagcuguuuguggucuacacaguucacaguucaguaguuacagaaggcuguuuccagagcaucagcgcuauuagugucugggacuuguuagaaaugcgaagucuguagagguaggaggauuaggaauucagggccauccuggaauaccugaaaccuugucucaacaaacaauagaacgaacacaucaagaucccaggccaaaccaaacuaagugaaacauaaaagagaccuguugaaugagaaacucuaggguggggcuuagcagccugcuuuaacauugguuaaaacagugcuuagcccauugguuaugaugcccacuagauuuagagaaccauuguguauggaaaagaguaauuuauauacuaaagagaucuagugcugugaaacauaggagucauugauuugucagguuuggaaaugauaauuauguugaauuuuaaauggucaguuuuagugaaagggaauuuggggaaaaugccagucuacacuaaggaaagagccuaagcagacggcauaggugugauugugaugguguauaugcuucguuggccuccaaacauuccuuggaaaauauacucgauaaauuaaaccccuuuaauauugguccucauucacuuuggaacuuuagaacucaauugacuccuugagcuaaauggaucaggaaaaugccaaucuuggaugaacucauucuggguuuuuuguuuugcuuuauuuuguuguuuugcuccuaauauugccaucuaugaucaccuaccuuucccccagcccguccuuucaucagaacacauggcagccuuuggaguguuuggucucugucagauccaugcuuucguagauuaccugcgcagcaaguugaauccacagcaauucgaaguucuuuuccggaguguuaucucccugguuggcuuuguccuccucacugugggagcucuccucaugcuaacagguagaggauucuuuuauuuuacuuuuuauuucaagcuauaaaguucuacuuaaaauuaacuaauuuaguuuuauguguaugaguguuuugccuucaugaaugccuguguaccacaugugugccuggucccugaggaggccagaagagggcuucagauuuccuggaacuggauuugggucaguaguaagccaccaugucuucugcaagaccaggaagugcucaguccgguuuuuuuggauucuggagagcugcuaaaaggacuguguagccuugccagucuuuucucaguuucuguccuauugguuaacuuagagaaauuuguacacccuuucucauauuuuaaaucauggcacuggucucauucuauggaaacuaaauccugauggucucagucaggguuucuauuccugcacaaacaucaugaccaagaagcaaguuggggaggaaaggguuuauucagcuuacacuucuauacugcuguucaucaccaaggaagucaggacuggaacucaagcagguuaggaagcaggagcugaugcagaggccauggaggaauguuccuuacuggcuugcuuccccuggcuuucucagcuugcuuucuuauagaacccaggacuaccagcccagagaugguaccacccauaaugccccccaucccccuuaacuaauugagaaaaugccuuacagcuggaucucauggaggcauuuccucaagggaggcuccuuucucugugauaacuccagcuugugucaaguugagacacaaauccagccaguacacauggcuauauaguuuagaugauauucucuuuuuuugauuuacuuauauuuuucagaagcuaauuugguauuucuaauucauagcaggaugaaggacuuaguucacuuagauucaggaguuggccuugauugguugauuugagcaaaucaaaucuaagaucuuccuuuccuguaggcuucuuugacgcccccacucccaacccugugaauuuauauauagccuaauuauugcacugacaaaaauacuccgaauuuaaaaagaaaaggagugaaauucuguaaguauaauuuacuguaguaaagcagaacagcccuuucccgccucagaauuuuacugaaauguaaugcugugggcuggugacauggcucaguggauagaagugcuuuuuguacaauccugcacuccugggaugaaaugaguagcuaaaauaguucagccacccagaagcuuggagguaaacuagucuggaauauaaagcguggcagaaacaaucagggaacuccugcuucagacauggcggauggcgagaacugguucccacaagugucuucuuacuucaacacuucugcacacacucagacacauuacacaggcacacuaauaauaaacaugagauggaauguuaguaauuagcauuuuagcuuaguguuuuagggauauauguuaaauauugucuuuuuuuuucuuucaggaaaaauuucucccuggacagggcguuucuacucucugcuggaucccucuuaugcuaagaauaacauucccauuauugcaucuguuucugagcaccagcccacaaccuggucuuccuacuauuuugaucuacagcuccuugucuucauguuuccaggucugucuugcauuuugaagugaccauaagaauuagucuuugaauccaaauauauuaacuauucucuucauuuuuuauauauuuuuacauaauuuuauuacaauacuacaauauauuuuguauuuguauuauaaaaauauuacaauauuauaaaauacuacaauaauuuuauuauauauuuacaaauguuuuuauuuacauguauggauaugugcacauguguacaguucucugcagaaaucagaagaggguauuggaugcccugcagguuaggggcagcugugagccaucccauguggguacuuauuauaccuaauacucaguaacauauuuuucacccaacucaguuuucuucuuggcuuguugaaguucuauguugaguuuuuguaguuaaagcaauuuguuauuauaaaaacagugagauaaguuaaaaaacacaaacaagcaaauuuacacuagaucugacuacuuguucuaccacuguuaacauuuuaaauuagauauagugcugaauguuuuucauuuuagcacugggacuccugaggcaggaggauugugaguuugaguuugcccugggcuacauagugaaacauucucaaaaagccauaccaaaaaaaucucauugucaauauuaguuaauuuugagacaggcucuuacuguuuauuccuugcuaaccuggaacuugcuacauauggcaggcuugcuucaaacuacagagaucugccugccucuaucuuccuugcaagugcugggauuaaaggcuuuggaucagauuuuuuucauguauucacauguguaaagauguggaaaaggacaaaggucuuauaacuucuuguagcagcauuuuuuuaaaagauuuauuuauuauuuauuuuuauauguaaguacacuguaacuaucuucagacacaccaggagagggcgucagaugucauuaagccaccaugugguugcugggauuugaacucaggacauuuaggacagcugucagugcucuuaacccugagccaucucuccagcccguagcagcaucauaauauauuucauacuuaauauaugguauaauuaaccaucucuucugcuaggcauaagauuauuuguguucauuugguuuguaaaaauauuauaguaaacaucuuugcauauuuuuucugacagauuccuagaauuacuuacugagguaaaugugugaagucauccugccauaaugaagauauuuucccuuguagaugucuguuuacagggcucagcuacuuacuuuucuuucccucuuuuguaguuggccucuauuacugcuuuagcaaccugucugaugcucggauuuuuaucaucauguauggugugaccagcauguacuuuucagcuguaauggugaggaauucacucaguuuuagcaaaacuuuaucccugacuugggggucuuuucuuuuccuuuugucuggcugaacuagaaaaaaaaauauugaagauuaugcaaagcuccuuacaguuguuaacccuuuuuuggaaugcaaagagacucauauucuguuuguggcgacuaauuuucuugggcucauaaucuuguguuagguacuucauugaauuuggagcagauuaaagaaagacauuugcauggaacugcuguuacaggcaguagugagccaccugauguggaugcugcacaccagacucaggcuguuccccagaagagugggaagaguaagcacuaagccucugggguggacuuuaguaucuuaaagccuugaguauauuuucuccugcuuuguuguuaaggcagagaagauuuuauguaacguuaugauauaucuuaucuacuucagaauaguuuuuuauuuuuauguguauuaauuaguguuuugucuuagugugugucuguguacugugugcauauuuggcaccuuuugaggucagaagagguuguuggauccccuggaugaucugaguuauugacagauaugagcugcccuguggguucuaggaauugaacccagguccucuagaaggguagugcuucuaagcacuggaccaucucuccagccuuuucuuuuuguuuauaaauauauauuuaaagguuauaaacaacaguaaaaauguauuuuagcugagguuggugguauagacuuguggucccaacacgugggaaguugaaucauauguucaaggauggucuaggaaauguagaaacucucuaucuugaaaaagaaaaugcacaaagauaaguugguuuuuuuuuuuuuguuuuuuuguuuuuuuuuguuuuuuuguuuuuuuguuuuuuuguuuuuuucgagacaggguuucucuguguagcccuggcuguucuggaacucacuuuguagaccaggcuggccucgaacucagaaaucugccugccucugccucugccucccgagugcugggauuaaaggcgugcaccaccacgccuggagcagucagucuucuuaaccacugacccuucucuccagcccccagaaauaaguuuauaaaaaaaguaaaauuuuaauuauauauuauauaaucuaugcauauauauuauauauaaaaauauauaaguaaguuuguaaaaaguuauauuauuuaaaacauaaguauauauacauuuagaucuguaguagagauugcuauuuauauuuaugguuuugaggcaaaguauuuuuacccgaguuuuuuuucuuuuuaagauuuauuuauuuucauuuauaugaguacacuguagcuguuuucaaauacacaccagaagagggcaucggauccccauuacagauggcugugaaccaccauguaguugcugggaguugaacucaggaccucuggaagagcagucagugcucuuaaccgcugagcucucuccagcccuuuccaccaaguucuaauuaucguuguauaugugugugucugugugugaguaugugcauuuuaguaaaggagcccugggagccacaagcaggcucuggugagcugcugcuugugugcugggaacuaaauucaguagaugauccuaaaccauugagucaucuuuucagcuccaaagguuaucauuuauuauguuuauuuauaugcauguuuaugugcuuguguguaugcuacaugcuagcaggugcuuccagaguucagaagagagcauggcuauugggaacuggacuccaguccucuggaaaagcaacacaugcucuuuacugcugagucauccuccaacccuugcuuagacuuuuuuuuuuuaacuauaaugauguacauguguccguccagaagaggaugauagauccucaagcuggaguccuaggcauuuaugagcugccuaacuuugaagaauuuagaucuggaaaagcaguaugugcucagagucacugagcuaauucucuagccuuggcauugaauuuucuuucucuuuuuuucugguuuugcuuguuuguuugcgacaggguuucucuguagcccugucuguccuugaacucauucuguagaccaggcugccccugaauucagagaugcaccugucucugacuccugagugcugggauuaaaggcauguaccaccaaugccuagccuuucuuaacaucuugauugcuggaauuacaggcuugcacugcaacagaguuuaaaaaguacauacuucucucaugcuauagcuauaucauauaguuucuauuccacuuuuucuggaauagaguguuggaaauugcuaaguugacaucauagucuacuaaaagauugaaguuugucauuugugaaacacugauuauacugauauuauucuuguucuuuuuaggugcgucuaaugcugguauuggcaccuguuaugugcauucuuucuggcauugguguuucccaggugcuguccacauauaugaaaaaucuggacauaagucgcccagacaagaagagcaagaagcaacaggauucuacuuacccuauuaagaaugaggugaggggcuggagugauugcucagugcuuaaaggcacugacugcucuucuagagguccugaguucgauuccuggcaaccaccuguggcucacaaccaucuauaaugggaucugaugccuucuucuggugugucugaggacagcuacaguguacucauauaaaaaaaaaucuuauaaaacaaaagaaugaagugagguuuaaguaacauguugccuuggaaaaaaugugugugcaugcaugcaugugugcgugugugugaauguguguuauuugcuuauguucaagaucaaugucuugagugguuagaauuaauuuaugcagccuaacauauuuuguucucacauaagaagccguguguguuggcuuacuguacaguucuucuuucuauagguggcgagugggaugauacuggucauggcuuucuuucucaucaccuacacguuucauucgacuugggugaccagugaagccuauucuucucccuccauuguucugucugcucgugguggggauggcaguaggaucauuuuugaugacuuccgagaagcguauuauuggcuccgucacaauacuccagagguaaaaauuugggaggaguuggguacuuggauaguggugaagacacuugaaauuguaguaaaucucacaacuuuuacauggaugggaagcuuagaaaaacuaaauauucagaaacuucgguuuuuuuuuuuuuuugagacaggguuucucugcauagcccuggcuguccuggaacucacucuguagaccaggcuggccucuaacucagaaauccuccugccucugccucccgagugcugggauuaaaggcauguaccaccacugccuggcuagaaacuuaguuuuuaauacguuuuaaagaccaagugucuucuagaguagugguucaugggucauagccucuuugguaaaccugcguuucugaaaauauuuacauuacguuucauaacagcaaaguuacagcuaugaaguagccaugaaaauaauuuuaugguugggggucacaacaacauaaggagcuguauuaaacgguuauagcauuaggaagguugagaacauuggguuagaguaacuuaaauucuauauucugcuuggacacauguguugauaugauagugguuuuaauauaaggcagaucaacccaguuacaacagaagaaaauguuuuaugucugcuauagaaaaagcagacgcuagaauagacaguuaccacuuaauaauaauggcauauaacaguuuaguuuaugucucuagaggaucugauuucuuuuguaguagcuuuugagaauagcauuucagagucagauuugcuuaacaucuaaaccaagaauguuuuuuuaaaguaguguugggguuugaaccuagagccuuagcauaugcuaggcacacagucuaccacugaacuguucaccuuuaguccuugccaucauaguugugauuuguguuuuccuuucuaccacugcauuguaguaacugauuuuauaauguaauuaagagucauuuaaauuaccuaaugacaaacuaggauuguuggcacauguauuuuaucccagcauugaggaugcagaggcaagugaaccucuuaguuugaggccagucugagaccagguuugagaccuugucuugaaagauagacauuuaaaguaccuaaugacucuaaccuuauuuauuuaguuauacuucauagucuucccuacaucucuugaugcacuguucuuuuucaaugaucuggaauuaagauauuugggaguguuggauuauguauaauuuaaauuauuuccugacuauauauaaauggaggaguagaugccccaaguuucuuuucuuuuucuuucuuucuuuuuuuuuuuuuuuuuuguuuuuuucaagacaagguuucucuguguagcccugguuguccuggaacucacucuguagaccaggcuggccucagaaaucucccugccucugccucccaaguauuaggaucaaaggugugcgccaccacugccuggcucaauucuauuuucuuguuaggcauacauuacuuuguaaaggaauugauuaauugggcaagucuuacuugcuauugaugaugccuuuccacucuuccuuagcauuuggauuuaagagcagugagauaaacaucuauuuucaucuuguuuuaggaugcaaaagucaugucauggugggauuauggcuaccaaauuacugcaauggcaaaucggacaauuuuaguggacaauaacacauggaauaauacccauauuucucgaguagggcagguaagguaaagggguccuuuaagugucugucugacaugugaagucucugggaagugugucgcuacgagaggagguugacuugagauuuuuuuuuuuugagaauuauacauuuacuuuucuaggcaauggcauccacagaagaaaaagccuaugaaaucaugagggagcuugaugucagcuaugugcuugucauuuuuggaggccuuacuggguauucuucggaugguaauguacuugauacuguaucuagcugcagggcauagauucuuugaaaauuuagugaaucaguuauuguuuuacuuauuuauauuugauuuugacagagucucaugugacucaggcaggucuugaauuugcuguauucauaaggauaaccuugaacuaugagucuuucugcuucuaccucuggugcuggagcuacaggcauacaccauuugucuguauuuucucucuuuuuaaagaaaaaguuagguguguguauguguguauauauguauacaaaggaaaaguaacuuucacaaaacugaaguuaauaauaucuguuuuugguuuugcuuuuaaaguuaaacaauucuggagauuuaaaguaagugguugucucauggcccucaacuuaaauaagcacccuuaacaucagucuccagaagcaguaauuccugucuucaguuucuuagguuuuuacuuuuugugcuaggcauugauuccuggagcuuacaugugcuaggcaagcacuucaccacuaagcuauacuuucaaaucuuuauauuuuaaauuccugcuauucugggguugauuaguuuuaauuguacuauaucaaugucucuuuaaaagguuguuuuacuucauuuauuuuguguguguuuggggaugcauguaugccguggaugucagaagacaacuuguggagguugguccuuuacuuccacugugugggucaugaagcuuggaagcaagcacauuuaccuguaggccaucucacuggcccucugucagcuccuuacaguuggugaaguguuuuaccccucaccucacauuucuccucuuuucuguguuuuuauguaguuaaucuacaacuuuuaauuaaaucuagguacuuugaaauuaugacuguaaauacuuauugcucagucaaucaaucugugguuacuuuccuuccuauaucaaauauuuucuuuuccuacagcuagugaguauguuguauuucuauguuaauuuucuuugaauguguggcuucuucuacacaauuacacaauuugccgcugcaaauccaguucuaugccugcuucugaaagaugcuucuauuuuauuuuaaauaagacuauuucaaauguaucuuguauaaacaaaaugaaauugauaauagcaggaauagcagacaauugccccaguacuguuugguaguaauuacuauauauauauauauauauacacauauauauauauguguguguguguguguguguguguguguguguguguauguguguguguguguguguauguguguguauauguguauauauguauauauauauguauguauauguaauuaaguacuauauaaauauauauuuguaugucuacauaucugcuuauuuguguguguguaugauuuguguguguguguguguguguauguguuuaguaggaugguucuauaggaugugauaguacacaucuguaguuuccacucuuagugagcaggaaggucacuaguuugaaucuacuuugggcuguauagcaagaucuuaucuguugaaaagaaccacaacauguaguuucuuggagucuucuuacuaaccaauaguaguaaccacugucaacugaguagaauauguuggauguuggaauaaaugugucauuauuuguaacauauuagaaaaauuuuaugaaauuuaggaagugagcauuaguaauuuagcaugaaaagaaauacugcuuagagucuuaguuaggguuucuguugcugugacaaacauucugaccgaaagcuaccugggaaagaaagcauucauuguaucuuacagacuuucuguuuaccagggaagcuagggaaggagcagagggaggggcuuaugcagaggccauggaggaauguuguugcuuacaugcuugcuucuugugccuuguucagccugcuuucuuguagcagccugaaccaaccaucccaggggugcgccgccccccccccaaucaucaggcaagacaauguaccaccugcuugcccauggguuaaucugauggggacauuuucucagccaaggcuguuuuuauucaagugauucuaguuuaugucaaguuuacaaaacaaaaacaaagcaagugaccccagaacaaaacuaaccaacacacuugucaggaggucuucauuagagauuuuuuuguuuguuuguuuguuuaauuuuauuuuguauuugucugcaugugugcaauugcaaagguugacgucuuuccaguuaaacaguacuggcugguaugugagucuuuagggauccaccagucuaucccuaguauuggaauuauaaguaugugcuaccaugcccagcuuuuauaaggguacugaauuuauaaggguauugaauucaggugcucauguuuuuguggcaagcacuuuacugacugaugccuuaagauuaucuuuuuuaaaaaguucuagacagggacuugcuguauagugaguagugaggaugggauggcugaguguggugaugcuugccuuuaauccuagugagagucaggauagccaagauuauauagagagacucugucucaaaaacaaacauacaaacaacuuacagagggagagacuugaucucacuguguaaacugucugguuucaaaugcacuguguugaccagcuguucucaaauucguaguguuugaggccuuugccucccaaaugcuggucuuaagccaugcaccaccacacgcagcuguugcuuaauauugucuagucucuuacaugugagacugcauccaucagguuuagauccuuuugaaguuacuccacccauuuacuugauuuuuacggucuccgcacugcuugugaaggugcucuguagauuauauugcuuacaguaagaugauuuaacuuaacuugccuuugaguguuugguaacagcagugguuuuuguguuuaccacaguaaauaguuauggcaaaacccaagguugggaauuaacaacuuuuguuugcauuucaaauacccuaucugugguugaugaauuuuaaaacaguguuuugaaaaauaaaccuuaagauauacuuuguuuacugcuuuaucauguccagagcuuaacugaaacuaucuuucuguuuacucugaauuaauaaaaacaagcuaggcacuguugugcuuaccugggaucccagcauuugggaauagaagcaagaagaucaggaguucaaggucugccuugaacaagacacagaguuuaagaucagccugggcuauauaauaagacugucuuuaaaaaaaggcaaacaaauuauuacauguauaacaaaaaguauucuccauuaagcauacugauacauuguuauauuuauuuauguguuaauuugugugauuuguguggggaugcaugugucauaccauacauauggccaucuaaggacaacuuuguagcauccauuuugcuuuuuuaaaaaaaauuugguuauuuuguuuauuuacauuucaaauguuguccuccuucccaguuuccucucaccaaaucccccaucccaucccccccuccccuuugccucuaugagggugcucccccacccacccaccuauuccuuccucaccacucuagcauuccccuuuacauugggguguaucaagccuccacaggaccaagggccuccucucccacugaugccagauaaggccauccucuacuauauaaggagcuggagccauuggucccuccauguguacucuuugcuuggugguuuagucccugagagcucuguggagggguggugguggggguuuguccaguuaguugguauuguucuuccugugggguugcaauccccuucagcuccuucaguccuuccccuaacucauuugaguccucgagcucaguccgauauuuggcuguaucugcaugugcauuggucaggugcuggcagagucucucagaggacaucucuaccaggcucuugucagcaagcgcuucuuggcagaguuuggugucugcaugugggauggaucccuagguggggcagacucuggauggccuuuccuucauacucugcuacaucuuuuuguuucugcauuuccuuuaguuaggaacaauucuguauuaaaaguuuugagauaggugggugaugccaucccucaacugggggccaugccuaucuauuggagauggucucuauagauucuaucccugcuuuguugggaauuuugucuaauguuaucucugucggguccugguaaccucuugcuucccuggcaucugggacuuucuagugcccccccccccguuccccauccaccacugcuacauauuucuguucaauuuucugacccucuguacucaucuccuaucucuugccacaucugaugcugccccucccuuuuuuucccucccccuccucucucccucccagcuccuuccuccuucuaccuccuaugauuauuuuguuccucccucuaugcuggacugaagcaucuacauuuuggucuucuuucuuauuaagcuucauauggucuguggguuguaucauugauauucugagcuuuugggcuaauaucuacuuaucagugagaauauaucauauguguuuuuugugugugaguuaccucacucaggaugauacuuuucuaguuccaaccauuugccuaagaauuucaugaagucauuguuuuuaauagcugagaacuacuccauuguguaaauguaccacauuuucuguauccauucuucuguugagggacgucuggcuguuauaaauaugacugcuaugaaaagaguggagcauguguccuugcuauguguugggacauguuuuggguauauguagcauccacuuucucuuuccaccuuuacauagguuauagagcuugaacucaaguuucuggcuuucacagcgagcuccuuaccuccccacuaagccccuuccccaggccgucucacuagcuuacauuacuguucuuuagaaaucauuugggggguugaggagauggcuuaggagauaagaauauuugcuucaaguaugaagaccugaguucaaauccucagaaaccaacgaaaaagccugggucgcucauuacucacucaugacuuucgcuggcauaucuccaaguucagugacacccucucucaagggaguacggcagaagggauagaguaggacaucaguauugucuuacacacacuuguauuuuauuuauuuaugaaaugaaaaguuuuauuucuucuuggcuacaucuuauuguguuuuuaguguucuuaaucgugaacccaccccacaacaacaacaacaacaaaggaucucacuauguauggauacauacauaguggccuggagcuuacuauguagacuagacuagccuuaaacuuaacagagauucuucugccucuguuucccaagugcuagguuuaaaggugugcaccacuguacuuggcuuccaguuuaacuuuuuauugaaugcuuaugaaggcuuagaauaaaauauuauaguacagaugcauuuauauaaaagcuugaagcuauguagccuaggcuugucuugaaugcagaaaacucuucucuuagcuuuccagugcugggauuauagacagucaccacugugccuaguuuccaccuuguauuauauucuuacagcacuucuaaauugguaagaaucauacuucaagugcuuauuuaaguaaauguggcuacuggcuacuucuugcaguaccuuagcccuauguaauuuguaggaauacuuucaguguggcuuaagacuggaccaguaauagcauacaauuucaucaauuaacaauuucuaauaaaaguuuuauauuuuuaggaaguguuuugcuagcacacuauccugucuuuacaguugaaugauagcauuccuuauuaggaaaauacgauggaaauuucuuuagaaauagugauauuuucagugaguuccugagaaccggcagccuuucucaugcagcagugcauucauuuuuuucucuagauaucaacaaguuucuuuggaugguccggauuggaggaagcacagagacaggaagacacauuaaggagaaugacuacuauacuccuacuggggaauuccguguugaucgugaggguucuccggugcugcucaacugccuuauguacaaaauguguuacuaccgcuuugggcaggucuacacagaagccagugagugugauucauaaugcuaacagcaauaguaauagcugacacauacuguguuuuccaugcucugugcuuaguauuuuaacucauuuaguccucacagcaacccagaagauaauuuaaacuaauguuaaugucauuuuuauauuugaagaaguugagcccacagguuacugaacucuugcuaauaauuaugugauaauuaggauucaaacucagucugccuuuaaguucugugcuuuaaaacauuaucuuuuauuuuguguauaucaacaaagaauaucucagugugagaaagaauaaaagaaaagagugcuuuuucacuauuuagauaaguacauugagaaggauuuggucagguuaaauccugucuuucagauuuuuuucuuuuuucuuuuuuuuuuuuucuuuuugguuuuuuucgagacaggguuucucuguauagcccuggcuggauguccugggacucacuuuguagaccaggccucgaacucagaaauccaccugccucugccucccaagggcugggauuaaaggcaugcaccaccaccgcccagcuaguuuuguuucuucaucagggaaaacuuuugcaguauauacaagucguggacuugugguccauggaaggguuacuagugcuagaucuuuggauaacaguccucaggaguagagugccuuaaaagucaucuuguagauuuagaagacagacgcuacauggacccugccaagcaucacauuggacaggacucaaguaggguagcucuugauuugcccuuucuaucugaugcucuuccuuacagacucuagucaaagugcaggcugggaaauagugcagucaaagugcagucagugcaguagaugauaugcagcuccaucucuuuaggaaucaacuuguauaauagauguuuucucucguugcuuuuagagcguccaccaggcuuugaccguguucgaaaugcugagauugguaauaaagacuuugagcuugauguccuggaggaagcguauaccacagaacacuggcuagucaggauauacaaggugaggagaugcugcaggucucagaaguugcucuuguacuuauagauuuguuuguucuaguaaucaguuucccaaauagggacauuuuuaauaaauggcaccugguuucaaaguagcuuguaagucacuugaaguguuaguuauuuauuugaguguguguguguuuucaacuuuguggaguugauucucuuuaguuuuguaucgguucaucagaccuguauggcacuuuaucugcuaaaccaucugaccagaccaaaauacuacuaauuauauuuuuugauuauucuuagagaggagacaucccaguuggugauuguuauggcaacauuucuuuuucuuuaaaaaaacauuuuuuacuacauuuuuauaugggugggggagaggcaucuuuauauggggagguggguacgccauguauugaggucagaguacagcuuguaccgaucaauucuuucauugugauggauccuggagaucaaaaucaacugcccuuacucacugaacugucuugccagacuagcuuaguccuuuucuuuuuaguuuuagggauaaaguuucaggcugacauccaguuuggcauuaaaauuacuguguagcccagguugacuuucuuuauagccuuagguaugguagcauuacagauguggccacuguacuuguuguagcaauacuguuccagguagggauuggaauagcuuggggauuaggggaaaugcauguguuucuguuuuuaaauuacuuuuuuaaaaaaacagcauuaaaaaaaauuauuuauuuuauguauaugaguacacuguagcuaucuucagacacaccagaagaaggcaucagaucccauuacagaugguugugagccaccaugugguugcuaggaauuggaacucaggaccucuggaagggcagucagugcucuuaagccccaaacuaugagucaucucuucagccccaaacuauguuuucuuuuugcugaauuuaugauacauaauuauaugaugucauguaagaguguguuacaucucuuauaugagaaaugauugaaccacauaucuagagaagcagaggcaggggaauugaguaugaggucagccuaggcuacauaguaaagcccuaucucaaauaauaggaaaaaaaaaaaaaaccgaaugauugaagucuuuuggucaaugucaaaguuagucuauacugguucuuagagguacucuaaaaggcuagauugacaguagguaggcuuuaucucaugcuaauuuauucacaugccaaacauguguaauccuuucugcuuacaguggaacuuguagaucuuuccaaguugaccuuucgguaaauacugaaguuaugucuuuauguugcagguaaaggaccuggauaaucgaggcuugucaaggacauaaacgucacauugugcccugagcauuaugcuucgcacugagcgcgucauguugaggacgcugaagauguuuuuuauaugcaguuuauaagaacagccggaugggguuagaauugucugcaaguuuugcccuggacaauaugggcugggccaagugaaaugauuuuuauaauucugagcagguuaccaaaugaaauguuauggcuuuacuuuggucaauuaaaaggggggggggauuuuuuuuaaaugugccuuauuuguuuugacuuaaauuggcugauacgaggaucacagaagugagcggauggaagaccauauccaugcucuagguccccaaaugaaccagauaggagcauuuuuuucuccuaucagcaaucucaaggacuagcucugguucaacaaauguaaacaacaacuuugucacacuuuuuuguuuuuuagcacccagguacaaugcuuuccuuauaaugggugcuuaauaaauuuuuaucaaaugaauaaauguuucugggaccagaggagugcuguuucugggcaagaaagacagcuuucuugcuguuaugucuauguucucgaugucuauuucuuuagaagcucuuuggcuuuauaaggacagaaaguugcugaguauuccugaucucaccaguauccuuucaaacuaauggcaguuauucuuuuucuaaguagaaaugugaagcaaaagugacuaauccaguaguucuuaagaucagugaaacaucaauccuagaggaagacacuccuccaacaucagguugaugaucaguagauguuucuggaaucagaugucauuauguggaccuacaugaaguuuaggcauucaauacuucacuaaaccuaaaacauaguaaauggcucuuugcucauuuucucuagacugcacuaaaucucuuaggguuauccaccgugagcuucuguuuuucuuaaugucagucugcuguguucauauaccacuuugaggcuugauuacuugguuuugaaucccuugcuaaauauauacauaggaagugggaaguauugcuacuagcagguacuuugauaucauugccagucugacugcaagaaaagagacuucaaaaacuacaaagcacagagaucccauagauauuuugugucaggauaaauagcuuucuguucuguauaauaggauauuucauguaauuuacaacauagggcauaaucacugauguauauaaaccaucuuaaauuaauuauaguguuucuauuuaagaaaacaggaggaauuauaugacuuuuagauagucacagugguacucaaugcauaugugcuuagguguacuuguauaccuaagggcuuuuccuucaaaccgguguauguacuguguauuuuaacugugggugaaauuuuagauuuaacagaugauuugauauccuauauguaaauacauuauuugauuuauauacagaacuacugccuagugggaaagguuaaccugagacuuaucaauaugauuaacauuacagguuauuaguaagcuuucucuauaguauaaaugggauacccccuuuucauaucauuuugacuccugggaucuugauauuuucuagucuacaaagauuuuuaaguugauuucauuuucaguuguagucuucuuaguguaaaaaaaaaauaaauccaccucaaaagcaacaauaaaauuucacacacaugcccacccacacacccagccagcacucgccagagacucuugcuuccaggucuggugaaccucgcacugugccuccugccugaucauuaguaacuugcuuuguuauguuuugguguuuuaguuugagguaacauugauuucuuuuuucuuucuuucuuuuuuuuuuuuuuuuuuuuaaccaguggcuuucaacauugugcgucauguucucuuuggcaaaccauuaucucccaaaguauuuacauugcaauucauaacagcaaaaucuuagcuaugaggucacagugaaaauacuuuuauggcugggaugucaccacaagaugaugagcuguauuaaagaguagcagccuuaggaagguugagaaccacugcccuauguuuugugacaccauuuuuacuaucaucuguuacuguucuaauuacuuuuuuuuuuuuuuuaaagacuguuccauguagcucaggccagcuuugaacucaagauacagaugaugcuagcuuugaacucuugaucuuccugccucuaccucccaguugugggcuacuacagcuaguuagguacuauuuuuccuauauauuuuaaaggaaauacuuuaauuuuuugguacuuguuaucuuuccugcuuccuuaccaccccagcuaguucucccucauuugugcccauuuucucauacugugaucaaaccuauucguuaaacaacuuuggguguuuugagacaguaucuuuuauagcuagggcuggcuuugaauuccugauucuccucucucuauuugccaaaugcugguauuaagauguaugccaccauacuuaguuacauuggguuuuucagaaugucuuugauuuuucagcuugaaauaacucuucagguuuguugaauuauauuauuuuacuguuguauuuguugaucuuugccauuuucauugauuugccaugucuuaguaucuucuuauauguaggggaaauacauuucuggagcucuucucuaucauacucaaugcauagcuggguauagcauuccagacuggcgcucuuuacauuauaaaggcacuggcccacuguucuaauguugagaaauggcaguuauuuugaugaguauuugucuauucuuugccccagaucuuuuuugcaucuuuuuuguggguguucacuguccuggguacucuggauuuucaugugugcauagucaaauuuuucuguuuuuuuuuuuuuuuuuuucaaacaguuauauauggauuccuccaauucucugauaaggcuaauuaaaacguucauauuuuaggcaacaugguaugacacuugaaauauuuaaauuuuuguguuuggguguuuuaccacauauaugu

SEQ ID NO: 5009 - RNA, 27292 nt, Mus musculus
uauagguggaaauuuacucugaaucuuuaagcuagaggcagucauuuuuaugagcacggaagacccuuguagcucuucacugccaccuggcugcgugccuggaaaguggagauuggaguauuggcaacauaguuaguuacuggcuaguggagcuuuaggaaagcuccagcagacucagugaacucagauucgucugagcaagcagaaccagaaccugagagguggguuuggggaucauuuuccucccugagacacuuccagggcucccaaagagagcccgcagaucaugagucagcgcgguggucccacugcguucacuuacacagagcaccggauuugcuuugugucagggcacagaacugcucaagacagguagcacugcaggaaacccaacgucacacagaguugaugacuuguaggacugcuguuuucaguuccccauccccucguggguagugaaauggaaaagcccagacaagaaagaggagccccaggaaacucaagacugcugguuucugacuaggagagaaaguucgagaaaacagauggcaguacauagaaaacaguggcuagugagcacagagggauagcuaggacuugcacucggcgcgaccuagagggcaggccggucauguucaaggggcggaggcucuggccaugggccugccuggggcgggccagucggcggggcauuuaaaucgcugccgccgcuggccgggacgcgcgccggcucugcacccuccauagucucagcuucgagugccggcgccucaagaugcgguccucccuggcuccuggugucugguuccuucgcgccuucucuagggacagcuggugagcagggcuggggagggaggcugccaagacgcgcagagacuugcucgggcggcggauguuucugcuugucccuggagugggggaugggguucuaguucuaucuggcagggcuccuucgguggcgcaggcguggaaguuuaguaacacagaacuauuaauuccacauuagcccagacuucugucuaaccccggugaagaacaaacagggugccuaggagucuucauccuuuuugguuugccaccccguaucugcaaacacaagcgcacaagcggguaccuguggagugccuccaagucuuaucuguguauuuggaggauccggauuugccuuugaggaacccaggccaagaacugguagaauauaaauggagccagagagcuuaaggccccuauugauuagauuaguuaacaagccagaaaucacugguucuauuaagccugucugacccuuccagucucagggauaccuagcuagggcaagaucucugggaucagagcugcagcugcuccaacacuggguggucacccuuaaaagcaugagcuggcauugacagcagcugcucccaggaccacaaggucacccuugugcugggagaagagguuuuagccaaucuccauugagcuuuuggagcaguguacuuggucugcaagagguggggaaggaagaguguuaaaacauuuuguuaguuaccgucauuuauaaacuauaaaacuuaacaaaauagccaguugcuggcuucuaaaaaaaacaaaacaaaaacaaaacagaugacacagcaaucucaaaucuaaauucucaaacuaaacuaagggucagauugggcagauacuuagucaucaauuuggccugguuuuaaaauaagucauuuuguuucaaggucucucaggcuaauaaucaucuaaaacauucuuuagaugguuuaugugguccuuucuacauuuggaacuauuaaacaguuuuauguuuucagaaagagagaaaaugucucucaaaaggagaugaacacgagagugagagcguguacugcccucauaaugaaggagcuagaagaugucauaauuggguagaaagagaauucaaggggaggggagaguugccguaagguggauguggaugguagcgaugggcgcacaguacacuugcugucccugacuuuagcugcccugacuuuacauuuaaaggugguugagaugauaagguuuugugcuauguauauuuuaccacaauuuuaaaaagcauaauauaaauaagcucauuuauacauuaagacucuugaagcugucucacuaguggacauauuuuauaugacuuaucaauuagcugcaacuucagagacuaaaauugcucaaugucaagaaaaacuaaaaucaggauaaaugacagacuagagucagauaaucuggaaaguuuucucucuguaaaacauccuuuucuuuguagacuccauuucagguuuguuuuuuuuuaaucucuaagaaaaaauuuugaucacacaauaaagugggucuccuuagaucuaaucucaugguuuacuuauguacagcaaaaacauuaauuaaccaaauaggucaugaucagugcucuugggaguuuucauaaggaaucuuuuuaagaaaaauuuaagguguguguccguccccguccuuuggcagugguggugcaugugugucucugugaggccagaagucaaccucagaugucugccuucagcagccauccaucuuaguuuuugagacagaguuucuuacugggacccggaacuuaccagcgaguuccacggagcuuuaaguagcuccagccugucucugccuucccaggccugggggcacagaugcagccgccaccuugucaggccuuaaggugggcgcugaggaugaugcucagcuugugcagcaagugcucugccgacugagcuugccccauucuuucuuuuuuuuuuuuuuuuuuuuuuuuucuguuauggaaaaaguguuuauuuugaaauuauuuuaauugagaaguagaaaaccucauaggaaggaggaagaaacaaaacaccacacagcauucaggcaacgcuuuacuucaugcccuuucccccgcucuggcucacucgucccaugaugagaaggacucagccacccacaauaauguuauuaauggguauauggaucaguuucacgaagaagccaaugaaucccaugauagcaaauccuauagcuguagccauggcaaucuucuggaauucuuuucugucggguuuggugcaucuuuuaaccagccgaauugaguccuuuacaaacugccggcugggcuccacaaacugcauuaccugauccauguuuguuggauggcggauugagagcguagagacacguagcucaggagagaacccuccccauucuuucauaaguagccgugcauuguuuuuuuaaaaauagauauuuuacuauuuacugcccugagauaagaugccaagauuuaccagauuuuaccugcuauagauuugggcagauuccucuuucuuuacacccccccccccaaauaucauaaggcuuuuagaucugaaaaacugacugacaucuucuaccuguaagacagggaacucagaaaaccacuuuccuuggagugaucuauuaguauugacuccauacaaugaaccucagucucuucaaaggggcugauauaguugauauuaaauagacauccuggucuacuacaacauccaggcaaggcccugguuacauaaucaguucuaaauaggcucuuguuaaaaaaaaaagaagauauucuuauugaaaguuuacaaguagccauaucacccuggaaaacaagaagacucacugaaaguuucugcauucugaggaguucaguuuaaacaaaacaaaacacaacacaaugccuauuaaacugucauggguuauggaucaccuaagaggaaagaaaaaggucuuccuuauacuggcauccugaaaagggagcacugcaauaacauuucaaguauaagugacagucauugguaguucacuuauuccugugugauuagugcugguccugcacauccuggcuucgcaaucucuggaacacaguuucucaggaagagcagaagagucucccuaacuguccacuacuguguacuuacaguuguccaaguggggcugucagaagaguaaguacucaauuuauagugaacaagcacauguucuagagaggaaaaacucuuagauacaacauacaaaaaaaaucucagaugggcugaagagaugccucauuuauuaagagcacuggcuguucuuccagaggacccaggaucuguucccagcaaccacauagcagcucacagccaucugucaucuaguuccaggggauuugauacccucuaacccaaugggagcuaaacaugcaaguggugcacauacaugcaggcaaacacucaaacacauaaaauaaaaauaaauacaucccuaaagaaauuugaaacucacucauauaauaugcaaagacuauaaacaaaagaguaaguuugggguaguucccuaagcagcugauuuguagggaaggaucaguggucugggaaguugcuguauuucaaguuaaagaaauagaguugcaaccuauguuaacauuuuggccgguagcugaaauuauggcagacaacucugcauguugccaugagguaaagcaacaucaggaucaguggaaacacguggcuaggccuguaauugucugacucucagaaagcugaggcaggaggauugugaauucaaagccaacuugggcaaguagagggacccuguuucaaaauagaaaauaaagaaaggcugauguugcaguuuacugguagagcacuugccuaaaacacgcaggacccuagucucaauccccaaauaccacaacacaacaccaccaccaacaacaaccaaacauggacagagaccgcauuccaaaaucuuuguaauuuaucauacagaaauuucugaacuauuacaaaugauggcauuuuaucuauaugaguuuaauguggagaaaacuacuuuuaucuucugauuucccagugaugcuaauguuaacugaugagcauugguuuauaaagccauccuaguuucaguacugcccuuuuuuaaaauguaaaagauaaaauccagaugguuuuccaggaacucugauuuucaccauuaugugaaacaaguccccacgccugagccugcccugacaugguuuuaucacacucucuugcuucuuuccagacuuaacacuugcaccuacuauaacccaaggcaaaucgcacucccauccacaaaacacaccccauaacuacgaguggcaaaugcucuaccaccaagcuacaaccucagcccaaaguagcacauaucagggaaaaggagggugaaucgugauaaaggcccaucguacaacaaccucucaguacaggaaugcacacaacacagccuucuaaacacacaucacgugugcaaugucuuuuaaaacuaaugucuccagucuacaccggucuugaacuauguagcaaagugugaccuugaauuccugggcucagggccuuguacaugcuaggcaagcacucuaccaacugagcuacagcucaguucugcuugcacacuuaagugagacuaacggcuauacucugcaaaguucaagacauacagggauaggaaucuuuuuaccacacugcacucuaggguuauuuacguuuuagauccucaucaguggaggcgaggugguucuagagggugugucugguagcacacggaaagacaccugacuucuguggcugauggaggacccucaauagauguucucuucuauuuuccuagaguguggugacuuuagaugcucccccacccccaagaaccaaaguauaguucugcugaaaaaauguuauacugaacucuggggcucacagagaaaaugaaagcaucaucucaccucagaauuaaugguagagcugaagaguugcggugcccacagcagucauugaucguauuuuuacuuuguuuuauuuguuuauuugguuuuguugcccuagguguggaagccaagauccuggguaaaccaagcaagugcucugcugcugagcacuguuggcaguuuuagagguagcacugagcgccaaagggcaaugguucacacacacacacacacacacacacacugggccucucaguggccagaugaacugacugugaagagagcugccuccugugaggacaucuggauagagggagagcuagaaacugcuuggcauguaagaagcaugcaguaacuaaaggugacucucuguagguaccaaagaucauuauagacagauuuuaaaccagugcacauuuucugagcuaaacaaaacauaagcugagguggggacaacaggguaaggacuuacagugugaaagaaaguuagaaaugaacucugucacacauuacuuucacacggcccuaaggagagcaucgaaauagaugugaagauagcagacagucuuggacucuucaccugugaaguacggauaacaggauaccuacuccucugauugcugagguuuaaacgggaaagugucuggaugggugccaggccugcguuaagucccgaagacuuaacaagaagcagcuuuacugcuaaaugccauucuauaaacuuuucauacuaauauauaccauggauuacuaaucugucuuuuuuuaaaagacaaaugaaccguuaguucccccaugagacgcacugauaaaaugagagacagaaaagcauguagcuuguacagcaucguguugcugacaaaugacugagcggaguuggauccagguuaaucugacuccuaagccuuuccucuucccacuguacuccugauggucacguggauggaaaaugcaauuacacugucauuugucauuuuagacaaaccacuuaaucucucugaggcuacauuuccuuaacgauaagagaauaauuacaauuuguauaucuuaucacgauauuaagauuaaaugagaagcuuaauuuuacauuuacuuaguucauauauauacauauauauacacacauauauauacauauauauauauauuuuuccaagacaggcuuuucucugugcagacuugacuguccuugaacuagcucuguagaccaggcugaccucaaaccaacugccucugccuccugggugcuagaauuaccggagugcggccacagccuuaaaagaauauuuuuaauugaaauagaauuauaccacauucccucuuauccuuccucuaauccgcccagcuccccucccucaaaccucucccuuaaguugauaaccucuuuaucuuuaagauacauauguaaaugaaaagcuuuuuaaagcacuuaggccucuguaguugggauuggcuaggcaguuguacuguuuguuguaguagggguucacccauugggaggaggccaccuugaauccuuaaaucugucagucuuugucuggguguugacugcuugguucucuagccagagggggcagugugccagaaaacacuccuugaaguggggcugugagcagguggcaccaggaguguggaggccacagucuguggaguuucagcccaguagguguuauuucacacccuguuaacagcaaguagaccaccaguucauugugcuucugagccaccaaacaccaaacugccuguuuccuugugcuacucuguucaugggcaugccugggggcagcugacagcacgggcaucuuuccagagagauggcugcagcuggugcuuauagggcugggugagcuuccugaggccuccugaggaggagaaacucaggaccuggaggagggagcgaggugacacugcagcuagaugagcaggaauggguguggagggagccagcuuucacaggcaggagaggcuagagcuugacucccacgcugauuguguuuuccccauaccuuacucuucccugggaggcugggcgaugcugacagauugcucuguguuguggaguuggugaggaagguagaacagaaaaguacucagacacacauggagagaugcuguccuuguugaauaucugugcacccauugcguuugucaguccucgugacaguuuuggguagugcuuuauucuuuuauuuuaaaaauaaaaccgaggcuugagaggcuaaacaguuugcucaaaagucacaguaaccaaaaaugaaggcucagcuuccuuuggcuuaaguccugauguccuuuucccuauucuguggccggagggcuggaaucagaucuucguuccugaugguuccugucucucaucuuauuuuccuguucuuuuaaagagaugcuugauaagggcagcagaaagaacagcuuaaggggcuggagagacggcucagcaguucagagcacuaacugcucuuccagagguccugaguuuaauucccagcagccacauugguggcucacaaccauuauaauggaauccgaugcccccuucugcugugucugaagagagcgacagugugcuuauauuaaaaaacaaacuaacaaacaaacaaacacugcuuaaggaaagcuguggugaaagccagcugccuuguccugcaggggaaugaucccaaggaugcuggagucucaucuuccugucaccagcaugugaccugggcccaucccccacaucuuauugcagcuuccucuuuuccugcugauguuuccucuuucccuucuuaaaagacaaauccaugugacacccccucccccaacccccaccugccagcucaagcuguguggacugucuaggaggcagcaaacagcuuggaguugacugcauaguucaggaucaggaucuuuccucagucaaacuguaccaguacucacugagaugaguuagacagucucaaaguaauacuagcacaaggcacaaaagcuguccuggguuaacgggccagcccauggaaccccaugcuucuugcugggauugaguguuggauuagagagauccguggacauaaggcuggguccuaagagccuucccagagaagaaaccauuggccaguaaccacaggaacucagaacuuucuagaugaaacuuguucuaagguuuauguauuuauuuauuuugaaaagaggaauauauauuugagaagaaagccaaaucaaauagggaagcccugagagcucagaaagaaugagugcacagggcuauaagguacagcuugaguuguuaagggugcaaguuugugggcuucagaagagcuggccaauaggggcagagcccugagaucagacuccgcccccauaugacugucacuaaguuggugugaugguggaggacccgggugggauguaucacuacuuucuuaaccuguagcuuaggccuugggccuugacuucugcaugcacuggagacagugagggugaggcuaggaccaggacuccuaaggguccuagaaggaaggccaucauccuauuucucaaaguaggacuacagcuauguggcugucaccacauucccaccugugcucuguucagaauacagccuauguucaggaguguggacaagagaccugguauuccacaggccugcucccugccccaagaaagcuuucuccucagaggccuuccuagccuguccugucccuccuugcucuuguaugcugcaggcaugacucaggacucugccccuggguaucuguccuuagcuggcccuuucccacuagaauaucucccaguguugguugauggacgacuuaguagaaguugaaggugguggcacagcccaaauugauccuggucugguuguuaccguacccagccuuauccuuuucagaacccgcugacccuagaaucggcacacccaggaacaggucgccagguucguuuccacaggggaagugcuaaggucaccugcagccucguccugaggucacauccugaggcugucccagguuaagagaguuuaaacccugauugucucuaagucaugggcaaggcuaucagagaaguagauguagaacaaagaaagaggaaggccuguuucuaccucuccagagaucagagucggcucuuggaggucauguuggcuuguggugguggcaaugaaguacuuagggguggugucugucauuaucuguugcuaaugugggauacauuguucccuguucaagcccagaaucauuauuagugcaaagucuuaaugaaguugauaaagcuauuaucgaggucuugggaaagaauaaguuggauugucagcuaauacuuaagagauagcuagucccucucuaucugacuugguuauucaauaaccagcauauaguggaggaggugggacucuaauaagugccaccucuuccuaauaagacuugcagggucaugggacagcugagccuauguggaguagucugggagucuccccccauauguuccuuggccccugaacugcuugcccaguccagcucugcaccagggcagccauuccuugcccuggcucuacaagucucccugugccuccuauggggaaucuugguucugagggaaggaagggcuugugagaagugaaaccugcagguccugcccugcucagaguccucagcugugagcuugaauuccuugaagucuuagucuagcuccacccuuaaccuaaccccccccccucccgacucccauguuccuaggccccugugcugacagucagcaccugggaccguuucugugaacaccugaugugcccucaaaggagcacuggcuaguagaaaggaggccuaacuccaacacugcuggggcccagcagucuuaugagcuuaaccuuccacccuauagaggccaggcagaaagccccagaggaagcaggugucaggcuaacaccauacagcacaggcuagaaacccugucuuucaaggauccugucuugcuugcuaauuuagagggcaggucuuugguugggagauugggaucuagguugggcaggccccugcagagcugagaaaaaaaaaaaaaucacaggucagcauacuaguauggacuggcugauucaccugucuacccuguggaagaccucagcuucuuagagucacuuuccuguaugguugcagacucucuuguaggcagcuacccuaccuucuauaaacaagggaaguuaccagcaacccugggucuuugugucuuaggagacuuagguaggcauccuugagagguagggaggaaggacuaauggcccccaaauuucugccaggcaaugaaguccuagagcucgccuuguaaagcaugagcuccuguucuuuuuccuaugcuaauaugaaacaccagccauguuuuuaaguguccacuggcuaucagggaugcuauaagaucuguaacaaacaucugucaauacugugaacaaggugagaaaguccuucucagaggaguaaacugguuuagagaauaagauuaucuuugccugauuuuaaguccuuacuugucucuacagacaugauuuugaaauauaucuaaggcacccugugaagcugucauguacuuagaaguggcuagcaggauggaaaggcaagggaugggccccaccccauaguggggcuucccccuggcuucaccuggcucauagccaaagcacccacuccuaggaaggccccacccuuccaauggcuucucguccucuucaagagauaacccaaacucuaccucuuggcacacagagcccuaccugccugggcccuaccucaucuagccacuucugcuucugugcuuggcucaggcuccuccuccagauauccuaagccaugcagugcucccacacccgcaguguuauuacaugccugugccuuucuggaugcuuuuucccucacccaucucccagcccuaguugacuuagccaucuccugcuugauuuuggaaccaacccuauccucuggaaccuuuuccugacaccaguucuaucccaccggguuuggugucccaccugugcuccccugugacacaaggcuuccugcugcuauggcauaggcacuccaauucucaguguguguuuguuucccucccuggccugugagcugcaggagucagggucuuucuucccaucucucuugcagucaccggaucccuaggcauagaggugguugcaaggggagucuuauuuuuuccaagaauauauggauuuuagauuuggacauuggugugacuguucucuccaauggcuuuuccuaccuaugguuggaagggucagggcucuggaugaaaagagcauggaacugauaaggauggauaccugggaacucagguggguggaagccagggaaaggugggcuggaucugucucccugggauguuccugguaugugggaguaaagcaguguggauguugaauguugacaugaagggaaggguucaaacagcuggcuuuggccuccuuugugccuccuugguugcuugcagcucaugaggcaucuggcaugucugcugagguacagccucugacuucaaguaacacugggaucuucuguugacuggucaucacuguugugcucucaggggcuccagugggacuuucauuccuaaagaucuuucagaaccagaaaagaccugauaugucaugacuguggccacacacaccuguggccuuggcaccucuguguagucacacaagccaagcuguguggcacuuaaagcugguacaccagguacccaaggauuaggaugagagugacauagugcaguugaagaagccagaagcagaaagggcuuaccugguaagugaguggagguugccacacaaacuugccugcuuuucccuggauuaggcaauaucccaguuaacuauaagguugcagauuccuucuaucuauugcucuuugccuagacuagcuguguacucucucuaaaguuucucagaaaauucuagaaaucccugaacuaggaaucagcuagauggcauuugguagaccuggaaagcuuucgugucaccaaucuuuuuaaauuuaaucacugggacaggcaggcaucugggguagccuuggcuuccuugacgucccuagaagaccugugugauucacauaggugccuuggaaacaaguagccgaagagguacuuugagauugggucucauuauguaguccaggcuggccucagagucccaauccuccugccucagccuccugaauucugagacaacagguaugcacaaccauccaagguuaagaauuaagaauauagugcagagaauaguaacagaugccuggguaggaaggaaacuuaaauccagggugaagugggacaggguuugguagcucaacucaauucaggcucugcagaaacaccuuucauuucacaagagguggccugcauugcuuaauuacaugcuugggggaagugaguuuggaguuuggaggcagauuaccagacagggcagggugagcauccaauaucugucuuagguucaugaagccaagggagauaagcacuccagggccugcucacucuucuccccuacccuauucuuuaaugagcagaggcaccgagccuucuacugucuagcauuuucuuucaggcugguucguuugcugguagguugaaacgcaggacuucaaguauacaaauucuguguucugccucugagcuguacccucggcccugugcugagaucuauuuuccauauaccuccugguccuugauugcugauucagcucagcugaugccuugcuguggaaacagugccucagcagggugcugcaggauccuccccagacccuugggugggugaaguggguaugcugcuauggaaacuuugagagauuccucauuagacugcucuuucccucuggcuggcccaugagauaggcaggagggcaggggagagaacaugggauaugugagccacagaggaaaugaucuuuguacccaguggaaucaacuagccggggacccugagggagaggacucagguuuugucaccagcugucucagcugagucaucucuuuccauaguuggagccuagucugcugucauccaagugcaagggaaauauggacaucacucuguagacagaucccucucuccuuuaauuccaucccaugccuaucuguggccauaccuguucuauacaaacagacacagagacagcauugucucagggagacccuacaggggcuaagagguuggaaagaagguggcagggguaguuuguauguacaguguguguguguguguguguguguguguguguguguguguguguguguguguguguacagagguccuuuguucccagacacuccuggucucugccccagaaacuugugucuagaagagagccuaaaggcaaaauguugguggugccgaggccuugaggaugcucuagcugggcuucugaagacugggaugcuccucuguccugcagguuccguggcuucauccugcugcucaccuuccucauuuaugccuguuaucacauguccagaaagcccaucagcaucgucaaggugaggcugguugguaaggaagacugugggacauguggggccugguaguugugugcugcaaucggaugcucuaaaccucagauaauccccucccaaucugauuuacccugcucacuggaccugacccuuccaccuggcagacacccauuguggguggcucuuuccuaggacacucuuacaauguuuuccuacacgauccuuuuacauucaccucccagacugcaccguugguugguguggguaagcuaagaaggcagggggucccggcucuguggauuccauucaugaauauuggauggccaccuacccuuguuggaagagguacugguaggaagaaaaucauggacuguggugggaagcagucauguuuaugauugaguagcagguuucuugcuucucucugagccaagugggccccaggggaugguauggcccuugacccauauuguauaguuuagacagcacuggguaagcucuccuugccauugccuuccagagccgccugcaccagaacugcucagagauggucagaccuguuaaugacacccacgaucucaaugauaccaccuggugcagcuggaguccauucgguaaggacaggagaacacauugcugccucuaaaccccagucccuccuuggacguaaaagggacuuuccugagggggcagccacccagccaaguuucuguccuucccaucugcuuucagacaaagaugacuacaaggaguuacuaggagcuguggacaaugccuuccuaguggcuuaugccauuggcauguuuauuagguaagagaaaggcagagcccgugcccagugacagggugggugggugcuugauaauugcuguuucuccuuacugaucugggcugcaggcuaaugugagaguugaaagugucucugugugggacugaggccaagaccccauccaggccaucagcccaugaccagccuccuuccuucucuauggucaccaaacuguuccucuaccagcuacugauggauccugcuguuagcagcccuuucccuauaaagcucccuagaugcuccauuuaaggaaguguugguggguauggccaaaguucucuaagcacagcccugcacauguagauucccaaggagagcugucuaaacuauacaaccagugugagucucaccuagcaaacauggagcuugcuaccagcaaucacugauggacaaggcaguguguggccuucaaggagcucauagccuaguagagugacccucagcuuagcagcuaauucaacauuguggaaguguuggguagucauguagugcaagcuuagauugaagacaaggaguuaaggaagguguuggaggaggugagucuugaaaugugaagaaccauggguguuggcaguggggaaggacacccaggcuggaggcaucagagagcacaguggggcaaguagagaacaacguggaguguagguagagccucucacaggguuaccagaagggguacagaagcaacagccagggagacagggcuaaaggauaaggucauuugcagagggccugcuccagaauguggaaugggagaaucauggaaggaguuuagcuaggcaugagggaaacucugagguaggcuugaggcagaaagggaagguuacaagcuagcaugccugcugucuacgcugcugagcucggggacaggugguguuucagaggcucccaugguaaaaggagggagacuuuagaauuuagaggguugaguuugcauugcuuuagggacagccaauuaaagguauccagaaggcaaucugaaugugacccuaaagcaugaagggacacauggggcccaaacacacgcaggaggggauguuucaugcauugugguagguagaaccaucaagcugaugaagcuggcaggaagcacgugguuagccagcaaggagggacaugggcaacagaauuuucagaguugugccaaguaaagcagaugacuucuggaagggaggacuggggucagccuuggaaugcaguaggacacagcucagcacuggccaccauggccacaguggcuucaguaauaugggccgggagagggaggugguagaguggacauggcauuaaccuggagcucaccccaucuuucucuccaguggaaucuuuggggagcggcugccccugcguuacuaccucucggcuggaauggugcuaaguggccuauucaccucccucuuuggccugggguacuucuggaauauccacaugcucugguacuuugugcucauccagguaugagucuguguagcacuugggccuuuguuccccucaaagagagguccuuuugggucccuggacauccccaggucagagcagguagggacuuggucucuuuguuugguccucuucucacccugcucggcacccuguucugacucccccagaaucucacaggacuggcucagugagccugccuuguacugcagugaaucugccugagaugccugagaagcuaggucucagcucacaugaucuugagcuaggggaaggcagcuauuguggcauuguguguggacgugcaagugagggaaagucaugguuugcagugcgggguguaucaggacgccugagccgugucauugaaccaccucuacccaaggugcucgcucgagguaacucucucccccuuccucccuucuacagaucugcaacgggcuugugcagacuacaggcuggccaucuguggugaccuguguuggcaacugguuugggaagggaaagugaguguaaugagggagugcaaaugacccugaugggggaagaaggggaggugugcggggguguguguguguguggggggguguuaucucugaggcuaaaagggcagugcuguuucucuaucuagucaacagagcaggcagccuuaguuauaauuccuauaacaggugaauuucuauuuuugauugaagcuaaaaggcuccaccacucucuuuucuuagacuggcuuuuggguuagcuugcuucaguuucucacccucagcucuaacggucugagcugaucaacuguuggcucuggggguuacugguuucuuucuuuuuuuuuuuuuuuuccaguauacauagcaucucccuacaagaugccaguagcaaaacacagugcuuauccuaggagccagcuaaaacaaugggcagugcucucaccugcuugacagcagccagggccuuugcugcacuaucuggggacucugagaagaucaguuguggguacaucccaaaggcuagaugcagccagccuuuugagcuuggcugugccaaauuuuuugucuuuguuuuguuuguuuuaauguuuuuuuccagcauaaaauuaauuuuaucacucaaagcuaauuuaaaauaaaauucauucaaugaaaaacauauauacauacaucacuuuuuguauguuuuuauauuauuuuacuuauucacuuuacaugcucacucacugccccccugccaguuaccccccuucccuucccuucucuucaggcggggauucaucaugggcaucuggaacucucacacaucugugggcaacauucugggcucucugauugcuggagucugggugaaccagcacuggggccugucauucaucgugccuggcauuaucacugcuaucaugggugucaucaccuuccucuuucuuauugaaugugaguggacccuucccaccccacacuuuccaugccccaguugugcucaugagauauagcagcuggauauucuguaagccuugcugcucaggguaguggaugacuagcucugugacccuaaaacuguccuuucaucuauaaaaugcuugcuccguaggauuucugaaaguguaagagggacaguguaucuucaguguuuugucuguagugugugcucugccaaaggacugcguagacagcuaguguuucuuccccauuuucccugaguuagcaaggccagguguuucuagaagaggcaggcaggccuacagggccugcucccuuaaugcugggggccacaugggacuuguauggcuaacucugcacuagcuuagacucacuguaaagugagagucuaaccuaucgguaaccuucucagaaagguacuuguuuaucccccagauccagaagauguggacuguaccccuccucggcaucaugugaguuugccaccccagcccugcccuucucaccacaucacaggaacuggccaugugagggucaagaguuggaggagagagcuguggucuucuaguggcuucacagacccaauuuugggcucuuagguuaaaugccccacaaccugauaugccugucagcccaagagagaaacauacaccuuccccaggauggucauccccuaccucucaauggggcuguccuucccaucagagaagguugguacauggcccugccaacaggagggaucaucuucuuuccucaggaugacccggagaaggaacaggacaacccugaggauccugugaauagucccuacagcagcagggagaguaauguggacauugcagccagcuccuccaaggagcagggcccugagccugaagccaucaguuuccugggggcacucagaauuccggugagauguuuauggaaugaagggaagauggccucucuagugauuuucacuagcuucgagggaacggggugcuaggggugacagguagcuucaaggauuuccaugcagacugugggguggcuguuugagaagggcuguguauaucaggccuguuuugacaggacaugcagcauuaggcacacugcugaaguuaggguggaguguauauuuguuguugccuuguguaggaaugaugacagucaugggguagugcuagccacccagggggccuccacuagacuggggaucucuugagccccuuuccauucugccuucucucauguuucccagggagugaucgaguucucuuuaugucugcucuuugccaaguuggucagcuauaccuuucucuacuggcugcccuuguacaucuucaauguggguaaguucaggggaagaggaacugagaaaaagggucucugaggaggccaaggccacuucuggugcagggaggauaucauacuuggguuucauuccaguacacagucaaggcugagccccaugcaugucuccagccaccugcccccuuggagcugaguugggucuuaggaggaaaacucuguccuacaaaccucuuuucccuagccugagucugggcugcuugguucaaaggugggugguagucuaccuugaacaccuccaauucaaggaagaggcugugugagcuuucguacucuguggacuucaggacucuucuuccaaggaccguuaugggagugauguguuuguacuguggccuuugggucuacauggagggagcugccccaauauaauagcuacuuuccacuguuccuaaccaaggcugcaaagauauaaggagaacacuguugugguuaaaauggcuguuugguucccaccugcucagagucucugguuugccaugggguaacauaccaaagagcaacaugcucugcuuugcuggcccccaggauucagagagccacaccccauacccaagaccuuuugcccagagcugcuuuccugcucuggggaaagacagaaacuguccugcucacacacacacacacacacacacacacacacacgaccaggaaaccauggggauuagucauggccagaucuccagcuguaguuugaccuauaucucuacaugagggccccugucucugauacuggcagaguacuacggcaguuuugcagacacuaugacucuguuuuguggcuuuuuugcugacuucaaaguaugaaucagccuugaggauggaguugcaaaucaagcuucuaaauguuccccuuuucuaaacccagaauccccaucuuccuacaggucuccuucuguggcugugagcauuaguacagaccuaagguggccugccgaggaaaagccccuguggagcuugcuucuauguuaggagugggucaagaagauagcugugcccaugcucagucagaaccauuauacuccagaagaguuagagaugcugucaugggcacguaccaggccugcaggagagccuugcugugaaaggucuagguuauccuucaggcaaagagagcuuaggacuuggcucugagggugugugugucaggcugcugcaaacucaccugguggcucuagccaaucacuuggccguguagccucagccuuuuccuuggacuggauuaaugcgccacaggaacucugcuggcugugucauucaggagauuuguuccaaaccuccccgugugucugauuauguuuuuguguuuuccauagcucacuuuagugccaaggaggcuggggaccuauccacgcuuuuugauguugguggcaucauaggugaggcccuguccuuuuguccuggcaugcugucuuuuauuuugcuucuaugcagagguacagaaagaagggacagcuggccaugaucuggguagagagcgaaagccuccuaauguauucucauuucuguuccugcuagacugggugggccuaagaaaagugaucauugcucugugguuucuuggagugaugggaacaggggaagacugcagagggagguggugauucuuaaggccagcccagcacugggcagcagaugaggaacagcacguagugucaaagacagcuugcgagugagcauguguuucagguggcaucauggcagggcucaucagcgacuacaccaauagcagggccaccacuugcugcaucaugcugaucuuggcugcucccaugguacguucagucucagcaugcauaugcuugggaucaggugucuagggccuggauggacccauguauccaucccuauauuugccugcacagcuaugucuuucuucauguguauguauauuccugggcacauguagagacagaaaaaugagagucagcagaggaccaggcucugugaaaagagaccaggauuaauaaucccggaaugggauuagugauuaucucgccuugguggggaaaggaaacaccagccgugacauuuuuugagcaaggaauaaugaagagauugaggauagacacaaaagauguuugugggagaggggaaauuagagagccaugcaugccuguaaucccaggauuugggagguaaaggcagggggaaucaggaguucaaagucuuccucagcuacagagugaguuucaggagacccuggguugcaugauucucauuucaaaaccauaagaaaaauaaaaggaaauuagagauuaccauaguuagaccaucuauugagacacauaaagaccugagaagugcagaugcacaaggcgggaaaagcaagugauauguagaauuccagagcaggcggggacgaguccaggcccaggucucacccagcaagaggaaaacauguccuucuuucuucagauguuccuguacaacuacauuggccagaaugggauaaccaguuccauaggugaggagguggugcgacucucaccuggucacuagugacccucucucuggggaacuccaugucauggguguggagccaagggcaaggaagucacuugcuauggacuuggggcugcgcacagcgccucaucucuaauaaugccaucucugcugucuuccuagugauguuaauuaucugugggguccuggucaauggcccuuacgcacucaucacgacagcggucucugcugaccuggugagugggccacuugugggcacgaggcuggucugagggcguggucaggggcucugucugcaaguccauucucccuucucccguucccacucguuguccugcagcaccucuacgggcucuuuccuuucaaccucagggccccaucaccacccaccucgagcuagcuuucucccagcacugcucuucccggguggcuuugcuuagcuugagcuaucccacuuuacucugucuccccagggcacacaugagagccugaaggguaacgccaaggcccucuccacugucacggccauuaucgacggcacugguuccauagguuuguuacugguuugggcuccuggcagcugaaccccugccuuguuauggguggacccccugugcaccaccgaagguggugggggaagguguguauguuucuuucaugagacuguucuguauaggugcggcucuggggccccuacuggccgggcucauuuccccgacaggcuggaacaauguguucuacaugcucaucucugccgacgucuuggcuugcuugguaagaguucuugggcuacacagaugucaguuggggaaugcuuuauguguacagacuggaacucugguauaaagcaagcacugggacuccugggguggagagaauggcagcugcccuuugcucagaauuacuuccuccugugaggagugcucuuccacuaacuucucagccaccugucccauggaucagcugagccuggaagcucacagugucuucccuucccuuucuaccucgaacccccacagcuccucugcagguugguguacaaagagauccuggccuggaagacggccugcggcagaagcagugggugaguuuccuacaguggaagccauucuccuaaccucacuucuaggacucaagccagggcucaguuacuccaugccgagucugugcugguccacugugggccucaggaacccugaagcagcgccccuugaugugcuguuggaccccaucccacuccggaacuacuaaccuugccucuguuguccccgugugucuccauagcucuagucuggcccuaacccacccgcgauaguauuuuccucaagucccaugacuuuugugaguauuuucuucaaguaugacuaauacgccaucggaaugugggcugcaugggaauccgcuccucuccugcgugugauuucccuccugcccgccagcuuucucuguuuccuugggagccauaccuggagauucaagcuagucagagcacggugcuugggaccuauuucucaggggaucugagaugcuacagagggcuuugaacacacccgcagggcaaaggggccagagaucuggaaucuuuucuucucugaacugaggcagagcugcagaugccuccuaaaugucagaaaucaucugaccccuuugccugggcuguguagaaaagggcaacuaccaaucaaagccuccggaacaaauugcaaacagugcuuaauccggugugguuucugccugguguccagagguggugggugugggagucgcagaggucagugacugagucagaggcugaggugcuggugacugggugacugucccuggggccuuucuggcucuucaggcagaagcgucuuacuaagaaaaggagcuggcaaagccuggaccugggcuggaugguaaaugugaagaaccaucuccuggggucaugguagcccacacggucuggggaagcgcuugcacuuuaagaagcgucacacaggcagggaagcaggaagcaggggugcaugugcaggcauucacagggucugccccgccccgcccugcccugcucuggaggacgggagcaggggacuggacagcaugaguuuucucuguucaccuacauucucugggcuaggcuugaagggagccaggaagagaaagaaaagcagaaagggagaaaaguauguagugaucuggaguggaggccaggcucaccucccuguggcucaccucuuagccuccuugagaggcagguauucucauuugaagugaggagccaguccuggcagaaccuaaagcggaacccagguuuguggagguagcuugucuuucugggcacugcagcucucccaggcugguucuuccuggcaggcccauuaagaaauggcugggacaaggagagcucuaggcugagaaccugaagucccugagguucuugguuucucuguacacucaccucuaucuaagaccuuggcagacuccucaggcucugcaucauugaacauaauggggguguuuuccucaaaugccugucaggguuggucugaggcacagagagaaugagauagggagugaugcuuuuugugaaguggccaaauguggcagaaacacuuuguuucccauauuauucuggcuuguuagugccugcccaacaaguaaaggggaacccuaauuacgaacaguagacaugaaaggcagaagcuuauuaaguuguggcuuacuuucucuuccaucccacccucuguucaugcagguacaaacaaauuugaggccucaauuggaagagcaacaugggccaccccugcuggguacccaacuuaugagcaagagaauggaagcuuccaucacagggagaggcaaagccuccugaucuaacuggucuagccccaagcuacauugccacuaaggaaggguacagaaaacucuaugggaaggggcugcugagcaccaagcaugggaacauggcagacuucaaggccugagcucugggaacugcaaucagaaggaaugggcugaaagcagaaaggaaggacagguucagacucuugcuuguuuggauuccaaggccuggaaaaggugcaucucuccuucccauguuaaauuauaaaccucuguaauuauccuguaccuaugagggauuucaccuuguuucaaaggugcugggccucucucucucucuguuucugucucugugucugucucugucuaugaacuauucuuucuguauuucuccaaguaggacccuguugaucuauccuccacucgauccuguugauaacucagccacuuugaagcauuagugcugccuuugcagagucaaggcuuggaugggguacgggagcugucauaaguacuaaauguaggggaacuugcucucgggcucuugaccguguccacccucagagcccaguaccuuccuugccucacucuuaagaugccucaguggaugaagacaucagggucaguuuggugaagacuaagguguuguauacaacugcaaaugccagugugaauuaagcacugggugcucaagucaugacagcuguccuuuaagaacaaacaggaaguggcuaugggaagaacuuaacccugaacauaggugccaaguuuagcaagaaaugaagauaccacuggaaacaucugcguaacugcuacugagcaguugcuaggagacaccuugcagccacccucugccugguguucugaugccccuuccuuccgcucuugaguccugguucacgacaugccaggcugacuccuggcauuuccgccugaccucuaagcugcccaucagcaccaauacagauuuccuuugccaacugugccacugcuuauccuugguagggccuggcauagcagcagccauggggcucgugaggggcaguaaagcauugucacaugaacaacaaagauugguguucuggggcugcgacagcugucuuucccagagggcauugcucaugacauugauaacacugugcaauccagcaggagccuagacccccauacaagauacauccauugcauuuacuaggauguugugucagucaguguguuagcuagauacacuggccucagcaauaaaauauaaagcucacuugccugguucucacuuuaguccugcaggaagcagucagucaggcacaucuuauccucaggaccugguacagggcaggggcuggcacaugguagucugcucaguguucacaaaucccucaagaccagaaagacugaccuuauguggaaaggacagacuuuaaggcaaagcuguguuacuucuguaggccacuagauggugauagcaucccguaguagaguccagggcaggcaggguugcuauuccuuccucugcagagaaggaagacucugcuuuccugacacagccucuugagagaucagugugggaggagugguucuaggaggucuucucuaucucagccucauuacuuaccacauucuuccugucuccucaucuacacaggggaauaacauugcucaaggcaugggacuggugugaagggagauaaguguuagucacacuugcugcucuugucuccuuugcagagaagacagacuaugaaaauagaaacaacacaagcuacaaagcaaugaccucaguugagggcuacaucauucauuaguucagaccugaugcgacaggacuggugggcagggccaguaggggcgauccugguggcuucacgugugacaguauuugaaggaagaauccaagggccuuggaugaucaauaugaaaaggcagugagaagcagaagacagaagaagcuaauauaaaucuugucaugcuguccuaugcugggauaaggaccagagcauggacacacgcacacaugcacuccaggcaggcaagagagucauuagaaagcuucaaaagauuugugagagcccagagccaggcuucaaaaaugaaggcuuaggcuggagguguaagaagaggguuggagaaaaccccaaaggcugaggaucaccacccccauggaccguucugcacucgcuugccaggccagguucucugcacccuccucauccccccaacacgccagcucugcgcacaguuuguucacuagaggccugguaccugucuucucucaggccucugcacucacacggggcuaaugcaggaacauuaccuuaauuaguuauucauuuaauuuaacuucacauuuggucucaauuaagcuuaaaauguucuuccuuauagaugcuacaauagcacguguaauuaaaaggcaauaacucuuuguguuucuccuuuagagacccacugggaggcugggcuaguguguaugaggaguggcaggugggaaguagcuggaagggaaagagccucuuguagagcugagaauuuuaaggcuucacugaaggagugaggaaggaccuaaacaugggaccagacagaggguggggagggccgcugcagggagccaugagaccuagacaaagcaaccgaccuuguccacgaggcuaugggaauaagggagguuuggggguggaaggaggccauccuuacagcuaagaaauggaacccuauauccuguagaagguguaa

SEQ ID NO: 5010 - RNA, 479 nt, Mus musculus
gcuugccccauucuuucuuuuuuuuuuuuuuuuuuuuuuuuucuguuauggaaaaaguguuuauuuugaaauuauuuuaauugagaaguagaaaaccucauaggaaggaggaagaaacaaaacaccacacagcauucaggcaacgcuuuacuucaugcccuuucccccgcucuggcucacucgucccaugaugagaaggacucagccacccacaauaauguuauuaauggguauauggaucaguuucacgaagaagccaaugaaucccaugauagcaaauccuauagcuguagccauggcaaucuucuggaauucuuuucugucggguuuggugcaucuuuuaaccagccgaauugaguccuuuacaaacugccggcugggcuccacaaacugcauuaccugauccauguuuguuggauggcggauugagagcguagagacacguagcucaggagagaacccuccccauucuuucauaa

SEQ ID NO: 5011 - RNA, 7000 nt, Mus musculus
cacuucauaguuuuaaauuucccuucugaggcauuuucuccauuuuuuagagcacuuaaguaaauccugcaauauugggaaggacauuggcucuucucguggucuucucugccugucuacauaaagaagguguaagcagucauaagcuuuugguuucuugggucacuuuuagucauccugauguauuguucucuaggaaaugcagagcacagcacaagguucccugcccucaaacuagcucuaucuaugauaaccaacuuuuauauaauuguuacuaauuaacaauguuaacaauaaauaauggcagucuuucuggagucuucccacucuaaaaaucccauucuaaaccuagguaaucauuaaucuauuucuuuuauguauaaauaagucuuuaugugagucaucuuauaaaugaaauauacaauaugagcucuuuuuacugaacuuuuucaguuagccugaugucaauacucaucuguguugucagauucauuaauguguugaauaguauugauaguaauuguaaugauaaaacuauuuauccauucauccacuaguagacauuuggggaguuuucuacauaguuauuaugaauucugcuaugaacaguuguucucaggauucuauaauacauguuuucguuucaugguguaugggaguaaaauucuggagucacccaguagcuuuguauuuaacuuuugacaaacuacaaacuguuuuccaaaguagcuguacuauuuuucacucuccagaacauguaaggaaaggcucaguguucuucaccaacauucaugucuuagacagguggcugcgaugugguguuucacugugauuuuaaguuccuucuagcaguugauauugguuauuuuuuucaugugccuguuggcugaguggguuugucuuuugaagauguuugccagauacuuuuccagcuucauaacuggguugucuuuuuauuauggaauuagguuguagaaauuuuaaaucccaacucaggguuucuacacugccuuugaccauuuuaguucccagauaaaacacacacacaaccuuuauauuuacaguaagccuuaaauugcacaagagcagggcagauaccugcccucuaugcuauuagaaucuacuuucuuaugauaaucccaaguuauuacuuacaauguuucaucuaggcugcucuuaacuccaauuggccagccuucaggccaacguuuuuauggcucaccuaacccauggcugcuucucuucuuccuacacuuccucucuugguuuuccucagaccccaagcccuggaaaccuaaaccuuaccucugucucuucugccuagcuauuggcuguuggcaucuuuauuuaccaaccagaaauagcuuggggucagagucacaggucuuugugaggacuccagaucuugggauccaccacuuagcauuauaauagauagcaagaccaaaccucaacagaauuagaagagcuccuaauguagucuacacacagguccucuaugagcuggaucuuuuguauuugcucccauucuggggauugauuuuguuuguuuguuuguuuguuuguuuuuugacagugucucacuguuguucuggcuguccuggaagucacuuugcagaccagguuggcuuugaaaucacaaagauuucccuggcucugccucccaaaugcugggauuaaagaguguaauaccuacuucuuuucacuuucuuagucauuucugcagcuuguagacuuaaugauaucuaauuuuuauauauuuguggccuguguuuuuugcuauagucugaaaagccauuccuugauccugggccacaaauguuuaucucacauguuuuguuacaaguuuuaaaaguguugguuuuauauuucaaguuacuauucaguuggggcuaaugugugucaaaggucauucuuucacauguggauaccuaguaucccacuaucacuuguuaaagacgaccauuuggcacauagaauugacuggaaacgucagagcuuccuuguaagaucucuguuguguuccauucauccugugccuguccuuguauagaauauuucuacaauacuauaacuuugugauaaguuugaaguugacaagugugagcccuuuuuuuccuuuuuuaaaaagauaauuuuacuuuucugaguccauacauuuccauaugaguuuuaaggucacuuuucuaccaaaaacaaaacaagacaaaacaacaauaacaaacaaaacagcaaaacaaacaaacaaacgaacacacaaaagaguagcuggauucugauaggaaacauacugaauuccugauuaacuugugaauaauuggcaucugacccaugaacauggagugagaucucauauguguauggcuuuaauuuuucuuggcuauguuuuacauuuacagaggacaaaaauuguauguagguuaaacauguuccuaaugcuauuauauugauguuauuguaaacgaaauuaccuuuugucccuuuuuuuuuuccaguuugagccuggucuuauguaacuuaggcaggccucaaacucaguauguagucaagaagagccucuccuguuucuauuuuuuugagugcugaaauuauaggcauguaccaccauacccacuugaugcagugcuggggauugaaccagggacuuugugaguacugagcaagaacuacaucuucagcccagaauuuuguuuuuuaauuauaguuguggggcauauuguguguguguaugugugugugugugugugugugugcgcgugugugugcgcgcgcgcagggggggggaggggggugacacuacuguuuaaauguggaggucagaggucaacuucaaaaguugguuuuucuccuucuacugggauccaaggauacaacucagguuaucagacuaguucacccaguacuuuuauccacugagccaucucuccagugccagccaagaauauuuuauauguugaaucgugucaucuuaaaauagaaccuuacuuccagcucagcauuuuguuucuuuuucuugucuaauuacuagucuuguuacugguuagaacaucaugcacaaaauuguacaguacuuuaagagcaaagaauuuuuaaaucuucauggcauuuaucagauuugaugauguucccuuuaauuacuagcuuacuggguguuguuauccuggaauugucggguuuuaucugauucuuuccugcuucuaguaguauuauguauucuuugguuuuuguuuuuucuuuuuuugguuuuuugguuuguuuuucuuuuggguguuuuuuuguuguuguuuuuuguuuuuugaucagggccuugccauguagacuaagccagcuucaaacuuaugcucuugccuuaaaaaaaaaauuaauugcuuuucuuguguuaauacaacauuauuuuccuaagauacuuuguauugacuuuuauuucuauaggccucacacaguuuuuuguuuguuuguuuguuuguuuguucuaagucugguuuucugaaacaggugauuugacuuuugugagcucaaguuaguaaaaugaugauaaaaugaccauugaauaucauuacaaaacuuuaagucguuuaguuucagucuauauauagaaguuucaagauugaugucuuaggguuguauugcugugaagagacaccaugaguacagcaacucuuauacaggaaaacauuuaauugaggcuagcauucaguuuuagaaguuuaguccauuaucaucuuggugggaggcauggcaacaggcaaacaugauauugagaaggaguugagaguucuacaucucgaucaacaggcagcagcaggaagagugacacuggaccugacuuaagcauuugaaaccucaaaccccaccccacugacauuuacuccaacaagaacacaccuucugguagugccacucccugguaaccagcauucaaaucuaugagccuauggagaccauucuuccacaaacccccauagaggugaauguucuugaacugcagucuggucauauguuaacaguggccuguggugccaucugugacuuauagaagucucagaguaauagcauugaucaagaagaagcaagccaccugucacacaugaugguaguguggugaauucuguuugaagugauaaaugugcuuuggaaggaaaucuggaauccaaguuucuuguuuuguuccuaaauuugcaagacuguuguccuggcuaguuuuaugucaacuugacacaaguuagacucaccagagaggagggagccucaaucgacaaaaugucuccauaagaucuggcuauaggaaaaccuggagggcauuuuauucacuggugauugaugugggagggcucagcccauuguggauggugccacuccugagcuggugguccuggguucuauaaaagagcaagcugagcaagccagggggagcaagccaguaagcagcacccuccaugaccucugcaucagcucccccuccagguucuuccccugcuugaguuccugcccugacuuccuuugaugauaaacugugguguggaacuguaagcagaauaaacccuuuccuucccaacuugcuuuuggucauggugcauuaucacagcaauagaaauccuaauuaagacaauggggaaccaaaauuugcaggguaaacuugaaucaccuuccuagauuagcagagaacuuuaaggaagaagaggcuuaaagauaaaaacugacccuaaagagauggauuuugauuuuuggagcaggaauaguuuguggguaaagaaaacgauuagguuuggacccaggauuuaaaguaguguguggcugaggaaugucucucagaguguuuguuuagcauguguaaggcugggaguuugaucccaguacugaugaguguguggcagggaaggagggagggaggggauggauaaguaagcaggguagaagguaggcauuucagucggaaaaaagagacugaauaagaaugaauauuggugucuggagagaggccuccaugauuaaaagcauuggcugaucuuccagagggccuggguucaauuugcaguacccacauggcagcucauaaucaucuguaacuccaggacuaguaaucugaugcccucugcaggcucaggcacugcgugcacauggugcacagacauacauacaggcuaaacacccacccauacacauaaaaauuaaaguaagagaaugaauaguccuuggauagcuguucauacuuucuguauguguuuccuccucacuauuauuugauggcacagcuuucucuaggcaugaaaaaaauagacaacagggaaccgucacagcucccaccauuuuaucuacacaggcacacuugccugucccuacuuaauccugcuacuguggggcucucucauccugucuuaucccauccuguggcugaagugaguccccccaucuccucaguacuucucuuuaccacaucauuaauuucucccacaccaggcauggugguggcacaugccauuauugccaacacucaggagacggagucagacagaucucaagaguucaaggccagccugguauauagagcaagucccaggacauccagagcuacacagagaaacuguuucaaaacaaaacgaaaguuucuaacauuccuguaggugcacagaacuguuguaauuuuuuucccauauggaaaaccagccaacuuaaaaaaaaauguagaagagaauaaaagggaaaaaacuaacuugguuuaccugauauacuuucaguuacugcuaaacaacuuugcuucccuuuaaaacaacauuccugaguucucaguacucacugcuccuucuuauguucugccuuauaccgucugucuuuaccacucuagugaaaacauucuuuagauagggugugguggugcacacacuaaggaggcugaggcagcuggacccugugcuccaggccaaagucaccaguagcuucuacauugcuaaauccaaaggucguuuucaaacuucauccuaauuaucaacagaauuuaacauacgugauccaucuuuuuuuuuuuaaucacccuaucaccuggcuuccccaccaccaaaguucuaauuuuuuuucuguguucauuuugaaaucuuuuuuuuaaauuagguauuuucuucauuuacauuucaaaugcuauuccaaaagucccccauacccucccccccccaacuccccuacccacccacucccacuucuuggcccuggcguuccccuguacugaggcauauaaaguuuacaauaccaaggggccucucuucccaaugauggccgacuaggccaucuucugauacauaugcagcuagagacaugagcuuuggggguacuaguuaguucauauuguuguuccaccuauaggguugcagaccccuuuagcuccuuggguacuuucucuagcuccuccauugggggcccuguguuccauccaauagcugacugugagcauccauuucuguguuugccaggcacucuucugucuuuccuuccccuugcuccuuugagcuuuuuucuaggucuguggguuuaaguaucaacuauauaugaacaacuuugaaauuuauuuuucuggcuccugacuucaucucucaucuccagauucauacauuuggcugcauagguaacauuucuguacgguugguuucccaaagauuucugcuuuucacacuuuacccacucucaguuaaugacaguucugcccaaaaccuuguagaaaucauuggcucuucucuuucucugauccuucaucauuccauuagcaaaugaugccacgugucuaccuucagaguuuuaucucuaguuccuguucccacugcuugacauguuccaaaccaucuuucuuguggauuacuugugaguuuccuaacugugcucccucuccuccacuccccucuuucuucccccccccccccaaucccauaauccaugcuggccuuaaacucucuuuguagccaagaaugaccuugaaugucucauccuccugcacccaaugucucaagugcuagga

SEQ ID NO: 5012 - RNA, 4953 nt, Mus musculus
cgagguggcaugguuuaggcuuuaauuauuaacauggacgcucaccacccucagcgaucagaagucagacaaccauagagaguuuggacuuagugguggucauggugcuggcacauggagacuucuccaggagcucuuugcuaugaucggcucucauagaagcuugcucaaaaaccccaggagcgguugcauccucccugaaggguacaagcaaagucacacagaggcuagaaacaucccuuaggcaacugucauccucuaacucagggacauguaaauuuugcuguccugagaaucaucuguagaacuuuguuuaaaaugaagggaauccaggccggucucaccacugacacacacacuuugccuuuggaggcauagaaauuggccuaaaucugaguguuuaaagaaguuacugguggguuugucuagucaucugaagaccacauuuuaagacauguccugggaguugaggagguggcucaguggggaaagugcuuugcuucuaagcaggaagaccuuaaaucaaacccccaagaauuaucauaaaauauaucagacacaagucauggaucucugggguucacuuggcaucuagcucacuugaccagcuccagcucagugaaaaaugacuccaaaaaguuguucucuuacuuccacaugggugacagagaacauaugcucuuccauacaugcacaguaggaacaugcaauauuaauaaacuacaauaaguaaaaauaagagagauggccuuccuaaaaaggucaaguuauccucuguccacauacucacacacucaaccuguacaaacauauacacacguguacauuuguguacaugcacacacacacacacaagaaaugaucagguaugauggugcuuggggagcaaaaacauaaggauuucugugaguuugaggccaaccuagucuacacagagaguuccaggcuagccaaggcuaccuagugagacacugucuaaggaaagagaaauauuacaccaaucucuacaugcaagauaccaugccuugcagcuaaauugucaaguauauaacaaagagagcuuuggcuuuuuguguuugucccauccagaauaacuaaucuuaagacaaaugaaacuccugguauccacccuccaccuuccccaauuaccucuaugugagauauguauaccaaaacgcauuagguaagugauauauagcuaaaugcaucaagugauauauauuuaaaugcauugagauaucacgcacaacacacacacacacauaccacacacacgugacagucugacaaacagccaucccuaucccuuccaguuuaugaauccaucucuccuuucugugccaaggcuaaacaggaacucccuccccugaaaggcuuuuaaugacaacagcuugaagucugaagacauccacuuggagccugagcccgaucccuuucauuucccucugcaccacccccagcucuccugcucaccgaaggucacuacccccauaggucuccuugggcuccuuuuuccucucuuucuggaaccugaugaggcagaaugcggcgacugacaggagcagcacucccagcagcaccccaauaagagucccagcuacucggccuucagaugagucuagagagacacaaaccucagaguuguaggagguuuugcccaccuucagauaaagagucauauaaucucucccaagccaagccuuugaccaggccucuacccagcauccccuaccagucacggagagguucagcucacaggaggcacugcccaucugguugcuggccacacaucgguaggugccagaggaggucagggagagauugguaagaaugagcuggccggacacuucaucuaaagagugagaaggacaugugugcuaccauggauucaacucacagugagcccauacagcuaccaugaaagcucacugcauucaguccuuaaaacaaacuaccaagaaagguuuagccucaucugauuggucagaaucccugcucagaaaaaaaaguaauuugagaagaugcagugaacuccaaagucacugcaacuugugugcccuugccaccccacacugcugccuuccuggaggaggaacugcauauccaggaaggcgauaauggacgguggaacacuuacuggaugaggucagauccuggauggcagcaaaaggcuuaauaacuaaacauucauccucuaaaauggaucaaagcugagccaacugcuuuccugaacucuacuucugccucagaaggcagagaacacaucaggaaaugaucuaggggaggagauuugcuggaauaagugugcacugggacuguuacuacccgaggaaacagggcaucugggaccaacaaacgagagcuaagccuucuagauauacucgucuccaaagaaacucacccgaugugugaaccaguccaagcuacucuaguuaccucacuaggaaguuuggaagaaacuuaugacccuuaacaaaucuacacuaaguaggcagguagggagugcgagauuguucccugcccucugcucucuuccauguuauccaggaagacauuuagcuugagaaguguuucccaagcacggcaggaagacagacaagaaggcaucaguacaagaaaggaggagggaaagggccuuagucauaacagauauggggaacuggauuuagagaccagaucuuaagucuccaauucacucuucccaaugcccuguacucuuaccuugaaccaugcuaccaggaggagguguaggagaagauccgagacguucccaguuguacacuggcuugggugcucccucagaggagcggcaucccagugcagcagaaccucccacagagguuugcccacucuggcugcauaaggggugacuggggggcacugcgaaaaccacaggaggaucucagcaauccucuaaccccagaccuacugacuucaacauuuccuuuuucaauuccucugccaaauaguggucuauauauaccacucaagugauuuccacuacugggaauucugcauccuggaaaggucuuccucaugcugagcccaagcacauugcuaauauaaugucaacggaacaguuucauuucuuggcaucugggcccauaaagagaaauuauaaauucucccccacaugaaggcccuucagauauuugaaugcaugggucauggaccccauccugggccuuuaguuuuuguauaaacauccuuguccaccuuucaaacaucuuacucagcuuugaacaggcucugauuaauggugaggugggagcucugaacacaaugugguacucaguuauguaggcuuuguuccucuaauggucacuucccuucucugucacugacguuaggagggacagaauccaaaucugagcuacuagugggagguuccugaaugaugaagcuggugaacuauguuaugucucaacacccccauauaugacuaguuucucucucucucucucucucucucucucucucucucucucucucucucucucucucuccacacuuagauacuaggcccuaagggagauaccaugggguggaguuguagugugacagaccaucuaggguaggauaauuuuuuucuugaagcucccaaugcagcugugugcuuggccugcauaucaagacuaaagggggugggguagggguggcaggucaggauaggagagugguuagugcauccccagcaugccuuacccagcacaguaagguugauuaaccccaacccguugguguagaaaucugguggguuguuaacauugcagagguaggucccagugucugaagggcggaggucagucaguuucaggguagccaguccuccuguggguggaucguggagaaggauggcccgaucugcuuuagagccagugggauacagguggccauuggugaaguacagaaccugagaagaggcccaaggcauauaaguccccuuuucugcagagcagcaaaaggcagaacaguauacuaucaaucaaucacaccacaggguucaguuaauuuaguggcugaaccagacuacaucugcgcaggggaguugggacucaugagcugugucgaagaggaagagagaauauaggaccaaaauggcugaaguccuccccaaacuuaauccugggugagcccucggucccuggccaacccagcagauaccccgccuucaacuuacgggcacggacgcagagaugggcuucccaggcugcacaaagcuccacuccaaggcaaaguugucgcccaccgauguuuuguaacugcagcucagcucggccgucuuacccuuuggcacgcucaguggcucagugggcacagucaccuccacagcuagcccugggaccaaggaccccaacaacacagauccggagggucugucccacacuacuguggcuguuuagaggcuggggccuccuuugccacagcacaacccccuucuucaauccaaccccuucccuccugagagguuuccgggagggaggagcccacggccuaacccgguuuuuuguggguaaaagguccaagauuaggccagguaugaggauguguuggcagaaaaggaaacaagaaaagauccuguaaugguaaaucuuuagauggcgagagaggccaacucauuagcuugccucucgcuuccccucccagccuucaaagcccccuucccugccuggcacagugguucccagcugcaggaacugagcaggccugggaagcccuucccugccccagcucucgccuugaucccgcccacccagccucuccucaccgcucaggcacacgaagcccagcaagugcccgcaaaggaaagcccccaccaggggccaggccauagccacugcugucuccggguccuguucucuaucggucugaaggauguaagggucuaggaaagcccgaagggcagccgccuuguguugggcuggagaaagacuggcuaucucaaagcaaaca

SEQ ID NO: 5013 - RNA, 8415 nt, Mus musculus
guacacuuagacauuccucuuuauuauucacauuccaacccaguaugguaacaugcacacgcagagauuaaaaaccuuccagccacaaccccaggagcccaacgggggagaggcuaucauggggcggggcugcggaagucuccuccugccggagccuccaggcgcucaggaggcuuuugcauaaacaaagaagagcgggaggggcugcucucagggugcguuuucaagaaaaaagagggugacaggcagguaugggauaggacuucacuuuccauuugagcaagggaaauuaucagauaaccaugaaaaccuccuccccucuuuccuagccccagguuuaggagguugagguuaggcuaggguggaaagacgcgggcgcccccuuucguugcccacagaacgaaaggacuuggugguugcuuuuuuuuuucuuucuuucuuuuucuuuuuuucuuucuuuuuuugagaguauuugggcgacgcauugggcgcccucugcaguacgcgcagcgaagcgcaccgaggcugcggaggcagagcugcaugcugggcgcguggacaggugggcgugaagcaaaaggacauuuuugggaguaugggguuugggacgaggguggggagaaaaggcaaaaggagaccacguuagacugaagagcuaaaaagggcacggacuuggcuacgccaagacgaagccagccugggagagggagucucugggacgcggcggggggagggggggggcuccugaagcuggcugguuggugggaaggaggggcucacaaacacaguagggaagucuugucacugcgaaggggacgcggcauccgacucuccucuggaacugaggaaagagaaggucugagaaucugccuuccgcugguaccauuucccucucccuuucggggagugucauccagacccccucccugacucacugagcugaugugugccccagggcaacuacgugagugaggcucccugugcucaugacccucggccgagcuugugcagucaaaugagggugacuguguguacguguugguccaagugugucccugccgcagccucaggcgucuggacauaccagaggccugcaaaguuauguuccuuagccaggagggguucagggcuagcagagagaaggacuagggaacugggucauuucucccacccagccuacuccccuacaaacucugcugcuuugguuaccuucuaaaacguucagcucuucgguccaagaugaagcagacaagaggaagggagaaacagguuagcucuuggcaaaucagcauccuuggccuucucccaccuacuugucugaguagucuagguccccacccuuaacuaccuucaccaucuucuccacucccagcccaaccuuagacuuccccagcuuuuuccaagcaggccuggaagaugagaaccucccgccugcgaagcacuccaggcagccucaccuggccuagucuccgcuggggccgccgcccgcgccuccccgggcgcccccagcuccgccuggucccccggggcccggucccuuccggccacacucuccgcucuuuaucuucuuccucgccauguggccccggaaacucgccuggauuuuggcugcagcggcguuggcuccgggaucauccagcgggaugucaagaauaucgucgucuggcuuggagcaggcgcucuccugaggauggggcauauuguuguuuuuguuuuuguuuuaaugggguugauaaagcccagacacggaggggauggggaugauaaagacagacucccagggaaugugguaagaguagugcccuguaagauugggaggacuucaaggauggcagaaggaguagagagggaagccuaugaguauuagcgcaucucuuaggcagccaagaagguucuggcccaggcggacacagaaagaaguacaugggaggauggagaaaagagagccagcuagccccauuugaaaguagccuuuaguuuuagggggcugccgaguugagucuggaagagcaaaggaaaagcagcaggcacuccugaaagugaccacccuuugcucucagaagaugcccagaccuucuuuguacaggauuccucagggaauggacauauauaucugcuacagagcaguuuucuccggagcagaacugcaccagaacucaauucaggagaaaaugaacccaccacuccuggaaucagccagaggcccagacguggucuuccuauuggacuugcuaguuccuacugucucccagauuggacccaaagaaccccaaagagguaaaacgacaauaacugaaaaggaaacagaaggcaagaaguucuuaggucaauggcuaccauuuaagcuuuuucccaucuugggugcaagagcugugcuuuucaaauauuuuaauucuuucucaacaauaaaggugggucacuuucacucuuucuugaguuuaccaugauaaaacugauaauuaagaauguaaaaaaaaaaaaaaaaaaaaaaaaagacuggagagauggcucagcuguuaagagcuccgacugcucauccagagguccugaguucaauuccuagcaaccacaugguggcucacaauggaugccaaugcccucuucugguguaucugaagacugcaacaguguacucacauacauaaaauaaauaauaaauaaauaaaucuuaaaaaaacccaaaaccuaccaggggucccagacaguugucaauagcugguagauuugaaccuuguucuguuaaguucuagaguuuauuuuaaugcauaagaaaggaaacacaaccagcugaccagcuuagguguauucuugggaguacuguguggucuugggagguuauuugagcuuuuccagucuuacaacuuccauuugaaaaacaaaucacgaugauaauauucaccucuacggguucugaagaagagcaaauugaaugguuucaugaagguuucugguauacaguaguugaucagcaaacaguagcuaugcuaugauugccuuguaaaacaauaaggugauguuaaaugaucaauuuuguaagccgaaaguggucucauaacaacagucuuacacagcucauccuaauaauguguuacauaccacgauauguuuagccaaugacacaucacauacaugauggcaguccccaauuauauuaaugauggaugcuguagccauuuuaguuuacauauauacccuguaauguuucaaccauuaugaagucggcuaaugacagacacauuucucaaaacauacuuccaucauuaaggaaugugugagaucaccaaagccgccucuguugcccaggguuccuuccuuuccccuucuuucccuuccuuucauuuacucuuacugcugcuauuuuuaagggcugggaaucaaaucugcagccuugugcaugauuagcaagugucuaccauugagcuacaucccuagacagaaggcuacuugauuaaggcaagccuuaaacuccuguucuuauugccucuaccuacagaaugcugcaggcauauuuucauguucuguuccucuucuguuccucugucacccugcucuaggugaauguagacaggauugaggccagguaaagugauagauuucugaguuuucaguccuaaggaauuuuggauuccgaggaauggagaucaggaguuugaggccacccugggcuacauaagaucucucucucucucucucucucucucucucucucucucucucucucucucucucucucucucucugguuuuucucgagacaggguuucucuguguagcccuggauguccuggaacucacccuguaggccaggcuggcacggaacucagaaauucgccugccucugccucccaagugcugggauuaaaggcguucgccaacacaagaucucucaaacacaccaccaccaccagcagcaccccuccccucccacuacauacagaacaagaacagagaaaggacuuggaagcugauggcaucaauuucagaggcuugacuaggaggacauugucgcuaugaaguuagaagggccuagaagaagcuucuuauggcuucugggauuuuguccuuauuuucugaccgagaaaagcucacuguuuucacgggucuuucucuucuuacgugaggugaccaaggucucacaacguaaguuagcuuuccuucugccucauccuggccaucagcugguugucagauauggacaggguaugagugaggauucagucaucugucucuaacagguuugcccucggggcaugguucuucaauuuauugauuuauuuauuuuugagucaaggauucaucaugaagcccugggugacauugaacuugcuauguaggccagguugggcuugaacuucccacgguucuccugccucuaccucuggaguguugggaauacagguguggccuaccugcccagccugucagcauagcuuucuacuccaaaaggccaaagcaaaguuuacaaaagacucccccucgucaugauuccccagcgacccuccuuuccugggccucagaguuccuuaauuugugcucaaggugcuucucaaaggauuuaaacacaauuucaggguguugccaagagagugaggacggauaggcccaaaacguccccugucuucuugucuuucuuaguuagcucuguagcucucucugacaucuuauacuucacauaaaauaccgaucaaccccuuuggguuuugugauucucccagugcaauucuuucuuggggauagccucaggaaguaggcuuuuugaaagaggacagcagguacaaaaacccauuccagauccccucuccuuggucuugcccgcuguuagaggucgcggugguuuggggaguugguauuuuucuccaaccacccuaagaccugaccucuucaccacucaccacaggugauccagaguaugaaaccuggcaagacaagaagagccagccccaacacagccuagcauaaggcuguacugcuguucccuugacucugcuccccaucccuccggcugauuccuuaggaugggcugcucauggcugcccaugggauagaaaucugggagaagaucauuggguuuggugcuugggcagcugccucucuuaaagccaagacugaugguugucuguguugggggguucugaauaagcuggggucaccugggagugggagaauguacuugccaaaaaaaaaggaggagccauggauggccacauuccuuugccucagagacucucauuuucuucagggccaagcagaacuuagcucaggugaauuguauccuucagcuccccaaauccaaacagcuuuaagaacuaugccugucggcugucccuuauauaucaggcccugugccgaguaccugggacauuuuaugccauguaaucuccauuuuagaagucaagaaacaaccucagagacauuuuauagcucccccagguugcauagcaaaacaacagugaaaugguccucuucagaauuuguacuuuuacccccugccucagggcgggugguuacuucgauacuguuagcugguacacagucaacgagacuacaaaggagaaaggagugggcuaucaaaacagauuucuuuuucuuuuccuauuagacgaaggcaggaaagucauguacauuugcgaugucaaucagacacuggaacaucgaauaauagcuccuuuaaaaacauccccuugaaaaagaacacugauguuuucuucuuccucauuucucucuaagcuugcuuaccaagggggaaaagaacaaguaaggcacggcuagauucuucccaaacaucagguaggauggucauggaagagaacuccagagcaaaaagaugaggaaggcauacuguucucuuuacagcgcagggaugccugguagcagcccugcccucuuccaguccuccgcccuuuuuugcccccucuuuuccuucuuucugccuccuuccaacuccacagaaugagacugaugcugaauauuaucuggcccuuugguccaguggacuugggacauaaaaaaacagagacugugucagggcccagugcaggaggugccccuggacccuggacauucaauaccucuggcagucccucuuccucuaggggacacugauuucaaacacauuaaccacacccucagccauuaucuaucaguauuaguuaucugugguguagcuaucuacuugccaugcaccaauggcuuccuggguauuuuuauaagcacuaaccaggagagacaagguuggaggccugagccccacaucucacccucuucauccuucucaggcuuccuagagucuucacccauucaugucuucccugcuggcacaucucccgauuccuuuccccauccuucuuggcuucucagccuuuucuuucuugccuagcaguuacccuccuccccuguugacucauaucucauaaucugccaucuaucuauuuauuuuuuauuuuuuuacuuaauggaacauugcuggggaugaggggcucuuccucaauugagacugaagacccacaccuuuccuuucccagccaaaaagugauucuugggcucaguguguagcucagaagcagaguacauauuuagcaggcauaaaguccagaagucaauccccagcaccaaaaauaaguaaguaaauaagcaaauaagcaaacaaacuguucccuggagaauagcaaaccgcuuccuuggaagaagcccuggauaguguucuucaaagggcggaacuguaugugauuggcaugcuuguauauguauauguauauguauauguauauguauauguauauguauauguauauguauauguauauauuuuuucugaucuauacauuuacugcuaugagcauuuacaguaaugaaaaucaguaugcuucaaagagggauuggagggcaaucuuuugagaggacagggcuccacacuugucaaaggugccuacuuggggaaaaaaaaucacauuucuaagccccauuuguacaacuguaaaagaccuaccuaccuggggugaucaggcacucuggcagcuguuauuuauuuaacaagaguuaaaaugucagcaauggcuugccccuaaguucucacugcgucuuggacacugggcauugggaagugucaccucucaaagauaugggcuauuccucccuuccaaacuuauuuauuuugcacauugugggagaaaggugggguuccugcugucguuaaguaaccucuggagucuuuagccagagugacagaaagaaaacacuaggaauuuggagucgucucuuuccuuagaucggaggcuaagaauaagcaaacacguuuuauauagguaugggucacucaacuccuuuagccagcuaggagccaggaccagugcuggaugccuucauacaagagcccuuaacaagaucugcuuuggcguuaggcacuugcagcauccaguuuccguguaggcgcugauagacacuuccuccccuugcccacagggcccucucacggucacucacccagcaccuuccaaaggagaagguuuugggggcugaaccagcuccaccccagaaccacacugacuagguucuuuccugcccaucaccaccaagaccaggguggauucuccccgacuucgccacauaagggcuuagacgaucaucugagggucgugaagaucuugccacaguccgcgacagcagcagugggauaggaaaucguuugggggccaaaaaauaccaagggaaaggacuagcacaccagcaacuuuccugugucuccgugggggaaguuccaccucucgucuaagcagcagcuuuccugcaugaaagcucugcucagauccagauacaaccuagauugucuggcccaugggcgcucagacgcccccgcgagcuggggagcauuuuccccagggcuuggcucagaucaggcaggcgccuuccaucauccaauacaauauuucagcaccauucuuucccacauuguuccuaggucuuccgcacccacuuccaucccucacucaccccccagggguucucgugugccccuugccccagaacacgcugaguucaaguauggacuuaccgugcagcaguccauugccgguguugaggguccuuggcugggguggagccuggcgcagagcggggguggguuuguacgaugcuggguggcagcucaggggcugucgggcacuccccgaccagcgcagaauccuugcagaaccagccucucuccucuuggguccggucucccgcgcuccgcaacucuugcgaauguaaccugagcccugcggccucgaagccaaucagaagacacuuucugcagggugggcggggagaacuggagcgaggaccacuccuucucucgacucucuccgccucgcucgcuuuggugcuccaaccucuccaccuacacacuuccauccauuccuccuacacaccccaucuccca

SEQ ID NO: 5014 - RNA, 94520 nt, Mus musculus
gcacacaacacuggcugcucauauaucuucaggaacacccugagcaggcugucacacugugacauccaacacuucuuccuguuggauuccaucacugccucggagcacagcuuaaggcuagugggaaaccucucuucuggacaaggugccuggacuuugucagcaaggugagcugauugggcucugaacccaugguuuucuaggugagcuuggagaagggacaggagcagccuggggcccuugugagugacugcaugcauuuggucuuuggcaacgugaugucagguuaugcuucuuaccacagccuacugaacuuuagggucuggguguaggaggucaaguuuuagagaaugucuuagggcuaauuuggcuuagaccuugaagcuuauauuuuuugacaccuccaguuucaacaguccugcccauuugcuagcucccacaacugucgaaggcaaggauuacagaccuggaaagaagaguucuagaaagggccaggguuagggagugugccaggguaugcuacuacccugggcuggagccagcaagaauuguggaggcaaagacuagaagguaaggcagguagaagagauggugcaaccagugagaggguaaaacauaacuuagugcaaagccucugugguccaggacauaucuuucuugggacagauggagaugggacuuggagaggauucuuccuaguaagcagaaaggggugguggugggaagggugaggugucacgugaccaucuaguugccaauacuuguggcuuccccuccugggagugggcccucucugaacauaacauccccgcucaagcccacagagagacuccauaauaagaaggggugggaaagcuggaggcuugugccuuuggcagagcugaucuggggcuucuaaggucagguuuuacccauuugaguggagggaguggggguagcaggaaauucaguuuucucugcaaauauuucagcuuuugcuguagucguauuuuuagcaaccugguuggcagagaagaagccuggguacauuuuuaaaggggccugugccagacuggagggcucuuuccaccccuaacccacaugucaggaaggagggggaggaaugagaacacauggcagaaggguugcauucaaacucaaaauucaggguugcuggcccugcugaccacgaagucauccucacuaacagccauuauucgccaccagcacccuuaccaucuacagcaucuucaagacaaguaaauauucccugaacuugugcugugaagaaugcuguggggacacaauauagaauuguauaauaugugguucacccuccaugucuauggaugugaauguaugggcuaagcuaacuguaagcugccaauauucagaggggaagaaaaacucaucuauaccacucagacuuccuuucuugucaucaucccaugauacaguauaagaaucauuuacauagcauuuacauugaauuaagucuuaugcauaagcuagggaaaguuuaaaauauacauagaaccugccuagggcacucgcaaacaugucguuuuaaacaacuuuuaaauuauuaaaaaaaaucuuaugugugucuguauaugucucuguguggguaugugcugaugaauguaggugcccauggagaccagaagaggguauuagauuuccccugcagcuggaguuacaggcacuuaaggggaguaaaacuuagggucucuguaaaaacaguacaugcuuuuaauggcugagguuucuuucagccccaaauaugucauuuuguauuagagaccugagcuacugggaaaucucccaauggauauucagggacagacucagaaagaaagaaccagcaacaaugaggaaugcuaagcuaaauccaaauaguguguuacggagggcuuccacggacaucaucccauguggcacuuuuuauagcauauuaacacuuuuaacccccuuuucuugggccaagauaugugaaaugcccuguuauuugugugguacuaggucuccagugugauacagaacuggggcugcagcguguuggguuuccuuuaaaaagcaccucucaggucuggggaaauggugcccgucaugcaagcaugaggaccaguuuggauccucagccucaccccucugggggagggguggggagaugaauagaucccuggcgcucauuucccagguagccugccuaaccagugaguuccagauuugaugugagacccugucugaaaaaugaucuggagagucacugaggaagacaucuaguauuagugucuacaagcacucgacccaugugugugcaugcacaccuguuccccccaacuccggcagaaccucaggcuuuguguggcagguuguguuugauuuaaaaguuaguccucuccacuucccucuugguucuugugcagaaaauaaaagcaaggaaccauacauacugaaugaaugacacagacagucacuauuacgggagcugagaauuuggaugagcacaaagacuuucugaagaaagcuggccugaagcaagguguggacccagugaagaggucugagagugggcagagcacaugggaggcaggugcaaauuuugugagccagguuguucauuucaggucacugaacuuaugcaaccuuugcccugacuggaggaaccccgaggacugaagucuugaucucuuucccuagauacaaggcaacgguguguguguguguguguguguguguuacguuugaaguucagugucucuuugccaucuguggugacauacugggguaugucuagaccaugagaaagcaaaccaaauguuacucacuaccaaagugcucagccucaauacucuuuagagcucuccacagcuuggcccaccacuucuuuucugagaugagacucagugugguccaaaauccuagauauggcuugacucuugucccuguauucucucaaacaccugcuucuccuaccucuuccacucauucaguuugcuuucugcuuaucccaugaguaauagcuucuucuggcugaucaguaccugcuggacaaacacaucuuacuggaacauuuacccagcaaguguauuuuaauaacauggcagcaagcauuuaauaucaucugaauagcaaacuccagaaacacccugaaaauaaccucgucacuagucagagguccagacacaugcauguuuuaacauauauaauauauaauauauaauacacacacacacacacacacacacacacacacacauauauucauguagcauuggcuugccucaaacuugcuauaaauagccaaggaucuugaacugccgauuccccugccuucaucuucugagugcucagauuauaggcaugugcuaccacaccuguuuuaugugaugcuguggauggagcccagggaugagugcuugcuaggagagcauucuaucaauauggcuacauccauagcugcauuuuaauuggcuuuuacagaaagucaauuagugaguuacaauucuucuauuauuccuuagucuguuuaaggaccuuugugccuuuuugucacuuagcuugauaggugaaaaaaaaaaaaaaaaaaaaaaacaacucuuguucaagcagcaacgucaguacccguaucuaagugacgguucuagccacucugcucuuuuugucuaccucagagaagccuggggauaaguucuccaggagaugaaugaacaucaucucccagcuugugugucuacggucaguuuuguagcccugugccucauggugaugcucccuggaagcuuggagugguuguucugaucauaugcuuuggucuaugaaugguucacuaaucagcuuuuauuaauacuuuuaagaugccuuuugauuucacuaauauaaaagcuagucgcaucguauauuuggauacaaaguaucuauccauccuucaucaucaguaauuuucaacucaucaccaacuuuaauuuauaucucuuauaauuucucauuauuauuuuauuuauagacaccuaacauauguaugucugaaauauaaggccucauuaguaccuauuuuuuaaacuuaugauuauuauuauuuuuaaagauuuauucauuuuauauaugugaguacacugucacugucuucagauaugccagaagagggcauuggaacccauuacagaugguugugagccaccaugugguugcugggaauugaacucaggaccccuggaagagcagucagagcucuuaacugcugagccaucucucuagcccuaaacuuaugauuauuauacugugaguuuuguagagaaagauaugaaauucuagggacccaguguaacaugguagcauuuccuaagagagugauacuuaaguauacagcauccagacaccaauaacuguguauaggcugaguuaauuugauugugguaaucauuuuauaauguacgugucuuaguuaggguuacuguugcuaugaugaaacaucaugaccaaaaccaaguuggagaagaauggauuuauuuggcuuauacuucaacaucauagucuaucacugaaggaagucaugguaggaacucaaacagggcagaaaccuggaggcaggagcuaauguagagaucacaaagcgaugcugcucgcugcuugcugccuugcucucuauaucuuguucaacugcuuucuuauucaacccaggaccaccagcauagggauggcacuauccacaauguauugggaccucccacaucaaucacuaaugaaaagaaaguacgcuaugggcuugccuacagcccaauauuuauggaggaauuuucuaaauugauguucucuccucucagauaacuauagcuugugcuaaguugacaucagacuagccagcacaguacacauauaccaaauuaucacauuguauacacuuuucauuauauuuauuaaggaaacagaaaguaucaaauaauaaggagacauuagaauuauuuaaccauuguagcuuuagcacauuauauaggauauaguagacaaugauauuuuuucuauuaauugaaugaacaaagggugaaauuaauaaaaguaugucaagaggaaguaagauuuagagugcaaagugccuauugcaguaaucaggcaugaccuuaugggaaauggggcaguuuuuuuuuuuuuccacccagaggcccucuacuucuucaacaagaagaacacuugcuguuuuuacagaggacccaaauucaguccacaggacccagaugccagcucacaaccaucuauaacuccaauucuaaggaaucugaugcucccucccggcuucuggugacacugcacacauauuaugcgcauauacacacauaggcaaaacacucauacacauaaauuaaaugaauugaaaaaagaagaagacuaaaaagggaagccuuucugaaggagacagauucucaugccucugcaaucuggucuuaggcuuccauucuuuugugcugagacacagcgauguguuuuucauauguccucauugaggaggcugcuuugugggaacauggcagauacacugugucagggcuugaagaccaggaaaaagccagguuugcacccuugacuugguuuaaugcuguuauuuauuucaguuuuaacauuuuuuccuuugaucuguugaagcaguuuaaugucaucucacuuaugcccagcaauguucaagguaaaacuacagucuagguauuggacaagagagggcaagguaggcagccauuuugguagcagugagccugggcagaucccguaagagaaacuugccucugagcucaaacucacugucuaagagaggcucuaucuagagauaauaucagaaagcucuauuuuguuuguuuauuuauuuauuguuaguuuguuugucaagacaggguuucucuacguaguccuggcuguccggaaacuugcucuguagaccaggcuggcauaaacacagagaucugccugccucugcuucccaagugcuaagauuaaaagcuugcaucaccaccucccaggacauuucucucaugagauauugagauguuauugaucccauauugcuugaauaacuucauaugcuaaugugugcucugguuugcuuucuguugcuaugauaaacaccacgaccaaaaagcaauuugggaaggaaggagcuuauuucaucucaugcuuacuguccaucauccagggaagucagggcaggagcucaaggcaggaccuauaggcaggaacugaaguagaaccugugaggaaugcuguggacucuugcucaauuuuuuuuuuuuaaauagaacccaggggcuggagagauggcucagagguuaagagcacugacugcucuucuagagguccugaguucaaaucccagcaaucacaugguggcucgaaaccaucuguaaugggaauggauguccucuucuggugugucugaagacaguuacaguauacucauauaaauaaaauaaauaaauauuaaaaaaauagaacccagaacuaccugcuccagguagcaccacccacagugggcuuggcccucccgcaucaauaguuacucaagauaauuucucagagacaugcccacaggccaaucugaugaaaccaguugagguuuccucuucccagguggccucuaguuuucaucaagcugauaaacccuaagcaguacaauggcuucugucuacuaggacaagccagucucuguugggugaauaaagacuaaggcgugacuacuauaaggagcuaaagauguaacaccuacccaugucuuuaaaccuccaaaaauuaucuugugcugaaacuucccaggcgcuuccucacaguaaacuuauugguauagaaacgucucuuacccuuaaacuuuaggaagaaggagacauugauagaaucauucgcacuggcuauugugcaguguagcuacgauauuggugaacaauuacaacccugucacuguagcuuccuuauagguccuacccagaaugaaaggcauuucacacugccuggugggggggggggaucgugguaggaauuugcuuauuugggccaauguauuuccauaugcaaaaauaagaauacguuuauccagauaacaugcccuucuugcacaacauugggaagugaguuuguuuucuugaguucuauuuugaguaaguuuuggucagacuagagcccugaaaaauaugagauuacuaauccuaagcuuuugcuauucugcaguuuguguggaacauugaagugugggcguugauauuguuuggguuguuguguauuuguguuaguuuugcuuugccuucacugguuugcaaguucgaauggggugagggggaggagagcuggacaugacuuguuucuggguuggauuuuuaguuggaauguuccuauggcuuagaagacaugcuaggcaaaacugugucuccuucugacccugaggcaucaagaaacuccacuaauauuucaacaguucuuuagucucuguacagacugugucuacacagucuuauauaguauaugcuuuauauaagcugacuaacaaaauggauaaauguccacgacagggugccagagaccaacauaaccagcccccccccggggggggagggaagagagacagagacagauuuuauauauauauauauauauauauauauauauauauauauauagagagagagagagagagagagagagaaugucaaguuugacccugagagaagacauagcacauccuguugcacuagguagaagaguguagcccugauacauuacaauauguucagugggugucaggucaugacaaugcacccauuguuuugacaagaugggguccacaugugugccuguuacuuccagggauucucugaugacagucucugaaaacucuagggacaacuaacaaaucagacaggaguucguauagccucaugcagccucgcucuccuaauugguuguccuuguuugguuuugcuuuguugaaggaaccguuauagaaucugaggugaccacucagaguuuccucagucacacaggaaacuuugucuccuggugucucauuauuucuuauugcccccuauaaccucuccauguuguuccaaguugggggcacaagcuugcuacacuuagaauuacuagcaauuaaggaggugucccuuaagagaaagaugaaaacuaaaaggcuuuaaacauuuuaucucuuuccagauaacaggucugccugcuacaucuuuaaauaaaaauaaaggcuuucaagguuagcuuuggaaggagacaaaguaaagggagaaggauguucaugcagaguuccuugcuuaucuaaccuuugcagcuccuuaggcaaagagaguaauugauaauccauaaacagcuaccaaccuaucuauuccaaugucuggaaggggcaauuaauugucagcccaaugauaaaaauucgcugcccauucuucagugacugugugcuugcuuccuuugaaguggucauuaccuuuagacaggacugacuugugucagggagcugagaccucugggacagugggguucuuuuuguuucuuuauuuucauuacuauuacugucaacaucauuauugucauuauaagccagcaugaacacaugcgugcacaggcucaugggcugaguuuaucuugaauuaaagcagauucuguaaguggggaaggucugaaaacauuuucuugggagcauuuccugugccaaauguuuauuaugagcauuuacuguauuucaucuguuucaugcugagugauccauguuauguccguuuggguagaagguauagaaauccaauuuaucuuagcauaagcauugauucaccgaaagggucaaguguugaguuucaauucagucaccaugaaguaaacuaaccccguuuaccacacauucccuuccugaauugugguguuaccaguagcuucugaaacugcuagcuauauaaucuuccuuauaaucaaugguuuuagguauucugccauaguaauggaaagcugacuaacaaaauggguaaaugcauaugacagggugccagagaccaacauaccccccauagaggggagagagagacagagagggagagagagacacacacacauacacacagagacagagacagacagacagacagauagacacagagagagacacacacacacacaccacacacacacacacagacagagagagagauagagacagagacagagagagagagagaaacagaaacagacagacaggaagacagaaacaaacagacagagagaaacagacagaaagaaagagacagagacagagagagauacagacagagagacaaagagacaaagauuuacagagagacaaagacacacaucuuuuaaaaugauuuaauuaaaaaauuuuuuguaugaauauuuugcuugcauguauguauaugcaccaugugcaugccugaugaagaccagcauguuggaucaccuagaacuucgagccucuauguagguggccuuguauguuuugggaaucaaacccagguccccuggaagagcagcaaauggucuuaauuacugagcuacuucuccagcccuaagaaagggacuuuguuuuguauuuugacacaggguuucucuguguaggccuggcugucuuggaacuugcuuuguagaccaggcuggcccugaacucagaaagccaccuguuucugcauccugggagcuaggauuaaggcaugugccaccauucccagcuggagaaagggauuuucuuuuauggaccaugugaaugggucggagaacaaccugccagaguagauucucuccuaugugaguagcaaucaggaucuaauucagaugugaaccagggaucuaauuuaggacaauucaccaggccugguggcaagcaccuuuaccuaugagccacaucacaccagugcaguguccuuuccuuuuaugggguuggcaugccaacagucuucuuagcugcaccauauggaauaacuaacauagcagugcagaaauguaucucuagcuccuuccgugugacucuuggcuuugcuuucuuuugcugccagcaccgacccugagcuuuuggcuauuggucaccuugaacuuaagccaggaacuugggauccaagaggaaaugcaauccuucaauccuaaauucaucgauaauacuuuaaaaauucuuggagagguugcucagcucuagaugggggggcucuugcccuugccugugucaaucugugugguaagggagaggaaauguuauaaguaacccagcccauguggucugacagguugcucucuaccugcaguguccuccaugcuuuugcuuggaguuggagggaaaucagggguccacaauggaaggacagugugcuagacagugauuaaagaaagccugccuuauuauauaauguauaauaauauguagucuuaguauaucaagucaugucaugaucaagauaauccaaugaagcaaauguauucguagacaaggacuucaagggggaagcaguggcuaaguagcuugagcaagggcauacagguaauaggcagcaaaccuacaguucccuuuaaugucagccucugcacuauuuggucauuucuacugccuugauagguuccuuuacaaucuauauacaucauagugucagagauccauuugcacaucaggaaaucaucuucaacccuuuguucccuucuaggagaagccaccucagcaucaaaggcacuuugaaguguguacuuccuucuagaguaacaagccuaaacaaaaccaggcacuuacuggaugcuuaauaaggaugagaugacuggauucagggcucagaaugauguugggucuuuuauguuucucccugucuuucagcaaggguucccucagaggcuuucugcugguuauauccucagauagguaugauauaagaaagauaaccaguuguugacauucuaaaacuuucaaggaaaagagaucaucuuacuauguauccguacaagacaauuuuggggagggcucuaaguacguaugccuugggaauuugcccauuguguuaggcagcuuuccauuccugugacaaaguucuggaaaccaucaguuguaaggaagaaagauuuuuuuuuaacagcucacagcuucagaaagucccagccugugugccuuuggcccuguugcuuugggucugugauggggcaauaccucgcguugcucauaugugguggaggaggucauuuaccucaugggagcaaggaaacagagggaggaaagggucaggauccagagaccugacuuccucccacugggaagaaacuacugaucugucaaaaaucugucuggagaucaagucuuuaacacacaugggccuuuggaaagcauucaggauccaaccuauaacacccaccacacugacauauauucuaggaccacauagagucagggugaugguggccaaccccaggaaaggaugcuggcaguuaaaaccauuuuuuuccaccaauuucuagcaagguggaaucauuaagauacagagcuguguccauaucuuuacuucucagugucuccuggcacuuccguugcaacgcugcuugcucauugugccuucuuuucuucuccacagaagcugucaaugccugcagaauuuggcccuucauuuugagaccccagcaucuagcauagugcuugaccuacagcagaaguucaauaaauaucuacugaaugaaugcuauauacuguuaugguuuacauaguuuacaaugcuaugguuaaaaauauaagcauucuccaaaggucuacuaccuagcguguaccacaauaaaaacuguucaaaagcucaaaaccugcuguauaauuuaucaguaaauuacaaguaccucgccaaaaaauuuuuaugugugcaccucauuucaaaucagacaucaugaaaauuuaugugccacauguuauaagccuugcacucagcugggugcagaggaggugagggaggcugcaggaaggaggguggaggcgcagccuauguggagccucugaucuugucgggaggcaagagaaccauggcaauuagggagccucuccaggacaacaugcaauaaguuucuccaucugagcuccggugcuccgugggggaaaucuagggucucuuuagguucccaggaggagcuuggggucauauucaagacaggguuagaggagugacaaaaagaacuggauaaaaaaaugacacgcagaaagguuaaagacuucagaugacucagguuggagaagagaaggcugaaaggaaacugaaucauuuucuucaagacaaagaagggcucuggcugggggaugauggccagcuguccuccguugccucugcaugcggagcaaggggaacugggcuuagaccggaggcagggcuaagauuagagagcaggaagaacuuggcagugaaggauguuguauaaccuacuuuuugagacaacuugaggacugaagagacucccacacuccuggucugggcccaguggaccaguacgcaggucugaucuggcuggcuggcugcaaacggaggaggugguccuguggcugccucucuccguguccucgauuucccguucccaaauuuuggagcugguaaggcagcaccucccccacccaccacgcgcugcaccaguguuccugggcuggguaauaaugccugucauuuccuuucccgggggaguggggcugcaaccgcccugacagccccgagggauugaaggcaacuaaaaauagugcauuaaauauaaucuguugaggggcacauuugcauugcuuuucuuuacccccgcuuaucucuucauccuuucuggugugccagguccuaggucuagcucugggcauugagaaacagguucuggguaccagcuguucucacugagugauggaaggauuggcaauauucgagaucuggggguagucauccaucaaaaauacagcugaggguucucaggggguacuccuggcccuccucccuugggccucuggguccuuuggaacccuuccgugcuggaagaggaguuggaagugggggagguaguguugacaaggagagccagccagggcuuuguucucccaucagccacuuccgucugcuacacaaucucucugagguuaaauauuaauuaagaacagaaugacagugagaacugaacagugucacuuucugucccaacauaaaugcuaauuuccuuacagguauaaaguaauucuggggugggauuggcagcccagagaauagcuggagagggaaaggaagcaggagauggguggugguagugguggugauggggucauccucagaacugguaagagggucacgagacagggaaggucugggugcuggcauuugagaggaaggccagggcaggguuuggcuggucacaggcuccuguguaguccuaggcugucuccauucuaacaacagugaucacagaagucaggauagcacuggcuccuuucacuucuauaagaaagggacuuuuuuuuuucucuauacaaagcuccuacgauugaaaaaaguaauuauaacauacacccaggcuuagugccccaggccuauaaucccaacuacuugagagacugggacagugggguuauauaaauucauggucaccuugauuagcucugugagauucuguaugaaaaugaaaagucaaaaaagggcuguggauauagcucaggguuaaaguacuugcuuagccugcaagaggcccuagguuaauuauauaacaaaguccacaaacaacaacagaauaauuaacaaaguaacaagaaugcaaucaaauggucacuacuugcgacugugucucuuuuuugcaguagaucagagaccccaggguacccaauaggguuccaugacuaagagacuaucuuggcaauguccagagcaaguuccuguaacccaugugcucuggaguacggugaggcucugaaccugaacuuuaugcaucacuuugauggcuuaucagacucuggaaacugcuuguguguacauaggcagauaauuggagacagaguugugaguuuuaguggaacuggcagaucuccaguguuauucuuagaaugugauacugaucaguagagucccuuuaugcuuaagaugauugcuacaguucuagcugaaugucuguacccuaggcaggaagaggaaaaagagagggggucagagaagcagguaaaaugaguuaaugaauuucccuaguaacucacguccaacguacugucucuagaaaccugcgagagggacuggaaaauuuaaucuucuagcugacuacauguagcuccacauaaagccaguguuuuuguuagugagcaaagaggaacgaaugguagauagccaggaguuucugcuauacugucucagaagggacaagaacgucugauccuggggagagagacaguaggaagaucccaagucuaaauccccagacaaagcggauggacgggaggccccugaccuuggauggcugcuuccguuugaguuugaucaaccuucccuaaacucacaauuggacuucugaagcucguuguccuaauggaggcugguggagcuagugcuucaccagggcucaguuauuuggaaggaugcucgucuuacucagcucugagcucuggagacuacagugugaaccuggcagggcagauguacccacccaugcaaucguggcauggcuguuauggagcagaaucgacugccuuuuuguaaaaacauagauuugaggccuacuccaugggggugaacucauauaccuuuuacuuuaauucuguuuaaaaguguggggcugaggaggucagagccuuagcaaccuauuauuguuguuuugcuaaucagacaugacagucaaaucacuuuucaaauauuuuugcuuauaccuaaaagcuaguaccgaagucacuuuggcuagagagaagcuucugucugaaguaacaaugguuaagguaaaugcucaugacugauugaaguccugagaauaaaugacuauugaaugcucagcccuaagugggggucuauauaaccccaauuuuuaagacucagggagcauccugaggggaauggaaaguaagagcuagagagucugagggagcaagcacugcaaaacacuguccucaggacaugacauaaucaacuguacucacgaacucacagcagcuguccaagauggaauccaucaacauuccaucauggauaugugagaggugcaugaggcccuacuuccaacugaggagccuuaaauagaugcuaagggaggagaagucguuuucugcauugguguagccauuaguaaauugcccauacuuuaauaaauaacuccucauccaugcucaugacagcgggccuaauuaaucucagaggguuauacacaaaaaggaacaacaaaaggccaugaagauaggaggggggcucguugggaagaagagggguucagagggugugggugaaggaugagcaaguaucaugggagcuaggaaauuauuagaauauauuauacauguaugaaaaucucaaauaauaguggugaugcuaagaauaagacuaaaagaugugcuuguuacacugaggagcauaccuuggugguggggguaggguggggguugcaguguauaucuaggaaagacuuuguuuggucccugguaauuaucaucaacuuuguuccccacaucuggaacagacgcacaaagaaagagaagacauguuucccucuugagaaagcuacaacugggaaagaugugggaggguuaaguuggaagucugucugauuaggaccauaggauaggguagacuugguucagccuauuucuccuaggucuuugcaccuuggcacagcuggucugucugacuccagugaacaucuguuguggacucucaacccuuccccugggguauucucuaagaaacuauccuuuauuacccuucccuaccaucucgacccuggaccuauccuaagagccuucuugcaagucucugagagucucaucuucauuaucauauucaugguuuacaaucuuuuccccaacagggauaaggcucucuagugguagagaaaguuucacggcauacacuuccuaguggggcuuaguaugugcuugguggggauggacagagguuuucuuuuuuuuuuuuccuucuuuuuuaguauuagccauuucucacauaauauauucugauuacaguuacccaucccucugcuccucccaggcucuccccaccccucuuuccauccagauccacuccuuuccugucucucauuugaagagaacaggcuucuaagagauaauauuaaaauauaacucaauaaaguauaauaagauaaaaacuauugcauugaaguuuaaaggguauuaaagaacgccuacuaugagcaagacacuacaaaagcaagaaaagagcuagcauuaacaaugacuuaggcaucagcuucuagaagcacagagauagaaggcuaaauucuugaucucgcggaaagguagugguaaugagaggcuggaauuuuuagaacagaaggcaguguacgaagguaauauggguuccugugaaggcuugcagaaaaagucacacauguaucugagagaugaccugggagagaaugaaccagggcagaggaaagagcuguagcaugucuggacagcaaguguuugggaucucaaaguguuucuguuugguugaaguuuuaccaagaggaaaguguugcugugggaguuagauagguuuuaaguguuuugaccucugcuuuuccuggaagauaacuguuaucauguucccauguggcuggaaagagcuggugaaggugucagaacuggucuguggugcuguuagggguaaaaagaggaggcgagaaucuggcuagauugagaucuggaguggcuauugcuguggucuguguauuuaggaagaccuugggaagggggguucacguuagguucucuucucacccuuucuuuuucuguaucucuuaaaauacccuguguucuugcagcaguguggcugcuaaucuaaaauaaaaacagcaggaaauguaaauggucagguucuccuagcaacaggagccagcccacucagggcguguggagcagaucaaaacuguccugaggcugagaugaggguggcuaggguaaggagugagucuucucuuccagauggccuccucuaacuucugggagggacugguuaguggacagacaccugcugugcagaagaaacccccuguaagcuggguuggcagagcaucaaguguggaaagaaagugcagggcaaaaaacaggggucagagaaaaauacucuggugugacaccccucccuagcaggguggcugcagcugcaucucucagagaacuugguguacgagggcuaacucagugaguggcuagaugguugaugggaagggccuuggauggcuuauguggucccuugcaaucaacccacggagcguagucauuuccaaagaaugaaagaugauauaagguaguuuagguucauaaggauaggaaacugacugcaaagacucucuaaggcaucugguuuaacccccugcugugaacgaagaaacugaggucaagagagguaagugaauuucccaggacacaaaaguaauuaguagcggaggaggaauuggaaaccaggguuccaggcugagacauuucaucuuaaguagaagcugcugacaucccuccucugcgcacagcuugcuaauuagaagccaugauaaccuuguugggccccggggaggaaaaacuucagucaucuugugcacuuucaaaaaggcuaaaggcauugagagacaaacuggaggugggcacaaacccagagaggugccauguagaccaugaaagugacaaagguguuggcugggaguagaaacaaggcuaccugugaugauucuuggcaugcuuuggggaauggggguggggcaggcuggaggggucucuccuggagaaaggggagaaagaucacuucuuugucaggacacugaagaaggugacugugacuugcucaagaggacugacccaaguguaaaugaucuugagagagaaccuugggaaauauucuggcuccucggcucccggagaaguccacguacccuagaugguguggaucccuauuacauacgcagucucuuccuuacucacacccuggcuugcuucugcaagacuccuacggcaucucaccuagaaaacaccggggagaaaaggguuugguucccgcugaauacuggagacuuggguacaugguugcuccuacagguuccagggguuguagguaggguagaugaaacaaacaccucuggagaacugguguauccagagauugauuucagaccaagcuguacuggccuacguaugaucucucuguagcuaucugcaugcuucacuucgccaucgacauccccacagcaccuaagaguaucuucaguucuuguuuuccuaugcugccucacccuuccuggccaaaacaccaaguggagauaaucaguugauuauuagaaugaacauggaauuuuagugucuguaguuugacucaaauuuuaguuuaucagcuaugugaccuuagaaaacuucccuugcuucugaauauugacuucuucaacuguaaaaaugggagcaguaauguuuguuucaacaaucuauaugaaaaccuaguguagccagacauacaaucggcacucaguaaguauugcucucuacacuuuguacuugugguugcaguuugcucagagaccaggugggagauccaacugcuauugccaaggcagggaaugcuauuuuucagguaucccaagauggagcugugauuacaauucuuucucacacaaaauggcuuuucuuuuauaacugaugagcucagcuuugaugguugaucugggaaugucauuucucugucuuguuuuucaucaauguauccuggccgcagcaagcacaccauagacauuugauuucuuguuuuuguguaaaaagauacgucaaguuauugauagucaacuaacaaaaaauaucuaaaacagugaguggauguuuggacugcuucagaguucuuuucuuuaaggcuagcucuaggaagacagacuaucaagcugcaacacuacucuggacaucuccuucagucaaucaagaccauagacugcaaggguuguuauaauuagauuuugacaggguaggaguguguauguguaugugugugugcauguguguguguuugugugugcaugcuuguguguguaugcauguaugcauguuagugcauucgugcauguguguaugaauauacgugcaugugucuguauaugcaugugugugugugcaagugcaugcauguauauaugugugacugugugugacuguguguccuccagcagcacagauggacacauuuuacugaaguauuuuccaaggaaauuguucuuuucucuuaguuaugacuccauacuccuuccaccucuauuuuugccuaacucugucucuccuucuuguacauuugaauuuugauccugccauuuuaacccuaguuucuaucacugugcacaguacugguccauuggacugcuuguacauuguuuccuuguuguuggaguuguaaaaaucaaugucccaucgauaagaugauagcuccugcaucuaaaguggcucagcauuggaccucugggaaauuccagagacaaccuaccaaugacaugacucagcaagugacaucuccagagagucacagcccaccccuccugagaagugugcacccaccgagaucaccacaacuucuggagucucaaaagcacuagaguuuagauucuuuuuuguuuaccuucugcacaaacacauccacucaugcaacagggauuauacuuccagacuuccacagugaaaaauaagguguuugccuuuuccuuucugaaauaaagguucuggcuccaggaaugaagcugcccgauaucauuaucugugaaacagguggaaaguaagaaaaucauauuucucuucauggcugggaaaucaggucaggcucugccaagguauagcaaacucccucgggcuguagagagcauguucugguuucugcccagaaaaacuauagaggaaaacuguggcugccuacuacugaguaucggggggaaagcagagauauuuuuaacauacggaauaucagugaacagaaugcuaaggaacuagaaaacuuauuccaauaaauaugaagcauaugcucugcucaaagcaaacccagcuuuugcuauauacaaauuucacaaaggaaaaauagguuggaaauugcauugcugcuggaaagugggcuacuauaccacugacugcaggagaccuggaaaacagagcgagaaggguggcuagugggucaugucucaggagccucagcuaucuggucguguggguccggguuaguuuugggcccucuggcacagaagacacccacuccaacacccccguuugugaugacaggggacucaagcaaccaucagaaugucaucucuagcuucucuauucugaauagacaggcaugcaaaaugccugucuugguggcagagaugccuagguuuagggggaaaagaaagaaaggaagaaaauaaaaaaaccaaaacaaaacaugacacuuuggauuucaugugacagguucuuccucuugcaacuaaggaaggcaauuuauauucaucucauuagcaaggcucuaguaauugggggauauuaauuuuauugcuaaaccugacaaauauuuuacucucuccuguagaggguaauugcauccccaacaggcucuccuuugugcugccagaugggaaggauguguguuugccauuuucauuaauacaauuaguaccucagcaucucgucugcucucucccuagcuccacacugccuggggcccggaggagggagaguaggaggaaggcguggaggaggccagccugccuaggacuuaggugcuggggaggcugugcccagggguuggcagagagcugcugagaaacgcuguugagagccagcuagcacagcgccuggaggcugccaagcgcuaaaccacaacaacaacaucaccgcugccgccaccacugacaacugugugguuagggagcaacaaaucauuaugcugccuagaacucccuggggcgucaucaugaucccagaagggugugcaugcacaugugggcgccucugcuacccuggcuccgggacugcuccugcugcagcugcccccugcuugugcuccuccgcacuccauucugucuacgcagcauuucugccagaagagcggggagcagcuucagaaggaguguagauaccugcucucucuaacuugggaaaugguguaaagaccacgcgauucuggccugguucucuacauuugcacccaggucaaacuccuugcuuucccaugccaagggcuacuaacuuuaccgaaguuuuauuguguucguuguuccucagccaccguagguucagcuggucagaaucacuaugcauuucuugaagagauagacaugauggcugaagccacaggguucaugcacuuaauuaagccuguaugucaacucacaggaugccaaaugaaaaggacagugucauauguagaucaguccaccuucaaguguuggucagggguguccugaagacccucaaaauaguccaagcuauuguuauuguuuuuguuuagccacccgagcaaugugguaagaccucgccacugaggacaccacacaauauggcuacaggacaaugagaaaucaaguugauacugaccaggaaauuuucuuccuaucagcuaguaccugaagcaggcuguuggaguacaaaagucaucagaagucuuacccaauugugaauuauaacagugacaagcauggcgaaauaugcucaugagugcagcugugugugaacaccaacugacuggauuucaggccugcuuuucaggagaaaugugugcccagcauuguaaaucuguaugggagccagggguaaaacuacuucuauuauuuuguugaacgaacauaguauuaaaccacgcucucuauguacaucucuaugccacuagauugacuagugcagcucaaauauuaucagggaaguuugugcaaugaauaccucuuagugcaaaaaucuguaacuguuugaaauguagagaguaauggaguggucagucacagaugagaucucuaacuccacccuguccuccuaaaguccagggaccguggugaaagaggaggcaggaagauuacaggaaguaauagagugaaauggugccuuguggacaugaugggacugcuacacucaugaacucauagcugcuguagacaccuauauaagacccauucaaaaaucaagccagucaacccuccagcacaggugggacuaacgaccgacaaaguucucuuggcugagaagcuauugauaguugauggcuucuggcugagagacaguacauuuugcuaagugcuguggucucugguaggccaacuauggaccagggugugguccuacacccaagacuauaugaggagcacaaauugcaaucaaugcucuacuaaaaaaaccagaagacacucgggaggcaggagguagggggagugucggugaggagaggcaucaaggaaaagauggauuugauggaaauguaucacaugcauguaugaaagucucaaaaguuuucuaaaauuuuuuuuaaaauaaaaaaaagauuuacuuuaaaaaaccaggcaaguggggaucgagggauagcucagugguuaagagcaugugcugaucuugcagagggccucaguuggaucccaaggacccacaugaugguucccaaccaucuguaacuccaguuucaguguaugcaacucaguugucugccuuccucgggcacugcgcacaugugguacaaaugcauacauacagggaaacacucauuuacacacacacauacacacacacaauuuaaaaccagggaaauaaaaacaaaacaaaacaaaacaaaacaaaacaaaacgcauguuaacaacacauuggcuacuagucuucccaaggcuauaacagacacacuggagacuguuggcauaaaugacaaauggggauuguuguugucguuguuguguuuuuuuuguuuguuuuuguuuuguuuuaaaugacaaauguuuauguuuccuaguucuggagguuaaaagaucaagaucuaggcgcuggcuaguccagcaucccuagggagggcugucucccuggucuacagacagcagucuucucuguguacccuccccuggugaggggagauagauggaagccagcucuauuugcuuuuuagacaacgucucauaaaacgcacacuggcuugaaauucacuaugcagcccagguuggccuaaaacuugagaaugaucguacugcuucugcuuccuaguguugggacuacaagcaugggccaccaggccaaggucucugaucucaccacaagggaaucacccucagggaugaacugccucuaagaccccaucuuaaaauaacaucucauuaaagaauaggguucaguauggguuccaucuguucacaguugucagggaggaugugugugaauggugccauuugcuuuuaaccuggccaggcuauagguaauagggcaccugccuugugcuuucuuuggccucucagugcugauuuggaaaccaauaaaaaagcauuucaggggcccuggagaagugacuccaugguuaagagaacuggcugcucuuccagagcacugagguuugauucucagaacccagacacugauucacaacaauccaugacucuaguuccaggggauaugucugauacccucuccuggccucgguggacacacauauauucacacacacacacauuuacaugaaaugaauaaauaaacaaauaaguaaauauuaaaagaaaaagauucucagaagccagcucuagacagcaaaguucugcuccuacaaaauaaggguuucagggaacuguaguuguuuuggaauggaaaauauuguuacaaaauauuuuuguuuuaaaucacaaauguugaguguucaagaucaauguuuauacugauuuaaacauacuaugucugcauguguugaaaaauuacaugauuucccauaaauauguacaauuuuauguuucuagggauaauuaaaaaugaauuaaauagcuggacaaugugccucacacuuaaaauugagagacuugcuaugaguucaagguuagccugugcuauauacagugagaccaugucucgaaaaaccaaaacggguuuuuaaaacauacauuaaaauaaaugauccucagauacaacauauaaaaugugucacagccaccacacuaugcaaauguuucaccaggggcauuaaguucguuuucuucauuucagacuauugucugaugucauuuuaggcacugauuuccauccagugugugauuguauacgucuuccuuuacuaagaaucuuucuuucacuacagcugugcaaaaacaaccauugcagagacccauggaagcgacugcccuaccugccuuguucucugacuaccuggacuugucgaccacacuuaaggguggcaagagacaguuccuagaucuuuagcaaacaaauucaauauucugggccccacuugaaacugacagucccggaggacuuuccagagcaaagggggaaagcaauagagucacauggggcacaccacauggcucccagagucugcagagacugcccacucaccuggauuucacuucuugucuuuugauagcugggaccacaugucccccuuuaucuauccacagcaaaguaaacuuuagucagaguggacaguuuuauuagagcuuaaagcggagacuacagggcaggcaagcaaucccagcagcugccuguaggaggagagaaggaagaagaagaagaaggaggaggaggaggaggaggaggaggaggaggaggaggaggaggaggaggaggaggaggagaagaaguagaagaagaagaaggaggaggaggaggaggaggaggaggagaaggagaagagaaggaggaggagaaggagaaggagaaggagaaggagaaggagaaggagaaggagaaggagaaggagaaggagaaggagaaggccuauguaguuugagugaagucagcaugaaggucagauccaugguggacaaacagccauauagugagaaguacuuuagaaaauguaucaugacaugaaccuuuuggaucuccagggauauggcaauucuuugaguguucuaucacauuacuaauauauaaagugcuauacuauacacaaaguucuauagcauuuaaaccaggacauugcuauacuaucaccauaggcugagguagcauacuuuucuuugcuacaagagguuagauugcuucugacuaucuuugaugauaggagugguaggggaaagauuuuguuaagcccauuucuacacaccagcuuccaagggcuucucuguuuucacuucacaaaguuacuggauccagaaucagucaugaaugauggcaguagugagugcaugauaauguacagucauucuacuaaagucuguggaggcuaaacgagccacuaaggaaaccagucagggaugagguuggaauuacaacucuguguauagucaucguuaaguagaaucaagucuguaaucccucaggacgguggcuuugcuuuuggguuauuaagggagauuggguuggguuagccugauucuaggaguuucuguuugcugcuugguacccucuucuggccauaguagaucccacucuaugaaucagggaaucucuacaggaguuuccuuguuaugaaacaucgacucagaauacacauucugaggccagaaaucacaaaaucccacugaucuuagaccaaaacuccauuuuggaccuguuuuuguugguuuauuuguuuuguuuugccuuuuuuuuuuuuuuuuuuuuuuuugacaagguuucucuguguacucuuaccuauccuggaacucacacuguagaccacgguggcccugaacucagagaucuaccugccucugccucccgagugcugggauuaaaggugugcaccaccaugccugguuuagacuuguuuuuaauaaggauacuuugauuagucagccaagauggcauuuuagauuuuaucauuagagucaguucaauuucuuucuuuuuuuuucuccuuuuacugaaaaaaaaagauuauuuucucauauaauauuuccugauuaugguuuguccucucucuacuccucccaguucugucccaguuucccuauccaaauccacucccuuucugucucuaauuaguaaacaaacagguuucuaagggauaauaauaaaauaaaauauaguaggauaaaacgaaaccaacacauaggaauugaauaaacaaacaaagaauccaaagauaagucaaaagaagcagagauguuugcaaguucaggaaacccauaaaaacaccaaacuggaagaccacaaaggaccugguacagaccagugcaggcccuccacgugccaacucagccucuaugauggcgaaauaucucauuuagggcggaauacucuucagucccucacucuaugcacugugucuggcugugggucuccauauuuguucucacuugcugcaggaggaagcuucucugaugauggcugaucaaggcccugaucugugagaauagcagaaugucauuagaggucauuuguucauuuguuuuguuuuagaacagcaguaguaugugguuugacccuaggaccauggguuaucuagucucauguucuuggccacccaagcaguguuggauauggauucuaucauguagagugggccuuaagucaaaucagagauugguugguuaugccugcaagcuuugugcuaccuuuguucucguauaucugacaggccaggcaucacuguagauugaaguguuugugguuggguugguguucauguuucucuuuugguagcauguagaguaacauccugcaccaaagaugcuagaaugaauacaggcucuauguaggcacuaguuugacuucaccauuuucaaugaguuguguagauguuucuuuaucaaugggggcuagcuaucaguuuauggagagcaaccuauagucuugguaacaacagcuuggguuguuuagagauuaucauggcaccccucuggccagaaacucaauuagagguaaugcaguccugggacuggaagcuucauuuggugacaagagauggccaguugggguucugucucuccauuggugauuucauuuagaucacuuuuauauuuguauauauuuuaagaagcuacuguauuagguuuuuuuguuuuuugagacaggguuucucuguauagcccaggcuguccugaaguucacuuuguagaccaggcuggccucaaacucagaaaugcaccugccucugccucccgagugcugggauuaaaggcuugcaccaccacgcccggccuguauuagguuuugauacuauccuucaaauggcuguuauuucuagcugucucucucuauauuucuuuccucauccuuccuuuucauucuucauuuggucuucuugcuccagcccguccauccauucguaacuauuuucuuuucugaaugagauuaucugucauucuaguccuuuacucuuugccuaaccuuugcgguucuauugguuguaguggaucauugacuuaacagcuaauauccuuauauaagugaguacauacuauauucguuuuucugagucugggauaucucacucaggaugauuuuuucugguucuaucauuuaccagugaauuuuaugauuucauuucuuagugucugaacaaugcuccaugcauaaaugugccacauuuucuuuaucaguucuucuguugagggacagccagguugcuuccaguuucuggcuauuaugaauaggacaguagugaacaugauuaagcaagugucucugugguaggaugaagcauccuuuagguguaugcccaagagugguauagcuggaucuugagguagauagauucucaucuuccugaagaaccacaacaccgacuuccauacuggcugcacaacuuuucacucucaccagcaaugaaugcguacuccccuuacuccacauccucagaagcgugaacugucaucucacaguaguuuuaauuugcauuuucugggugccuaagcaugcggaacacuucuuucaguguuucucagucacuugcaauucccguuuugagaauuauguuuagaucuguuuuguaccccacuugaaaguuggguuacuugauuucuggauaucuguuuuuugagaucuuuauauauuuuggauauuagcccucuauugaauuuguaguugguaaaaaccuuucuccuuucuguagguugcuacuuugucugagugacaguguccuuugccuuacagaagauuuucaguuucaugaagucccauuuauuaacugcugaucuuggugccuguguugacaguguuuuauucaaaaagucuuuuccagaaccaauaaugaguucaagguucucucucucucucucucucucucucucucucucucucucucucucucucucucucucucucucucucuuucucuccuucugguuuuucaagacaguguuucuuuguguagccuuggcuguccuggaacuagcucuguagaccaggcuggucucaaacucacagagaucccauugccucugccuuucaaauacugggacuaaaggcauggaccaccguugccuggauccucacugucucuuuuaucagguucagcgcaucugguuuuauguugaggucuuuggucuauuuagugcuaguuuugugccgagugguaaguguggaacuauuugcauucuucuauaugcagccaccuagcuugcccagaaccauucauagacgauguugucuuucuuucuaguaucuauuucugacuuaacagguguguggacuuaugucugggucuucaguuugaguccauugaucaccuugucuauuuuuguuccacugccauacuguuuuuauuauuauaguuccgcacuacagcuugaaauuggggguggugauaauuucagcaguucuauuauuauuuagaauuguuuuaacuauuuugguuguguguguguguguucccauaugaaggugaaauuuguccuuucaagaucugugaagaauuguauuggaacuuugauggggauuuacugaaucuguagauuacuuuugggaagauggccauuuuuacuaugcuaauccuaccacuccaugaucaugggaggucuuuccaucuugugauaucuucuuuaauaucuuuccuuagugacuugaaguuuuuaaucauucaagacuuucacuugcuuggcuagaguuacacugaaaacaccuuacauuauuugaggcuauucuggaaggcuuugcugcccugguuucuuucuuaguccauuugucauuuguauauaggagagccacugauuuuugugaguuaauuuuguauccaguuacuuuccgaaaguguuuaucagcuguaggagcuuccauaauuucuuaaugccuuugguccucugagaagaguauggccaagcagcuauggaucaaaacacauauagcauaucaagcuguccucuagcauuuuaacuacuuauucaugucugcuauguuccaaggaacuucuguugucucagcuuugcuaccuguagcuuacuuuuggagagcuuagcugacuccgugcuauuuucucggaucauaucagcaaaccccaauuucccauauugcaucuaccucagcaccuuccucuuaaucaaaucuuguuauauucuucuuggccuaacaaccauaaaaucccauugaauacauggucccagacuccugauuuaagacuuugaacuucugcuacucuuuugguaaaaauucuaucuccuuuuaggccuagauuuuacacuuuaucaucugaauuguguuggcauuugauucuccuugugggucuggaaacaacugaagaccauggaagcagauauuuagaaaaaucacauuuuguuaaguggcaccuuccaaggucaugguccuugaaauguuuuaauuuacugcaagugagcagcuacaacccuccuuuuggaggguaaggacaguuucagcucagauucuggucucacuuguaucuguuuaucucuuuccaacauuucaaggucucauuacuuuuccauuagcacaauuagcuuauugugggagacugaagcuggagauuuuaagguauuuccccucagugguggggaucuaauccagaaccuucuguaugcuagucaagugccugaucacuucgcugucauacuguuagcagaguuauuaggcucaagucugagccugucagaucuuauaaauaaaucaggcuuuguccucuguccucaauaggucaauuaagcaaacaagaacuagagaaacacagaaaaaggagacauauauaauuuauacauggagaagagagauauagaaggcuggcagcccuccaagucugucuuuagaguccuggcaugagguuuagguauaaguaguugagccaagguguggauagcuaaguaguuucagccacaguaggucugaacugaaagcuauuuccauucuuuuuucuuuuuuuccuuuucuuucucuuuucuuuucuuucuuuccuucuuucucucucccucucucccucccucccucccccgccccccucucucuuuuuugguguuuuugagacaggguuucucuguauagcccuggcuguccuggaacucacuuguagaccaggcuggccuugaacucagaaaucugccugccucugccucccaagugcccggcuagcuauuuccauucuuggugacaauuucuuccucuggcaugagaugccugggaaaacugcaauuuuucagggaccauugcuuuuguagucugagagucaaaacagcggacacaagugucucuuuagaacauucuuucuguuagacugauuauacuaccagcuuuccagauuucagugcuuaauuaggauuuuaacccugcaaccauuaaaagaauuuuuagucuugguccuuauucaugucaguccagugaccaaaggagacaggcucuguuagagaugccauagagacuucugauucucaucagauuucgaguugaauauuuaaggcacuugauauauuuuuccucuuguuuacuguccuaagaguauuccgcagccauccucugauuacagucuuuagaaucauuauuguuaccauggcaacuaagugccacagucaguuucuaucuguugcccuccaccugaauccacuccaugcugccaccagugauagguugccucuguuauuucgcugaauaccuugaguugccagcguucuacuuucuccuaaaggggagggugguugugugcuucucaacuacaugagagcaacaaaauaucagacuacuauuuugggaguguguuuucuugagccccuccugguaccuauucuugcaucuaucugcagccaagaaggcaacauauggcacacucaaauggagguaauugagaugauuuaauaaaggaaauauuuauaaagacauaagcaggggugucagguugaguaaugggcuuuauuuuuuuaaagauuuauuuuauguauauaggugcuuugcugguauguauguauguauguauguauguaaguguauguguauguguauguguauguguauguguaugugccugcugcccuuggaggccagaagaagauaccauauuccauggaacaggaauuauagacagcuauaagccucuacgugggaaauaaaucuaggucuacuucaagaacaguaaguggccuuaauuacuaagccaucucucuaaucccagcuuaauugaaaaacauuuuuauguuucauuuuuauuucugugcaaauauguguguguguguguguguguguauguauguauguuauguauguauguauguaugucuauguacaagcgugagagagugccuguggaggccagaaaagaugauuguaagcuaccugauguagaugcugggaaccgaacugguucucuagaagagcaagcucuacuguugagccaucucucuccggccucagggaaauggacuuuaaaucuucagcuuuaucugugugcaggcccuuucauaucuacaguggaugggcccuaggacuuguugaggccaauggcaagggggaaugugagaccacgcuguuucuaauuuuaagccuaagagaugccauaggcaaauaauuccuguucaaauuugaaggcaacuuugacugacuucuauucgaauccuuguuucucagcuugugguacuacucuaggaggcuguggaauccuggaaucccagagauccaaguuggugagguagguuaguaggggcaggccucugaagauuacagacagauaccugagccugacugcucugcugccuggucugccacgaaaugagcggccugggacgcacaaucccacugccgugaacucuaccaugcuuucucugcucuggaacacuggagucugaaacugugagccaaaaugacccuuccacugaguaagguggucacagcagugaggaaguaaacuaacguagucccugcuuuaugaugguuuggcuuacagauuuucagcuguguaugaugguaugaaagggacacagauucagaagaaauuccuguuuucccaggcuagcugugugugauaaucauaucaucauaaaaauacagcaguuggcugcagcuccugguagggugaucagcaacugagucacuguaguguacuguguuguauguauguauguauguauguauguauguauuuauuuauuuauugacauguagcccuggcuguccuggaacuagcucuuuagaucagacuggucacuguaguguacuguguuguauuuauuuauuuauuuauuuauuuauuuauuuauuuauugacauguagcccuggcuguccuggaacuagcucuuuagaucagacuggucacuguaguguacuguguuguauuuauuuauuuauuuauuuauuuauugauugauugauugacauguagcccuggcuguccuggaacuagcucuuuagaucagacuggccuacaucuuacagagauccuccugccucugcuuccagaguacugggauuaaaagcgugcacuaucaccacucgauugcauuuuaauauuuuuauaauaauagcaauucacuaaguugugugagauauuuaaccuuugauugcauugcaggcuuuauguugauuauuuugaccaaccuugggcuaauaagaauguucuaagcacguuuaagauugaccuaugauguuuacuagacuagaguuauccaggucuuuccacuuaugguacuuucaacuuugaugguccuauuggauguaagccauuuuaagugaaggaacaucuguacucuuguuuguacuuaugagccucugaugcagccauuagagaaaaauggcugauaagaaagaugaaaaacauuggaagaguagcuguaaucacacauuguguacaaugcgaagcacuguuguucuagaagcuaaagcuugaaguaaugaugucuagcugagcucauccugacucaagcaagcucucguggaccuggaccuggagauuauagaaauauacaguagcuuugcagaguuagugucacaguaaccugaugcuccagaguaaacaaagggauugggacacaugguacagacugagcuuaaaggauggagaggaagaagugacuaagacauagggaaaguagcugcaggaaaggaugcuugguagagcuguggucuuugguaguggaugcaggaauccauggaaaccaaagugguagccaagaggaauagccagcaucaccuugcuauccccugcuuuccaaggaugccauuagaacagcucacuuucucauggccacugaagcaggaugaaggcuuggaagagaaaauagaaaauauucgacacaugucacauuuuuaaaaagucucugcuuugcuuucgugguugugaugguuugguggggaacgggauucuuggcuugagauaauuccccauagaacugugacgguguuuccagugcacuagugagagguuggcagugcuucggcauucuuaaccuuugugugcgugugaaccauuaauuucuuuccaucccugaguacgaguaggauuuuucuuuuugccuugaucacaucucacuaauuuauagcaugcuucuugaaguggaucugcuuuuaucuaucauucuagauaaguuauagaauauuuuaguucugcaacuauuucuugaauuauucauaauuuuaagauaguaauuuaaaaacuauacuccuuuuuguauuuguguuaaauauagcaugugcauuccaugauauauguguggaggucaaagaacaacacuugagagucaguucuucuacuauauggguuacagggauagaacucaaguugucagguuugguggcaagugccuuuacccacugagccaucucuccagaccuucauaaauuauccccuucuguuucucuguucuuuuaaaaaauuguuauuguuaaaaacuuaaugauuugcuuuuauuaaauguguaugugcaugcgcacgcguguguauguguguguguguguguguguguguguguaugguguguucuugagugcagguacccauggaagccagaacuguuggauccccugcagcuggagugacagguggugaugaggcaccugauauggguguugagaacugaacuaggauccccuggaagagcagcaggucacuccuggccaugaaaccaacucucagcucucguucuuuuuaaauuuuuuacagauuuuucucuucuccuuuuuuucuucccauucccccuuacgucuuccucuuucuccuuucucucuguuggaaauagggucuuggguuagccagucuaaugugaaacuucuguggucacgugauccucugaggacacuuuuucugagccuguguccugagcguacacugggaaaaguguucaagaauagagccagcaaaggagggaaguaaagaaggaugguaccuugguucaagagaggugccagccugcuuggcccacagaagcugugugaaaaccacagagaaggagccagagcuguuggauccucugaguucauggcauaagaggugacaagcaagaaaaagaaagaagaaaaaagaaaaagaagaagaaaaaaagaggaaagaagaagaggagaaggaacaggaggaacaacagcaucaucaaaacaacaacacccucccccacccuuggauuguaaauauaacaacccccccccaucuacccuaacauaucuuauaguccuugguugcuuaguaguuauuuuagucaacagugcagaaccagaaagccaucuggaugauggucuugaucaugcgaauuucuaacugauuuguugguguauuugccaagaucuccugauaucacuuagccuuaggacagcuuuucaggaaagcacuuuguaauauuaaguuuuuacuuauguauauguaugagagugugugccuguguguguguguauguguaugugccuaucaguaccuguaggguuuaguaaagggaauugcaucuccuggagcuguaauuacgggugguuguuagucaccuaauauaggugcugggaaccaaacacuggcccucuacaagaagaguaaaugaaugcccgucuaccccugugccaucucuccagccccagugacacugcuuuuuccucuggggaagaaagauguugggaagccuuuguacucaaaauguaacauucuggguuuggaggauagaaugaagauggcccccauaagcucauagggaguggcauuauuugagaagauuaggacaugagcccuuguuggaaguagguguggccuuguuggaggaacuaugucacgggguguaggccaagccagauccagugucacucucucuuccugaugccugccaauccagauguaggacucgcagcuaccucucuaguaccauaucugccugcaugcuacaaugcuucugacuaugauggcaguggacuaagccucugaacugccagccagcccccaacuaaauacuuuccuuuauaagagcugcgcuggggcuggugagauggcucaguggguaagagcacccgacugcucuuccgaagguccagaguucaaaucccagcaaccacaugguggcucacaaccaucuguaacaagaucugaugcccucuucuggagugucugaagauagcugcaguguacuuacauauaauaaauaaauaaaucuuuaaaaaaaaaaaaaaagagcugcgcuggucauggugucucuucacaacaaugagacccuggguuuggcauuuccauccuuguaaauucuguaucucccaguucagagaucauacuacucuugggacuauaaagcuuagcuaucuguuagggcaaggcaugaacacaggaaagaacugagggacauaacugacuuucuaacaguguugacugacuuuuaaaaaaaaaaugcgugucccuaucucaccccccaccuuucacuucuaggucugauaccugacaccuacugguccuuuaucuuuugugaauuuugguacaaaauguuucucugacucucucacuaaugguuuaggauucagaugucucuguucugcuagauaaaugugguuucccacuuucacagucuuagcauuguucacucucugcugcucuaacuaggcuuagcuuuuaaaauaacggcauuucugaaggacaaagaauuagaugcacaugcuuaauuuucuguuaaauuuuuauguuaaucaacaaguuucuaaguaaaacaaagucugauuugauuuucacuuaaacuaaucacagucuuauugggauucagaaaccacuuuacauuauggaauuuaauguuaauuauuaguugggaaaacagaguuguuaccauaugacugagaaugcuguagagacaauagcuguuacagagacagacacugcuggaggcagcuauccaccaguucuucgucuaaaaggacaaagaaaaguuagaacuaucaaaacuugccuccugcagcugaaacucggacaucuuaggauacuggugggugacuacgcgcugaaauugggcuguacaugcuucuggacugagcugcugcucuggggacaggaagaacugucgguggcucugccaggcauagggagcagacaggaagcagacaggagguguacuuuccuccucuggacuugaagucucuucugaggaucucuuuugccacagucuaaaagaggugcagcuggcaaaggagacucguggugugcaaagagcagucagucccugccucacagagccuguuacaguggccuuggagcacagaggauggcuugcuaacugauggaccccaagcuuuugaauacucgggauuucaugcauuuuuaccuuccaauaagcaaagucaauucucaucccacccccucccucucucugccccacauccaagaaagggggggggaagggaggaaggggagggagggagagagagaagggggguaggggggaagagagagagagagagagagagagagagagaggagggaaggagagggggaggggggagagagggagagggagagggagagggagaaaucgcaguaacaauuguauucacauaggaaaaugggaucucaugaucuggguaauauugaugacaagucaaaucuagguggagucccaacuaaucauuuugcuucuaaauauuaucuugugggcaggagagaggagagauguaccagguaccaguaaguaccaagucuaagauuugaguucaaucucuggaacccuuuauugugggaggagaaaacaaauuccugcagguuguccuuugaucuccacucagcaguaugaggcacacagguacacacacacacacacacacacacacacacacacacaccccacacacacaguuuuucaaaagugaaagaaaaaaaagugaguuuguuuuggucacuuuucuguugcuaugacaaaaugccauggccaacggaacucacuuuggggcucacaguuccagagggcuagaaucuguaaccauuaugguggaaagcaugccagcagguaggcaggcaugguuuuggagcaguagcugagagcuuacaucuugauccacaagugugagguagagagagcuaacugggaacaccacaggcuuuugaaaccucaaagccuguucccagugaaauuccuccuccagcugcaucugguugcaguuggcguucuuaacucacccauaggaugcucgucauaaguguuauuagaagugcgucaacucucauucccaagagcagaauaagugcauucugguucaugacauccauuuauggaaaaauuaaaaaaaauuuccagacaguacaugaaacauuguauaacaccuucccuuuuccaccuuuccaucuuccuuggaaacacaguuuaucaaguacacuacaagggagcuguggccacaucucccucuuuuugagagugaguuucuuuuuaaaacauuuguuguuugucuuuaaucccagcacucaggagguggagguagucagaucuccaaguuugcugccagccugcucuccagaauuaguuucagggcagccaagggauacacagggaaacccugccuugagaaaccaaagccauaucaggcucccaucagcaggcacuucccggcauccucaauagcguccggguuuggcgacugugugagaagcucugguagagccugacaaauacagaggcagauacuugaagccaaccauuggacugagcucgggguucccaauggaggaguuggagaggagacuaaagaagcugaggggguugcagccccauggggaugagcaacaguaucaaccagcaagacuccccugagcuccugggaacuggaccaccaaccaaagaguacaaggaaggacccauggcuccggcagcauaugugacagaggauggccuuguugggcaucagugggaggagaggcccuugggucugaggggauucuaugccucagauugggggaauggcagggugggaaggcgggaguggguaggugggaguggguaggugggugggugggagugcauccucauagaggcagggggaggggccaagggauaggggguuuucagaagggagaccuggaaaggggauaacauuugaaauguaaauaaagaaaauauccaaaaaaaaagaagaauaaaggaaaaaaaaagaaaaaagaaaaaccaaagcaaaccaaaacaaaaugguauguuuuuauguuuaugacucuuuugcuuucuugcauguauauccaccauguucauaccuggugucuacagaagccagaacagaccaucagaggcccucaaacuggaguuauagaugguugugagcugccauaugggugcuuggaacccaaucuggguccuuuccaaguacaggaaguucccuugaccccugagaaccucaaggucaaguuucacuuaccuaaggcuggccuugaacucacuacacugccaaggaugacuuugaacuuguaaucaucagguuuuagccuccggaguucuggaguagcagugcccccucuauaccuggccugaauugguaauuuucuuuguuagggagccuuaccaucauuuucccauaagcucacuagauuuagguccuuguuuucugugcuuguauuuugcucaguuuucuauuuuuuucuucuuauugacuuguaagaauucuuagcuuuuuucuuccuaaaacauaugugaaguaugcagauaagaaaggaaauuagaacaauucauguucuccccacccagccucauugauucacagcagacuuuagugaaucaggcuguccucuaauacacacucugccagccucggccuuugggagugcugggacugcagggguuugccauuguaccaggcuucucuccauugauugagugauugauuuacaagaaauaaaacaggggcuggagagguagcucagucuguaagagguaguccugcucuuguugagguaagaguuggguuuccagcucccacucuggguugcucacaaccuccuaugauucaggaucugaugccucuagcccauguaggcacaugacuacacucaaggucacaugcccauaccucacccauacgugccccaaguuaaaaauaaucagucuuuaaaaaagagaaacaaaacuguguguguguauguguguauguguguauguguguguguguguguguguguguguguguguguguguguguguguguguguguuucuguggucugaccccauccugcucucucuuguugcucuccuaccauaaucaguacccugaguuuaguauccacucuucccauggagucuuuauacugaguaugagucuguauuuuguacacuagcucuuuguuaauuuaauguagcuugaauugaaaauauuucuuauucuguuguuucuaccuugcuuaugguguuuucucuuuuuaacucaugaaagccaaauuuuaaugugauccuaucaaauguuuguauggcucuuguuuuguuguuguuguuguuuuuguuuguuuuuguuuuguuuuguuuuguuuuucugucuuccuugccccugccucuuuccuuugugcucauuuuaugaauguauguccuuuuagggaaugucuauguucccuuuaggacgaguccugacuuaaaguaucucugucaaucuaguaucucccaaucaguugaccuaugugggcuguggcuggcugcauuucucugcacaugcagaucuagcugcucugucuagcagauaguuucuaucuucccccuuucccuuuuccuccuuaucuucugcuuuccuguuucuuugccuaggacuugacagcacagggguuuucagucuguuauaaauuacugaaaauuauuaaaauaaagagauuggcaccuauaagucaaaguccaaagauuuccagcuuuauuucaguauguuuuugacagaaucauuaaacagagaugguauguuucuuuuaucccuacucucuacucaaucaguuuuauccuaaaucuugcucucccuuggaacuacauggcauuuuuaauaauucaggggguuuucaccuuuauacuaaagacauuuggccuggauaauuuuuuguugugguacuuuuuguuguaguagguagcuacugauauuuaaaaccuucuuccucccuguccugagcuguuuuaacaaaaaaugucuccagacacugacagacauaucuuaguucauuuucuauuuuuagaacaccuaauaaggguuaauaaaggaguguauguagcucauaaucuggaagcuggcaucaaguggaacaaaggagaaaagaaggccccacccucauggacuuguucauucuaauuauuuuccaaagauuucguguccaaaugcuaugauccaggucauuaggguuuuaauggaucaauagggguuggguguaauucauucuauaguaucacuauuugggauuuuggaauucuaauaaagaaacaaaccauucaccuaaccaaccaaccacagcccauauucuacccaacccccuccaccgccgcaaaaaaagagaauaauuucauggagaaaaaaaucaaaacuuuaaaaaaaguuacuauuuaaauugacuugauagaaauugaccuggagaaguaggcgauccuuauucaguuuccuuuaagacaaacagugcaugcuacaauaugaacagaagcagaacgguagcaacaguuuagaacuuacccugauucauuucugagucagagacacacuaacugaugaagcucuauaaaacacuacagaagaacaagacccuccaggguauucuugguuuuauuuauaaaaaaggauugcuccaugaccauaacgauaacuccuuuucuuuauacacugaaaguaauauuuauugaaaaauucauuuugacaaacaucaaacuuuuuuuucuacagagcacacuuuugugugugugucuuagcuagggugaagggacaccacaaccguggcaacucuuauaaagcauuuaauuagguuuggcuuagagauucagagacuuaguccauugucaucauggugggaagugcaguggcaugcagccagacauggugcugaagaaguagcugagaauucuauauccagaucaggugacagcagggacagagagugaugcugggccugguuugggcuucugaaaucccaaagcccacucccaguggcacauuuccucaacaaggucaaaccaauccuacaaggucauguguucuaguccuuucacauaaugccacucucugagacuguggaggccauuuucuuucaaacuacacaguguguguauguguguguguguguguuuuaaaagacuuauuuagauguauaugaguacacuauagcugucuucagacacaccggaagagggcaucagaucacauuagagaugguugugaucuacccaugugguugcaggggauugaacucuggaccucuggaagagcagucagugcucuuaaccacugagccagcucuccagucccuagaguguguuucuaaguaguguaaguuucucccuuuuacaugguuuucauuuucuucuaacuccaaguauuguugguccucuuuccuguuuauggcaaguaucauuagcagcagaauuuauguagcagguggccugcuuucuuuucugcugccaggguaaauaccgacaaaaagcuaccgagggaagggagggcuuauuuugauucccaguuccagguuccaauccgucauagcagaaaagucaaggugguggaaacagcucguuucaucucagccacaggggaugcgugcacgcgcacacacucacuacucagcuuuuucugcacucuugagaaauuuaaaguuuauuuuaaaauuacacuuccaguugguugugagcugcuugauguaggugcuaggaacuaaacucgggucuccuauaacuauguguuuaagucauuauacuaaggaaggcaggcguccccucaccaggaggucaacaggaugagaaugcugagaaagaauguauuuuuuaguuuuuauuuuuauuuuucagagcugggguaauucaccuuccuuuggccuuaagauacuguagcucuugggcucagaccucuugaacucuaagacuuaagccacagauagcuuccccuuuucaggccuuuggccuuggacugagaauuacacauuuggcuucugguucgcaugaaccuucagauucagacaacuacaugacugcauuuccugauucucuugcuuacugauggcaaacuguccuaggacuccauaauuaaaugugugugugugugugugugaaguuuuuucuuuucuuuugaagcauucuaagacagaaaagaagcagagagauuaguuagauauuauaguuaagggcucuaaaggcucuauccaaauuugguuucauucuugaaaaucuuagaagaaaaaaaaaagauguucuaguuuuuagcacagaguugacuacagauauacauguaaauauaacuacauagaaacuucacuaauuuuaaaaguaacuuuauuagcaacaaguaugcuggagcgaugucacaacaguuaagaaacuugcugcuccugcaaaggacacagcuccaggcccagcacuuacaaggcagcucacaaccaucuguacucccaguuccagggcaucugauccccuucugaccuuuggagacauuagguacacacaugguacauuacacaccacaggcaaaacacucaugcauacaaaauaaaaauaauaaaucucagaaggcauuuaaaaauaaguauuaccaucaacuaaaagacagaaaaucccaugugaguuguuaauagccuccugggaucucaacuuccuacaaacaggaagcagguugagaaagcccacugcccuuugcaaauacccaaggaaaauaugagauccaggcccgaggacagaccaggcguuuauucaugaaacaguccaccuuuuaucuuacauagaaaccuauuacucagugggauuucaucacugcgacuguuauuugccuuuugaauucaaagguuucuacaccaggaaaagauagaucuggaccccauagagauuaugaguuccuagacuucagauuugauggaccuuucuggggguuaggaucaagaguggauguauuucacaugcgggaaggguguaaucauagccgagaguaaccauagaaggauaaguugguccccauuccucccgaucugaaugucuuauuuugcauacagaaugcuuugcucugccugcaaauaggcaaguccuuuggucaaugaaugagcacaagugacaagugcaaaccccugagauaguugccugcugcucuuccugcuugugcuucuguggucaucaugggaaggguguaugugggguuguguuuuucagcagaagcacugcaggugacucugagauuagagcaugcaauaugccucgacauuaaggcuccugcagcacuucacaagaaagaugaugggaacugggauugaugugcuaccgugaaaguggugagauugggagcuccuggguagauuuuauagguagaggauacauuugaugggagagaaagugaugaauuaaggaucaggacaucugggccuggaaaaauggaagaauggaguggcuauuugcuauguaguuauauuaauaaguuaucauguguuguuucaaaucaccgaguagcuaacacugaacacugaucugccccacccuucauuuacagacauuuuugccuuaaaguuucgucuccaagaugagagauaaagacgaauagcccgaugugaguagccucccuacuaccugaggccaugguaaagucuuggccugcacugccagcugggagcuaugucuggguccauggccaugcagacacaggggucuguauugauguccauggcucaugucaccaccaaagaccagguagacauccccugucagagccaccgccugagaucauguugaggucuuagggauguguaaagcugucccugccucucacugauuaugguacugggagagcuggccccacccauuaucugccaugaggugguaugggugugggaaagauaccccgcccccuaccucacuaccaguggcaggcuggagagcugguccuggggucaugagugcaggagauauggccuugucccucaccagcugcaacauucagagagcccaccuuccccccacucaucacucccaccaucuccacaccucaucuaggcagcauguagaacugccccugguggugggaaaauggugaacugcccugagagugacucugucccuugcugacuguggcacuuggguaaauuagcuagagcagugcuggagagcucacccuggagugugggugcaggagagcuggcagguuggcccacucaguuaucauucagguccagauccaggucuuugaguugguccaccccaacaucuaccucaucuaagaacugcuggagcuuguaaaggggccaguccugcagaucuaaagcugagggucuccaugacacagggcaacaaggugauauggagaggaguccuggugaggaaccuguauugauacuguagcaaaagcaagagaccucugaucagaccaacgacacauuacaaugaauauuugcaauuaaagauguguuggcaaaaggauaugcugugugacacauugugacauauugcaguuuccauggagagauguguuuuuaauguuuuuuaaaaauuuuuaauuaaauuuuuuuuugggggggggauggagguuccaaaggcagagggcaaauacaaaaggacagggagaugagugagacugggguucaugaugugagauucagaaucaauaaagaguucuuuuaaaguguccuccaaacuggauguaguggcacacacuuuuguuccuagcauuccagagguagaagcuggcagauucugugaguuacaaggccagcuagagcuacaugguaagaccccccccccaaaaaaaaaaaaaaccaaaacagaaauaaguuuccuuccuaggccacuucucugaagauaggcugcccagugacacagagagaagagaaucccaaaaccacccagaaguaaaaccuuucccuuucccuuggagcuagcuagcuagaaggccaacuaucuccaacaaauguuacuacuguuuauuguuuuucccacucuauaaggagaagccagagguucagccaugagaaugucaucuauggacagggaccucaacuggaaacuccaacugacagccucaauuucucuagucaguuuuugcuggauaguuugauuugauuaugucauauauauauauauauauauguugcuauuuguucuuuuauuuagaagacucaccagaaaggacacugcucuugccaggacucuaccaggaacuccaacuggcugccuuaaugagcuuuaccaguugauuucugcugaguguuuuaagcauuuaaauucuaucuaucuaucuaucuaucuaucuaucuaucuaucuaucuauccaucuauccauccaucaucacacaugccuuacuauuuauuuauuuuuuuacuuuagacacacuauauacucaaugaacucacucauucaaaacugaaaguauggcuaucauagaucauucccuggaccgcauagaacacuauuuuauuuucugagaugggaaacaccaagagaacugcagauggcaagggcaauaucagaauuuguuugggaaauuucauuuugagaaaccuauaaccaucccaaugggaauguuaauaggcagcuggcuauacaagguuagagcuggagagcagcaaguucuggcaaugauguggagaugguuuauaaagucauaagacuggaugacacgggcagguaaagauuaaaaaggaguccagugauuggguuuagagggccugauggcccucuaauaugucuaaugguuggagagaaauaguaaucagcaaaagagacuuuuaagaagggauacauacgggauacauugucucaagaagacaaaaugacaguaagcugugugaucaaagcagcaaauguuugcuauuaauucagcuuauaaaugguauucaguacauuuuucaauaaaugauugcuuaugacaagugaauaccaguggguacaauuuacaggaaggccagaucugugcuuaucuuuauaauaauucaaacuauuaaaaagcuuagggcaugguauauagcucagucagagcccugggguucaccacuaccaccauuaccaggaggggaaaaaaaaaaagaaagaaaaagaaaaagaaaaagacuacacuguuaccacagaagagaaacauggcuuaaagcucaguuuccaggggugggcuagagaggcuuuacuuguuagcuuuuagaccacaugacccaaggucuccgaagccuuagccacuucugcucagaugcugaguucagaggcauuuauacacgggcuugggacaaguauaccaauccuccuguucccagggaggucuucacagggugggccucaauggcaugcuuacuaaacagacgcucaggacagauuuucacaacagcaacuaauguuaguccacaacaucacgucucccuuacugaagaaaaaaagacaaccacaacacugauggauuuggauuacuuuucauguuucgggggguaaaaccuguggucucaauugucugccucuucuuucagauucucauucuuaucugacuucaucuucuuuaccucuucucuagccacguguccccggaagagggacuggauuuugagagcagccgccuccuccuguucucuuucuuccucaguagacuccuccuucauugaaaggaaugaaagagagagacuuuccagaacgcuguauuuugaugccacagaaaugccagcuuacagaugcaacuguuugaggucuguuacuuccugaggggauuuugggacacacuguauguguaccaagggcugaaugccaaaggaacagugaggaguucagcuuaccauuccucacuacgucuuaauauaagaucaucgucuaugucuuuucgcuuguuauuccagauagcaccuauuuuaaguuuccugagaaauuacguuaggauggggaagcaagaaagaauccuugaaguacagugucuguguuaacaucaguagaugcacuauuuugaaauaaucaugauuagacaagauagaguaaaaugauaaauucuaaucucuagauguuuagccauacauuuagagguugagcaucaaacagaaaguuacucuaagccgggugguaguggcauaugccuuuaauaccacuuuaaucccagcacuuggcaggcagaggcagguggauuucugaguucgaggccagccuggucuacaaagugaguuccaggacagccagggcugcacagagaaacccugucucgaaaaaccaaaaaauaaaguuacucuacugcuacuugguuuaucaucaggguuggcagaacagugacaaacaauuucuuuuaaauuuagguauaauugacagauggaaaaauccaugaauccuaaguguagagcugaaaaaaauauauggcccuuaauguaucuuuuuuuaagcuaaaaagauguuaaacaaacacacauuuaagaauuuccaaguuaucauguguuuugaaaaguugaaauauuuucgcuuucccaaaucuuccuaaguagucauuaauuguaguuguguguguguauauuuauguauguuuaugaauccuuccaaauuuucucuccauaugaguacauuuacaugaagacgugguuuucauuuuaaaacaagaccaugcuaaucacaaugcucuucaacuacuuucccuggaacaacaagucuacgcacucucuccugugcucguacuuugugggugauuuugcucagguugaaugggagggacaggaccacugugcuucauuguacugaugucacucuccagugauucagucacucagucaccuauugacggaccuuugagcuguucgauccccuucauuacaaacagcgagauacauuuagcucuuaaauuuguaaauacaaauagacuggcauaaaauucuuugagaugauucuccaaucaagugaauuacucuuaaguuaaaaaucaaugagaccuuaacacaaacucauauucuugaauuccuauuaaauaugaugccagcaguaacuggauuguaucgauacuauucuagaauaacuaaauaauguaagaaaaaguaugucucagugggugggaaguacaguucuccuugaggggcauguucauuuucaguaucaaauguugcuaacugagauacuaggaccugaaaaggaacucaaagguuugaauugugauauuguacagaaugaauucuuuuacacaaagaccagucuuucuuaguuucgacuacaaauaauacaggcaaucauguguuguauuuguuuguuuuaacauaaugugccauauuaguaaauguuuaacugucucuacagagaaguaacagaauaaaacaacauaccacaaaagcucuggcuuauaguguuaccuuagucucaauacucucauguggccgacguuagguuaucaaaaugauguugcauugugcacaguuaucuccaagugauagccuucgcacaccacugaauagagauagguaguaucuuugaggguggacuucucucuuucuggguggcuuugauguagaauaucaagacaggcaagcauuucuauagaagaccuuuccugagcaagccauacuggguaaagccauuuuauuuggugguauguaauuauuucuccuguaguuaucuccagccugugccuuuguguggugguaacauaagcaguggagaaguuccccaaauggaauacuaaucuaagagaugagaggagcauccacguucaucugucugccucuucccauggaaagauuucugaucuagaucucuaaagggaagaaugaguuuuugaaaauaaucuuccaguuuaucacugauuaacaucugauuaacuaucuauaagaaaaacucuaauuucaauaauagaacuauuauguugguauauauuuuaugcacaccuuuaagguuagugaugcuacgguguguaggaauacaaaaguaaaugaaaaguacuacguacgaagggagugacugguguuucuucucuuccagaugacuuagcuaauucuuguucacauuucucaacuuguucuuguuccuagaaugagagacaagggucacaugggcauuguuuugaaggcagcuaacucuugaaccgugcugcuuaagagaaacuggaaguuucuugucuucuaucaggaauuugucuugggggaaaaggaagugaauaaaaacaagggauaaaccacugccccacacuaauagcggauaaaguuugguaauaaaucuugaugacaguuaaaaaaagugucgauaguuucuacaguggcaguaaaaguuguuguauuccauaguaugaagccaaggugacuucuuaaugauaauuauagauucaaaacuaagucacucuuacagaagagaaaggaauuuggggaggagagaguaauggggaugaagaucaaaguaccuuauauaaacgcaugaaaaugucaauuacugcuuuaugcaguuaagguacaauacugcauuaaaucaggaaagcaaguuucccuuuuggagaaggguauguauaaagaaggagccagcucagucaguucugacauggcugguacagucuuccaccaaacagagacacugcuaguucacugccuucaggaagagucuuuaacauagaaaauagaaaucugagcauauggaaaugaacaagauaaaacccuggaaaccaaauguaaaacaaacacucugaauuuucuauguaacacaaggacagaaugcuugcuuucuuucuuuucuuuuuuuuuccuuuuaguuuuccaagacaggguuucucuguguagcccuggcuguccuggaacucacucuguagaucaggcuggcuuagaacucagagaucugccugcugcugucucccgagugcugggauuaaagucgugcgcuccuugucuauacagugauuauuaucuuuguuauuuuuagauauguuuuacugcuacucguguuggcacugagccuuugggcccaggugauccucuugccucagccucugcaguagcugggauuacagaaccaggccauugagcccagcuuuuuguuguuguugcuuuuuuuaauuuuaagaaaaauuuaaaaguauccaguuacuuuggggaauucugcuaaaauauaagcuuuaauuuggauauaugggggucuagugugagacugaauucuaucagguuuccaauugaugccaaugauguugaccccacauaagcugucucaccuaaucuuccucgucucaaacacagaacagauaauguacugacugccaaggaugacacaaacccagaguccucugagaugugaaagcaagacaccaacuuuuaacauguaauacaugccuucaacucaacucagggcaauuuugguuaagaaaggcuaucuuugagaauacuauuaauaauaaaaauggauucaguuacuaaagagauuaacuuugaagaaaaaaaaucccuaucauuaucuucuauuugaauuagucuuuuuguaacaugcaaaugaaaaaaauuggacuaauagcguucuauuuugugagauauaauuuaugacuuaugauacccaaguuuaaagaauaagagaugggacuaauugcgugaugaucaaguccuuucuccuguugucauuuuuaaauuaaugcuaaguauugguacucaauucauauauucuagaagaguauuucucaucauaaaaauuuuuaauaaguuauuuaaugcuugacacacuucucaaaacuuggggagaccauaacaauuucuuuuauagauagaaaaauauagcuaaaucugguagguucauaagacuauaccuugaaugcgugguuguuauagaagcgguccucuaccuuagccccccauucugcuggaucaaagcugguuucuaaauaacaaaaauaauuuuauacuuauuuuguguucauuaaagugaaccaagaacaaugcagaaacacaaguuucuuguuucaaaucagaguuucuuuacugacaguugaaaaucuugcugacacuaaauagccuagugcuguagacauaaguaauuauuaaaauaugaugaucagucuaacacugaaugagcccuuaguuuuauuuacaaaagcaccaaacaccuucauaacuucuguguucauaaaacucauaagaaaguggaagacacagaacaaaugucaguauuuuaaauaaauggacuuaaaugugcacuggcaaauguaaaaaaguauauaaaauauauacuaagggauccggaaguuuggaaaagugaaaaagaagggagaguuuucaaaagagacacauuauauaaacaguucauauagacaagcaauauuucuauccaaagauaguuuucuuuaacuuuccaccaugaaaaauuacuaacuccaaaaguaagaugcuuaaacaagucccaugugcacauguacagagacuacaauuaucaacuugcuguuuaucauuuuaucuauauauuuucugaugauuuucaagccaccccaaacauuauauuaaucuacauauuaucuacauacacaaaauuuacacuuaaauaucuaacuuuacaaaauuagcauguaccauuaucacaucuaagacauuaacaauuccuuaccaucaucuuguaucuagccaacuaucuaaaauuuagcuuuugucuacuuaucuuggucacauaggagccucaaaauggacacacaaugccuuuuguuauguuuuuuaaauaauauuuaguggaaaauccaccaccacuguauuuuucugugcaguuuauuuguugaugaaauugggccaguuuuccuuuggaauuuuccagggcagauauuccugaccguguucacaggagaucguuccagggucauuugcccuugaauucccuguacacugguagcuggagcugcagguuucauaugauuuagguuugauuguuuuggcaagaauacuuaauugguugugcuacuuaaucuucucagaagacaaaucauauccuguucuauuuuauggacugauaauuguucuuuaacuuauuuagggguauaaaaugguaauguucuaaauuaaauuaaucaguaugaauuuugggguagacaugauaaagaaaacagucaacuguuggauuacccugaaauauggcucuuaaaugaaaccaaggucaaugauuugauaccagcuuucaaaauaaccagguggcucccagcacuuucuuaggaugaccugacaaugaagagcucugugugucugguuuuagcauuaugagcucacaaauacuuagcaacuuauuaaaauuauuuuuacaccccaaauguauucccaacacuagcauacuuacuugaucuacucuuuuauauacaguuacaaaguuuccagaguaccucugcauauuagucagcuuucaccacuguuacaaauaccucagacagauccaguuaaaagaggaaagguagaauuuggcuuacaauuuuagagguaugggcuaaagacugauuugcuuuguuguuugggccagugcaaacauuaaaaaaaaaaaucaccuaauauguauauuuggguuguuuuaauaaaugacaguauaauggaauguguagagggggaacuucuuggcuuacaguuaaguaaguuugacagauacuacagaauuccuuuccuguggaugcauguucuaccuccaguaggaaugagugugagggcuuauuugucuuagccuaaucuacaaaucauacugauaaacuuuuggcuugcugagaauacauaguaguuguugguaguugaguguaguuucuucuguuuuucauuacuguauuugugugugugccaauggaaacaagaaaucagauccccuggaacuguaguuacaggcaguuguaaagcugcccagguggcugcugcuaucugagcuugggucuucuggaagagcagaagugcucuuauccccgaagcuaucucuauaugcccaauuuugauuggaauuguuauuaugggauaguugggguagcuuuucauguuaagagcuaucuguguuaauuuuugugugaaccguuaucucuugacauaaaggcguuuaacacaugauuuuuacaagcuauuuauuaggcuuauuaacucacugggcugcugggacgugaacugcaagcauuuuucucaguuuguuauuuuguuuucuucaugcugcuuuguuacacacaagcugacuucuuaugcugucaguuccaucaaucuguuccuucaaccguguugccuuugaguuugaagcaacuuggcaagcaagauguuuuucuuaagggaugaaguaccucccagcauuuauaugguuucuuucuuaguauuuaaaucuggaaucaacuuauuauuuaucuggggcuaugauauaaaguauugauacaauuuuguuuucuuauuuugaucucaauacuauuuaagaaguccauuuucuccuaaugacuugagcuaccacuuacacuguauagucacagguuuccugucacaaaaaugaagacuacuagccacccaugaaaaacgguggcaagggaauucuugccaugugggagaccggacauuguugguuuagaaguccacacucauuuauuuugauuauacuugugaagguuaaguuuuuacacuguaucaguugguaauucaccuuuaguugacguaaguggaaguggguguggugguuaaguuuuuuuuucaaaugguuuuagccacuuguuuaucagagaacuaguauucuaaggccauuagucaucaauuguuuuuauuacugugaccugguaacaaugacucaaauauuuuuuuaaugguaugcuccugaguucuaaaauuaaacaaaugacuaaagauuuuuacugcaugaauuuguaaaagucaauguuacaauaaccaaauucauguucauacaaacauuacuuuuaaucagacaauauaucuuaauagcuuuccccuacuaauauuguagauugugcagcaaacauucacccugacuggauaugaaacagaccagcaggagucaggaaacugguggaaauuuugaguucuucaaaggcaggaucacaagggacaggagguggagcuguucagugugugugaguuauuuggauucuaucuguguccuggguuuccucucucuguaaaaugauuuaugaaggaacaucuguuugcuuagggguauuuccagucuacuuugccuaaaguaaugguaacaaaccuucuauacuaugauuguuccaggcaagaguagguuuucagcacaaacaugaugauaauuguucuuucccccuuugaccugugagccagauccucauauucaugaaucgucaaggcugggauuuguacaucguacaaaggaaguauaggaacuucacuuuggcuuaaaaucaaagucacugcuagcaugaaccuuagucucugugcaggaugggaccuggaaaguacauagaauguaaauuaccuucccagcuggcaauucacuugccaaagcaguuuguuucugugccuucguugaagaacaguuucauauaccccagcgaaacccgguuuauuuaaucuagggaguguuaaauuauuuuuauaacacuuaugauacuuucaaaugagaagaaucaaaauuuaaagaaaacugcaaauuauccucucaggaagaacaggcagugagcuagcaggguugccugagaauaggguccuuccauacugcaucugugagaaauacagagagaauggcaggguacugaacugucacagccuguugcaaacaguaagagccguacuugcaaccacuggccuuauaaaggcuuucugcacaaugaccaugauuuuuaauguucuuuuuuucuuuuuuguauguguguauguuuucaugcucccguguguguguguguguguguguguguauguguguguguguguguguguguguagugcuagauauguguuugcacguacaugguggucacaggcugaagacauguauauuccucaaucuuaaguuuuaccauaaugaaaugcuuaguuuauuuuaaaauuccuauuuuuuuuuuuaaaagagcuuacucucucuuuucucuagaagguucucaaaauacgcugcggcaaaagcugguauauuguccgguugcucccucagaaucucccgugucagcccuucaagaagauuuccaaauccuuguggaauucgguaguggguguuggagaaaggaaucgacaucuccucggaaagaauugccuauaugguaccuaaagauucaguaaaaagugccuaauuuaaauuauauaaucacaaguuucacaaaccaacucacuaucacgacucaaaucauuucucaaacacacauaccauauuuuggacuuuaaaaagaaaaaagucacacaaucuagguccuggugcucucucuaucucaguagaucugaaucaaauccacgcacauccuauuguggccgaagugaacugacucucacaaaauguucucugacuuccauaggcugacgacaucauggaggccgugcccauacacaugcacauacuaaauaaaugaacaccaaauucaccccaccacgucuauccuuuucuccuagaguuuugaauucuaccacugaacuauuuuguuuguuuucugagacagagucucucaacauagcucuggcuguucuguaacuauguagaccaggcugcccucuaacucagagaucuaccugccucugucucccaagugcggcgauuagagccagccugguggauaaacacuaugcuuugugaauuauaguaucauaaauccagauccauuaaauuagacaaauacauauuuucaaaguuagagaaccacaguuuucacuagauuaaguacuuuguuuuucuguccuuaagaggugaggguagauguugcaagcccacaguauugaagagacaaugauugcugagaagcugguauaaacaauccccuuuacauugcugagaagaaacuauuucaagugcaguacuugggaggcaaggguaggugggucuuugugaguucaaggucagccuugucuacagggugaguuuccggacagccaggggcuaaacagagaaacccugccucaaaaacccaaaaaucaaacaaauagcaagcaagcaaacaaaaaucuagucguucuagaaauuauuauaauuuguugaauaguuucacuuguuuuucagccccaacuuuugaagcauguucucaagugccucugcuuucugaugagggauugugaaaggggaggucguguauuugggagucagcuuuugauguuuggggaaucuuauuuucugguuuucucaggccuucuuuuaucuuauuauucgaggacuggcuuaaagguggcugacauaggauuugauuauugagaaaagagagcuucgggucugggcgugugcucccucugccucccccaagaagcacaaaggcggcgcugguuggggucgaggcuggaggacuagagguuuaacaaggccuaaccuguggagucucuucccuuucucucuuuuggccacaaacagcagauuagauaucgaaucuugagagcuguguaaagcccugaaccgggcgggggaggacaggcugucgaggggaagcaggucaaaccgugggcgggacgccaaagaccuagcguuccagauucuccgagaaagggcuugccaggcucucugucugguccaggaguugcgggaguauuggagaugcggagagacuacggcacgaaggaaaauggcgaagccuccacauuggagagggagugggggaaacugccucaccucuucuuucucuucaagcuggugcggaugguuccaguguuuuaucucguugcuggguaaccguuuuuuuuuuucuuuuuucuuuuuucuuuuuuuuuuaacuacggaggccgggaggggagcgcccugcgccgcgccgcgccgcgccgcugaugguuucgcguacugaaggcuugaggguggggcccgauagguagacccucccaggccccgcccacuacgcaagaccacgccucugcccuguccccgcccccgcauaggggcucuuccugaauucggcggguuaaucaggaucuucacaaacaugguuuccccggggccuguguuugggauagugcugcucauaaucgcgcgagucagcagaagugcaggugaggugucacagcugugccggacccuugccuuucagaucuucugcaggaucauggcaugcguccccuuuaaaggucugguuugagucagaacuggacuuuucgcaccuaguucuggcucaagguacuguugggcccaucuacugccuuuuucaugcaggguaccucauuugcagcauaggaggcagggagagacuucgguuuacccauuggaauaggcuccagaguccccagaccgaagccuugaggagagcucaaagagaagggggcgaagcuuaguuagauaauauuuggaaacaggugucugagucauccaaaauacuucaacaccugcccccucaguagugcccuuggggagggcuucugucgggaugggugccuugagggaauuaaauuuuacuaguuucuaagugguuauuagggcuaagaaauacaacccccucacuagcucagaauaauuuaagguucagcucugaauuuugauacagccuaagagauacuaguggagggguaagacucaucacacuggagagggagcuauuucacacuggccauugugcaggucagagcuugucaucugacuaaccugagcuggacauugcccucugcauggagauaucaaaagauaggaaucuauucacuuaaaguaaaagguuacugcuggagccacccacccuucuuuucuuuguaucacugaaagaguggaccucauccauagacugucaauaaaugaaauuuggggggggggaugagaauauagcucagugauaaagcucuuggcuggagugcuaggaauuuguggucccauuaccauuauccucacagcaaaaaugaaauugcaauuccuuuggaauuagaugacguugauucucauucugucauaaacuaccuucugaggccugucaaggacauuacugucuucuuucuuaagaacucugcuacacgaguaagcuccuaguagauuguaagauccuuggcagcaagaauuuuuaucuacuauuggaauuauuuuuccuuccaggguugcagucucaauguguaaaguacuagguaucauuaaagagauauucauugaauucauagcuguucuaauuauucuuuaaaauugcuuaaucuauuugugcucuagucccuugauggguaaugugguuagguuauaucucuucaucgguaguaacacaauuaacacguuuauuauaaagauaauuuccaccucuaaauuuuuuuuuucucaccauaaauccauucacaaagagcuucuauaacugaauguuggcaaacacagaagggcuugggaaggcauuccccauccuauggacugcaacauuguugcccauguaaggaauauuuucuucacucuguucuuccaacucaagucuucucuuugcuuagcucuuauuuaugcguuuacuuuucagcuuuuguucuguaucuacccaagacagggcccucccacacauaugccucccgguuuccccagcaggcugccauccugcuuaugcaauucugggauguugugguuccagaguauuuugcucaugguacaugcuucuugagguuguuaagcuuuccggauaauccuugauugccauguaggcuuccugaucgaacuagcuccggagugagaaagaaaacugaggauuuuuaggguuagccuguaacuuaaaaagcaguauuaauaggccaccaagcuugugaggggacccccauuagcucgacugcccuguuaaguauagccuaaggggccugccaucuuuuguagcuuucagcaaggaaaaugucagcuuuguuaauucuaauucucuucccugucuaucacuuuuauuaaaaacaaaaaaccaaaaaccaaccaaaccaaaacaaaccaaaaagcccuuaauuuuguaaaauauuuucuuuguaggauuuuuaaaaacucuccccugcugagacaaauugggaugauuuuaugauuuuccuacuuaaauuucuaugagcucacugggaucauuuggaucaaugcuuguuauuuaaaaaguucuccgauauaggcuaugaguuaaaaauagaaaagaucucguuaaagugaauucuuauucagucuuguuagugauucuuagcacagaauccaauaugcaagugugccuccucuuuucuuugcuugugaaauggugacaagacuuuuucucagagauuuuuaaccuucugucucuccacgaucguauuuuugucuccugacuuaucugagcuuacuggaaaggaaacauuuucacagucguaagugugguaaaccaggucaucaaagacaaaaagcaacaaacaaaaccaaucaacaaaauuacaucaucaucaacaacaaaauaaacccucaagagaaaacacuugaagggguuuggcauugauaggauggagaggaggagccaaagauggguacagcaacauuagaggaccuaugagcuacuaggagugggcacagugauggagaguuagggaaggaagugccuuguuuuucuuaucaucaccaucugugaggugcauggaagguucauuuuagugacuugagagaggaauguuaaauucuagagccaaguuuuagagcaaggguuggccaagaacugugaaggggaaggaaggagagcauguacauuaguuguuaucuuggguucuaaguuucucuuaauggucauguucugcugugauacauauuguuggaaacuguucuuauuauguuguuuauuuaaucuggagcaacuggacccgguuuuggaagauuaaaaggcuuaagugggcucauauucuuuaguauagggacuauauguuacuuccuuuuaccggauccacaugaugcugaaucuccugauuauguucuccuaagugcuuguugauauuuauagguauugguuuucgcuuugcuucauacaucgauaauuacauggugcugcagaaggagccuucaggggcugugaucuggggcuuugguacaccuggagccacagugacagugaccuugugccaaggucaggaaaccaucaugaagaaagugaccagugugaaagguaaggcagcccauucucuguucaguuauuguccucuucugccaccugcuggauuaucugaaaaugaaugcuuauggcucccccucaaguugucaauccauccauccaucauccauccaucuguucauccauccaucauccauccauccauccauccaucauccauccauccauccauccauccaucauccauccauccauccauccauccauccacccauccauccauaagaguuauuugagauacuauguggguaaacacuaaagauaccacaaaugguaacaaggcucaaaguucccuucaccaaggggcucauugaacagaacaaauuauguagucguuggaugaacacauaaaauaucuguggacuuccaagagcuagagaagacauccaccucagucugguugcuauggaaaguugucacagaagaugauaguugaggcaggcagucuagaggugagaggguggcucagagguuaagagcucuugcuguucuugcagaggaccuggguuuaguucuagcaugcacauagggugacuuauaauucuguguaaccuccagcuccagggguacucugggcacacacacacacacacacacacacacacacacacacacacacaaguugaaauaaguccuacaagcaauuugaaaagagagucaauuuggugaucuugugaagaacuugaauuuuuaguuuacugucagaguucugauucugucuguuauuuuuagguauguaauuuaagaauauauuaaauauaucugugacaguuuguuuuuuuggggggguuguacgaauucuuaauggauuauuaugaggaguaaaugcauauaaaguaguuggaacagugcuugucacauuaacuuguuuggccauuauuguuaccacuacugcuacuauuacuuauucaguaauucaaauauuuauugaguaccuacugugugcuagauacugugcuagguacugaugauaaagugaugaauaaaacagauggagccucucccuuagugaagccugaagguuaggggaggaggcaggaaaauaaagaacacucauaguucuuugagauaugcaauaguaaagaaggacucuguguguguguaugagagaaagagagagagagagagagagagagagagagagagagagagagagcuuagcaagguaguagaguaauggacuuaauuuaaggcugguuuugaaagagaaaacguccuagacauagacacagguacaucaguaacacuggagaaaucccguguagguagguuggucugggacacugggcuaagugacugaugguaggugacaggagaagggccaguauggcggcuuguuuaucucugcuaaagcauuuaaauccuggaucuguagacuuuaagcauaaaagcacaggagcagacugauagaguuuggcagucaucagauaggguugauagagcuguuaggaggcucuuaugauauccagauacacaugaugaggccuugaccugggaguguagcugugaggaugaagguucaaggugagaauaaaguggucucuuugaggaagggauaaaaacguagaagaguagaugcugggaacuaaacucaggucuacuccaagagcagcauguucucuuaacagcugagccaucucuccagccucucuuugugaucugugagauauacugaaugugaagaauuccaaaacuuccuaugcuuagugccuagguuuuuuuuucuuuucuuuucuuucuuguagcugagaauuucauugaaguucugauucuucuacuucuauucccuaaagggugggaucauaggaaugaaccaccccacccagguuacauaguacuggggacugaauuaaacaugcuaggcagguacucugucugcuaagcuauauccccagucuacuuuugaaagcauaugaaauuaauggguuuaauuauuggcauuucacacguauguaucauuguauuuuguucauauucacuccccugcccuucccccaccccuugccugacuuauccucuguuguuguuuuugagacaacauuugucugugugucucuggcuguccuggaacuugcucuguaaaccaggcuagcugcacauuaauuuucauagauguguagucgguuuauauuucuauugguaguaaauaaagguuccccuucccuacauccucaccaggaucgggugucaccuguuuucuuaaugauagucauugugacggagaugccguagacuuuacuccuuccuccccauauaauauaaccaagucucaagagggacauuuccccucuccucugauguagaacuauugaaugcaaguuacagauucuguuuguuccagaggagcaagaauaauauaagacuauaacuuuagaacccacccuaagguguaucugccacaacaugcuaugacuuuuaucauuuucauaagcaguuuuacucauauaaagcauuuacuuuuuacuucauucuuguuugguggugguauauuugaacuguaagcuauaaaauaaauguaggugguaagggaugagcacuaaggcauccuucaccuucaagccacauuugaaagccacaggaucauguuuuagcugaugaaaagucaggguucuguguggagaggugaagaaagcuguuucuugugagcccuagguuuucuuuuuaggaagauaaaggccauggguacccccuccccuucuugauauucaucacaauaaccugaaaaagauaacauuugauuugauuaauaagaagaaaagcaagaaagugcuuuaugacuaaucaugucucugaacaaauuauuuuuauuucguucuugugguugugguuuacaucuugaguuaacuggggaagccagagagaaaagagagacagacagcucuuucuuuguguaugccuuuugcuguacuauauaaaucaguugucagaggcaaacaaccagacaugcucuuaacaugugaaaacaugaagcauggccuucuuaucaggguaggccaggguuggaguucauuguugucauuuacucgaugaaaugcuuggcaaaauguuuguaggcuaaguagugguaaaacgacggcaggagauugaucuuccuagaugguagaagaaaaaauguaagaacacagagguuugaauacagugaaaugaaaacuuagagaaaccugggccuggacuggccaaagagguaacagggaacaaacgacuacuguucauaaggcaggaccagagcagcuguggcucagaaggccaagaaccagcagcaagcccauuggaugcugcugaaaucagugacggugagcuuuaugguuggggacuuagaauuacuauuugagcucauccuaguagucuugaugggcuaacauucuaaaagcucuuaagugccccauggcaugcucaucaccaugcacccuguucugaacugacuauccaaacaaagacuaacgcuccucauggaacaugguggcuucugacuuuccaaucccacccuugcccuuggucuaagacaucauagggcuuguaugaguuaucucuugagcuccugugcccaucagugaauucucuacagugcaaguuucuccugcuuuacagcauugugucagggcauauuuuucuuuuucuuaaaugggaguggaaaaaugcuaggaaccaaaagaccuuaggcuagcuagccaagaaggaagcuuuuugagaaguugaaggcaaauuuuucugguacaaaagauguuggaaucaagacucauuuuccagguucagcuuuccugagguucuagguccuaccaggagcucauucauuuuucuggcuguagugaaauggugccacugcuuugccaauuuucuuuccugucuuuuuguugcuggacauugucuuaguuaggguuuuauuugaagagaucacaugaccauggcaacucuauaaaggaaaacauuuacuuggggcuggcauacaaguucagagguuuaauccauugucgucauggccggcugcaugguagcacaugggcagacaugaugcuggagaaggagcccagaggucuacaucuagguugguaggcagaaggaagagagagacuugagccuuguugaacacugagaccccaaaaguccaaccccaaugacacaauuccuccaaagcuccaccuacuccaacaaggccacaccuccuaauuccucuccguaagcauucaaauauaugcgccuuugggggccaaucuuauucaaaccaccauagaugugcacacuuguuggaagugcuagggagaguuuuugucacuagccauguguauugaaaaagcuaagggaaaauacccaauuaauagcucugaaugcacuagaugaacacaggaggcugagaacuaguccuguguuagguucucuggcaguugaccccaucagcacacaucagcagugcuucuggcagaaggacggagccucaguaaggugugucagugcaggaagccuggaaagaccuuggcaagccuguauuaggacagauuggaacgucugccuguucauaagugugagccauacggagcacaucacaccugugccacacaaucuguccuagcugcccacuguuuccaaaacagugauuuuucugguuuagguugaauuuugcauuuuauaugcugaugccuggcuuauuggucagagaaaugcaaucgugagcgcaugguccuggguuuagccgaccuucuggaggcagagcuccaggcucagcuaguaccgcucuucagaggaccaaacguuuagauauuuccuccaccacuccaggcaaccuuuaaggcuucaguuuucacuaauuugcaagggcucaucuggacauuuccugcuucugcuuaguuguugcuggcugggaggaaccuuggacaguguccagcauggaguaugcacucagaugguauuucuauaauuauuucuucucauagguuagggcaauaacauuacaaugcuccaucuccuggucuccucauucuuucccuuuggauuuacauugaucugauggcaauagauaagccagauuauguuugacauuuuuguguuaaacuguuuuucucugccuuuucuaggcuccuguuucacugcuccaguauuuucacguuuucugguucuuuuuuuugucuuaagucucuguguaugagguugacagcagugauccaguggcugagaagaagggcaaugggaggugugguuucuaggaagcaagcuaugaaugucuaaaauagggucuuucauggcuucucauuucuuaguggugucgcagaaccucaagucuuguaugucacucugaaauauucgauugagccagcuaaaauguccuuuucacugagaucaauuuauaugcuaacugcuacuuguugaugugucuccgugcaccugugcacugauggcagaacccagugccacugacuguguugauacuuguuagcgauagauggcaagggugacccuuaguaaaagaaagauucagauuagaaaugauuuucugaaccugugcuuacaugcgauuggauaauugcaaguuaguucagggugcuguguaaaucagaaagauuagauuacgguaauauugacaguuggaugguguaaugagaauuucuguuuucuguuuuuuuuuuuuccuugucaacuaacuauccuugaaauuuaaucuauguguauuuuugucucuccuaauuuaggauuauaacuggguaacuaauuuuucuuguaaaugccuuaguuaaaaauaagaagggauugguacagauuagggauaaaaaggcugcuguucucaacagcucuacccccuugccuggaauuuggccaauccuuauagaguugcauacacuuugucacagagccugagcuuagccacaaaugaggugcaguugguguuuaacucuacuuuaggugguugguugauuaaccccuugaagucuguuuuuguuucagaacccuccaacaccuggauggugguacuggacccuaugaagccugggggaccuuuugaagugauggcgcaacagacuuuggggacaaugaauuucacccugagaguccaugaugucuuauuuggagaugucuggcuuugcagugggcagaguaacaugcagaugacuguuucacagguaauggagcaucucagcuaagucaguguuggugauaaugaaggagaaggaaaaaggaguaacaaggaaggaaggcugcuucuguucacuaagaacuuaucauguguaggauccaaucugagcacuuuaaauaauuugauuucacaaucuaaagaagcuauuguuuggcacuaauugugcuuauauacuagguuuucucccuaaaaagguuaaagguuacugcuaucccuagcucugucauccaagccgauuuaucuuugcuugccuuuuuugacuaucuaguucucuguuuuugagaacuauuugaguuugagguugaggaaucugaacaaccaagccgugguuuccuuucauuucugucuuugauaaagguauaaauuagauggcguggagagauggcuccgugguuaagaucauucacuggcugcucuuccagaggacccagguccaauucccaacagccacauggcagcucacacccgucuauaacuucaguuccaggggauccaaagacauacaugcaggcaaaacaucaaugcacauauaauaaaaagaaauaauuuugugaaaguauaaacuagaguacuuuuauaugucuuaagccuucuuguuugguuucuauagcuuuuauucuuuguagucucauuauucccuuuaagaaaaccuauuauuaaacaaugccauuuaaaagauucacacacacacacacacacacacacacacacacacacacacacacacacaucuuuauccauuuuucuaauuugaaaauccaaauuucuguaauauaacucuuucuaauuuugugaacucuuacuuccuguguuaacuauauggaaguauuuugaauugacaugccuauuaagcuagacuuggccuggaccuuguuagcauguuugacuagacauggaugugaguuuuuaccaugcuagaaagcauggcuugguacagaagaggaacugcucuuaacucauuagagaaagcagugcuuuccuucaugcuuuaauuguacuucuguguuuccacagaaaggcauggaccagaucuguuuauaucuauauaguaacuuucucaaucgcaggcuaugccaaggaucccaucccauuuucugucaagcuaaaucagagcuugauugcuaagcguaaacacauucuuucugccuggaauuuuuuucuucagcaucuucugaauuaagucagggcugagagcucugagauggaggggaacagaagcgagauuccaucugaaauauauguguuaccucucucucucucucuuucucucucugucugucucucucaaaugaggcacuuaguuugcaaggcaguauuuuaggugcugauaguaccaaaagccacauuuccagucuuuuaacaguuuacagaaccuuauuucucaauagaaaaaaugcauuaccagccccccccccccugauuuugcuccuuucccuguacaaauucccagcacacauaagcacaugagcacaguguuugucucuuuuuccuuuccucccuccgugugccauuuugaggagguaagauucucacuauaaccuaccccucuucacauucaaagaaggaaauggcagauuguaugcccaucuuguuguuaggguaaaauggaauuuuaaagcugaguguuauuuauaacaccaagugagauguuuauaaauggagaaaagucuaaauguucaucugccaccucaggguaggucucagacauuucuagugaggcucaggaaaagauggccaauaucagacaagaagcccaaauuuucaaccacuuggcccuccccucuuucuuauuuuacauauggagagauugauauacggaagagagggaaaggaacgauaacccaagggcaggcuuuuggaagugccgugguggcuucuuuacaguuauuaccucaaccuuagaacugauuuagucgguguugaaacaagguacaagaucuccaaacucuuucauguuaauuauuaaauuacuaacuagaugucuguccauccauaagugugggcaugcacacacauuuacaguuuacacacacacacacacacacacacacacacacacacaccuugcuugccccuuacaggcuccaugcuaacuuucucagagggaaauagauucuugacgugucuucauuaauucaagaaugugguauaaagguuacaaaaugaacacuggugcgcagcugcuuugauggggaauggucgggucccuugagagacuguggugcucucccucagcccaggcagugcuaaugacuucaaauaccuugguauucauuuacauccucauuuaaauacuugguagggaaauaauuacacugagcuguuugaugagaugaagucugaucucagcagauggaguaaggcuucccuuucaucagcagggaaaccaagugucauuuaaaugaaaaucuuccugaaaucucuuuauuccuaaauuugcugccaauaucccagaggaaaugcuuccaucaaaaagacagugcuguugggggaaaggggaccaauuucagacacaauccucaucagguacagcaggaauuucccccacccucuuuuuguuaacacccagcuuucugguucuggcaaaugugaaaaaaacgauggaagccuuccagcuaauguuuuggauccaguguuacgugcugguaacaauacaggagaaugccagccacccugacuccacugcccuggcaguacucaggcacacuuagggauagggcauguuucccauccucccuccccaagcuggcggcucauugcuaugagcugcuugcguucccaggcagugcggaagcugguguggguggagagaaugaaagcagcuucauccaccguucccauggaagcaacauacgaugcauccugcucagugcagagcugaauuucaaaggaggugacuuuuuacagguacuuaacugcugaaaaauaauuucccugccacaguacacugugagcacaucagcuuguuucucuucaccaucuauuuuccaugaaaucuuacagauaagauccugaaggcagaucaggauuuccaauggaauuuuccugagaccguguguaaucucuguccugacuauguagacuuugaccagcuggaguugcugccacccaggagacccaucaggcuguggcucccacagugacccaagagcaauuucauuugcaugugguuaugcaguuggcugcagucagcacaguggucaagucagaggcaauucugggggcagcauauuucagugaaaugcuguggggcacccuggcugcuuuauucuuucucuuuucuuguaccguggguuggaaggccagcuguauucucugcagugggugggagggaaggcaaagcagaugcagguucuguggcuggaggccaauguauucuugccuccugugcuuugcaguggcugcuggacucagcuggagagccuguuccccaaggccaauccuaacugggcuuccugacgauccuuuuggcccuuuguuuggacugcugugugggggugggguugguugggguagggggauagagaggacucaagagaaaacauguacacaaauacaaaagcaaaucaagauauugcucaccuauuguuuuuuaaaaaaucaacaacaauaacaauaacacaacaacccaacaacaauaacccagcaaaaacccaaaccaauucaacaacccaacuccaauaaccccaacgacaauguaagaaaccaagcugaaaggaaacagugguauccuaacaguggaauggggcuuaacugaucucucuaaucaguaagucacucaguaugguacacacauucuugcccagaauaaccccagaccacugugucaucugggcucuugaaguggcuugaggaaaugugguuucuuuggacagacacauuucucucugucagaagccuuucccuggacaucacuuuucaguuuaccucagcuuccauggggacugcugucuaggacugaggugggaauaaccuaguugccacauuucuuuggugcguuucuugggaucuguuuuuuuuguuuguuuguuuguuuuguuuuguuuuuguuuuuuguaugguauauagauuacauaagucacggccucuuuuauguugucuccacagagauucccuaaauaccguuguuaauucaaaugcuuuauuuuuauguuaucaguuaggagaggaacacguccuuuaguuuuaaguuaaaguaaucuguggguugugagauauagcauagugguuaaggguuuaccugcuauucacuaggcuuuagguucaauccccagaaccaugggggaaccaugggauagugauguaauucauaguguucuuuagccucauccuuauaccgcuguucuuguccaggauagaccugcuguggaagaucacagguuucauuguuugugaacugucuucuggaaugugauucaucucauugucucuguuggacaaaaguaccuagauccagguguucaguauagcccauuacugauuuugguuauucacuuauucucagcauacccaaaugucagaaggaauucuguggaucagauguguguacugagaagcugcaaggcaguuuaaccucuuucagauuaauggauccucggauuucuccucuagaucuuuaacgccucaaaggaguuguccgacacugcugccuaccagucugugcgcaucuucucugucucccucauccaaucagaggaggaguuggaugaccuuacugagguugaccugucaugguccaagcccaccgcagguacgugagugccucagcaugccuuccuuuaggcaauggcuuagugacuuaaguagaaccuguagccccugaauuugguucuacuuauuauuacagaaguauuuuuuuucccuuugaauuuccacuccauuccugaugaucacuguuagauuuuucuucgcaagaacccagccugaaucuucuccacugaguucaggaaaugguacuuccuuuuccuuuuccuuuuccuuuuccuuuuccuuuucccuuuccccuuuccccuuuccccuuuccccuuuccccuuuccccuuuccccuuuccccuuuccccuuuccccuuuccccuuuccccuuuccccuuuccccuuuccccuuuccccuuuccccuuuccccuuuccccuuuccccuuuccccuuuccccuuuccuuuccuuuccuuuccuuuccuuuccuuuccuuuccuuuccuuuccuuuccuuuccuuuccuuuccuuucccuuuuuccuuucccuuuccuuuccuuuccuuuccuuuccuuuccuuucuuuucuuuucuuuucuuuucuuuucuuuucuuuucuuucuuucuuuuuuuuuuuuuuuugagaacaguauggaugcuguucaacaugaggugggucugggucuucuuccaucaugguaacccucuguguucccccacuccccugccugugucugaggacgucucacuguccucuccgagugaaccaagaucugcuccagcuccucucagggccuccugucuucccucgggcuuuacucuccauuucucucucugagagaaacacagaauccguauuucauggcucugccuccucuacagcaggcugugcacuaguccaaggacaccgcagcaaguagacagacacacagugccugcugugaagguucagccuuguucuuuauuuccacaaaacaagacaaaggcaaauacaaccagcccccuucucagcaagcgucaucacuggccucacaguauguggaauaucuuuuguuucauucuucuccugccccccacaggguucacucuuuuuguuuuggucuguuuuuccuaccuccccucuccuccccuccccuccccuccccuccccuccccuccccuccccuccccuccccucccucccucccucccucccucccucccucccucccuuccuuccuuccuuccuuccuuccuuccuuccuuccuacagauuaggcuggccucaaauuuaagagauuauucgcccgucuuuaccuacaaagugcuaggaauaaaggggauuaaaggggauuagaggcagauaucaccaucacuacuaccugggaaaacauaguucacucuguagguaaaggcuugccauguaagcaccagaaccugaauucagaaccccagcacucauuuaaaaggcagaugugacagcauauaucuguaauuccaucacaggggaggcagagacaaagugaucucuggggguuacuggccagccagccuagcugaauaaauagugagaggcaauuuuaaagugaaugaaugaaugaaugaaugaaugagguagaggaugauagaggaagacaccugacuuuguccucugguuuccacauaugugcacauacauacuugcacaucuugacaaauacaugcacgcgugcaugcagacacauacuuuauguacaaauaaacaaguccuugucuauccucugguuuccuaaccacuuuuuauccuuuuaaguuaccuuucuccucuaccuacuaguuaguaggucuaccuuuagcuacucacagccaccuaacaauaacauacacauguuuccuaugauauuagagacacaguuaugaaugcgaugaagucccuccagaacuaauagaaauacuguucuauugcugugagauaccaugaccaaggcaaccuauagaagaugacauuuaauugggggcuuguuuacagcuucagagaguuaguccauuaucaucauggcaggagauguggccacagguaggcaugguacuggagauguagcugauagccacauccugauuuauaggugggggccgggagggagaaggagggggaaggagagagggugagaaggagggagggagggagggagcaaggaacggaggaugggaaugaaugagaaugggcuuggcagggacuuugaaaccucaaagcccacucuuaguggcauaccuucuacaacaaggccacaucuccuaaucuuugccaaacaguucaacuaacugauaacuaagcauucaaauauaugagccuauggggccccgucuuauucagaccaccacagagggaaacacugaacuucauauuacaggaagugauguaauagggcugcacagagagggaggaugucagucuaaaccaggcuuuggcugaacuucauugacuaguuuuucuuuguuguuaacuccagcuaaaacuuguucguaucccuuaagauacuguacuuugccauuuauuuuauuuagcucaucaguugaccuauucaguaagcuuuagaauuuaugaggagagacucuuugugucucuuucauugcuauaucucaaccacuguguaguucuggauacauaguaggugcucaguuaauucuaauuugucggaaauugauuugauuuucuccuauugcgcuucuuggguuuggauccuuuucaggacuaaacagagugccuccuguauaguagacuuuuacuaaguacuaauuugaauugaucccaucucuguguguauuucuaccuuccccuccccuugucaacuuccucuaguauggagcucacauacaccagcuuguguugguuccuggguaauaugaacaguugaaauaaauuagacuggugaaagcaaaacugguuaugguugcuguguuucccuuuuugcugcauuccucagcacuuauguguccauauuuucauuacuucagcuauggaauuuaucauaacaccacccagaaaaaaaacccccacaucuucuaccuacuggcugccucccuuaagugaguuaagggcggcagggaccuuacaggcuuuguaccacuuaucuacugaggaggacuuagaguuccugaauuccgaugcaccugagggccugggguucugcaaaaccugcugagaguuuuggaucccugauuauauaagcaaauuauuuauguucagacuacgacacaguuguuuccauuugccuccaugccagacugagagcucuugcuuccucauuauggcaaaaagcaguuugagcaaaugaaaaaaaaaacaaacaaacaaacaagcaaacugaagagcaaucaugggaaacugucacgaacacuguaauuuuccccuguggaaaagcuguuucuccuuuggggagcuuuggaagucacgcuuuauucugggcuguaucuuguaucuuagcccucaucuuacccugcaucugaaggucuuagaaaggagcccacugcuggcuccacucaugccacagccccaguuggcaccccucuucuuuucucuugacuuucccuauaacuguuucucugcacaggaaacuugggccauggaaauuucacuuacaugucugcggugugcuggcucuuugggcguuaccuguaugacacucugcaauaucccauuggguuggucuccuccaguuggggugggacguacauugaagucuggucaucuagaaggacacugaaagccuguggagucccuaauacaagggaugaaagaguuggucagcccgagauaaagcccaugaggaaugaauguaacagugaggaguccucauguccuuuuagguaagugugugcugaaugcccacauuuguucugaguaaauggauucaugcgcagggcaaguguugucgugagcaucuacagucaucugggaacaagucaagaggguuuuauauucguuuaacucaguaacagcaguagcuaagugcgugcugacagcuuucuauggaggguaccguucuagggucuuuauuugcacuaauucaucuaguuuuugaaacacaucccuaaaguguagauguugcugcuauuccauaguuagagacaccaagucccagagaagauucaggaccuggcuugugaacaggacuagucaaguaggccagacuggcuccaacgccuggguucuuccuagccacugugcucucuuuccucaaaaguaaacugccagacaggaagaaugacuguauaaguacauauuuaaaacuauguuagugugccugcuugggaaaagcugggugggaagaauauuucagaagagaaagaacuaguuagaaaaacaaacagacaaacaaauaccaaugcuauaugcaaauggagaugaauagguaugcucugugcucgugagcacugucuguuucacuuugggaagguuucuggaaggaggaggaggaggaagaggaggaggaggaggaggaggagaaaugggggguucuuaguacaguuuggguauuuggauaaagguuugccugggugugggugggauggagauauuaaguuuggagaaaaggauugacuuuuagcagaguaggagggaaagucauauccaguaugugauggggauuuucaagccagguccuucggaucuccacggaggggagugaaaccaauggagugggaaagugggaauucucaucuauagcuacugcaaagauaaaugcauauauguauuccacagagaagucugggaccauauccaaagcuaaaacagaauugguuuugacucaguaaugccauugcugggaauuuaucuugcaaaaaagaaguuaagcauguauauaaugguuuagcuacauggaaacucaucaugccauuacuccccaaagcagcacauuuaagcuagucugucugcugaguaguaguuagcugaauuuauugcuuguaaaucagcccucccucugacuuuaauggccuuaucuggaaacuggcguggcccacuguggacucacacagaacugauugcuacacuuucccugagaagaaccugguggaauuacaagacucuuccuacaguuucaagugucaugcaacagacuggauugccucuggguuacuucaaugugagguuuguccaagugaacguggguaggcugacugucuuaugauugcugacuuuguucaucuugcugauuucaggguugucccaucuguucgugugacuggaccgacaagacacuccguccuuuggaacgccaugauccauccacugcaaaacaugacuuugaaagggguggugugguaccagggugagcuugcucuuuauccauuggugucaguuagcuuuugcuguauagcaaagugccccaaggaguuaaugguuucaaaacccagugaguuuaucauuuuauuuagcucccuuuucucuggguuagcagggugguacucccaucugcugcuucagcuggggucuccgauuuguccuuggcuaccugcuaaguuaucuggugucuggaggacauaggauggcugacucucauauucaucaacuggggacagugugcuggacauugugauucucagguggccugaucuuuagcagguuggcucacacuuggaguucauuucuauugugguagaagaguuccaggaacaucuagagagagccaagcccaaagaccagcuuuagaagcuuccacuuuuguaccaugcuugcugaagccucugacaccugagggcauggaaggccacuaccucaggggauggaugugguagaagaagauggaggguauuuuaagaaaccacaccaaacuccucuaccaauuuugguguuuuuuugauuuuuguuuuuuuuuuuuaaaggagaguccaaugcggauuauaacagggaccuguacaccugcauguuuccugaacucauugaagacuggcgccagaccuuccacuacggcucccagggucagacagaucguuucuuuccauuuggguuuguccagguauguauucagaggauacauauucaguguuuggaguuuaugggcuuguguggagaguguggacuauguacaugucuguacugggauuugcagcccaacauuuguccaaacagcauguccuggcgcugagcuguauauuaauuucuaugaacuuacugaugagaugauuauaucuucaaaauguuaauaaauaacgaaucuuucuuauaaaagcaccccaguuucacuugaaagauuuuaaaaggcaaaacaaauacccaaacaaaaaccaaaucaaaaaacagucccaacuacuaccaccacaaagcuaagaccauugagaacucaagaaaaaaaagacuuuuguuugugcguaguuguuuuuuucucuucguauauuauuguaagccuuuuucaugccaauaaauauuauucuucaacaugauuugucaugauugcaaaguauucugaaauguggaugcauuguaacauacuuaaaugaguucuuaauggauggguacuaagugguuuucguuauuuugcuuuuacaaaccguggcauguuauuuuccugacagcagauuucuuguagucuaauuauugccguaagauaaauucccagaaauggaauugcugggucaaaagauaaaaccuucucaaaggcuuugucaaauccccauuuuuuuuuguuaaaauuaugaauuugcauaacugugccuuuagcaacuguguguaagaauggggacggucccauguugaacaggguugugcauuuccuuggcugacucaggcuggcucugcugcauuguuagaccuacuaacuaacugauugaccaaacuaccauguuaucuccauacccuccagaauugaccauauuuauauguccuuuguuugaaacaauuuuucuuucuuacacuuuccuaggucuuugcuuggaucuaagggaacuacuugugauuauucaguauggguuaggugcccuuuccucagauaaucuuguaauaucuuaugcuuucguuuuguuuacaugugagucauauagguggcuauguuuuuuuggggucagguuuguauuccuaguauguaguugguuagcaucaaugauggcuuacaacacaauaugaaagaacacugucaggagaggaagcccugcaucugguuacaggcuagucagaaggauuguauguucauccuuagacaaaaggaauaaauacaugggccaaguucaaaauuaaauucaugaaauaucuaaugcuuagacuuucuagcugagugguaguucuugucuuuuauggaauaggaaauuacacaauuaagguguuaggaaaaaaacgcccaaccuucaguagaauggccacugucauggcuuagguauuacccugugaccauugcagauacuuucuauucacuacccucugucucuuguaccucauauauauauauauauauauaauuuuuuaaccauacuccuccuuaagaaggcuucuguguauauguguuugugugauguaugcuuauguguaauuuugugugugugguaugugcuuguaugguguguguguguguauauguguauuuauguggucugugucuguaugcuguguguuugcguggugugcauuuguguauauaccacagugugcauguagaagucagaggacaggcacccaguccucaucuuccuccuuguuuaagacaggguuucauugcuuaccacugcaaacaccaggcaagcgggucuacauguuucugggggacuuucuugugugggcuucccauuuuguuacagaaaugcugggauuacugaugugugccaccuauccuggcuuuauguagguuggguggaucugaacuugucuuaaugcuuuugugggaaauguguacugacccaucuccccggccacugugcccuguuucccagaaaggguuuuuguugacuuucuuccaccuagcauggcuuaaugacuuacuuucuuuuuuuacauguacuuguuguuugaaggugacuauguaguucguaugaaaaauaugcacuuggaugcauauaaccauggcaucuggucuuuuaaauuugacaguuugcagaagccucuuacccuuuagccuuaacuuuaucaccaacaaaaauaugcuaguuacuuuuuauauuaccauauguauuuauauaaguauguggauucaaagggaaacacccaauaugacaacucaagauagugugguacaaggucugggacuggaguuacacaucugggauuccuacucuuugagcuguguaauugugaacaaacaucuuucuuauuuuaaguauugcaugacuuaaucuaugugaaaacaugcugggugcuagcauuuauuauuguuguaagaagucaggacauuugcagggagagcugucuuguuaggaaagaugacagaugguguuugaaguaaugcagcggugagaucacaguuagaaauucaggacuggagcccauggaagagaccauggcugguggggcacucaagaguuacugauagacagguggcuggaagcaugagggaaggaagaucuggaggccggguuuaaaagggaucuuggaggaacagauugaaaacuucacuaguauuuguaacaucuuuugaaugugaccaguuuuguggguuuuuuuuguuuggcaguuacauaucuucauuagucuucguauuuguaagaagcaccaugggagguugaaccaagcuucuucgcaguacuucagauuaggaaaaaaacacaagcauuucauuuggguguggaguaugcuggugcccccacguggccagggugcagcagugccgucuggacaauuaagggaauucucagucaacugccauuuugaggaaaggacuuuuugacuuugagggucgauuguagugggucuuuguguugaacuuuaggcuguuucuagugacuuuguugguucguuccuauuaugucacuugcuggugacucggguuccacuugcaguccuugcauugaaagaagauggauuacucauuagaucucucucucucucucucucucucucucucucucucucuguguguguguguguguguguuggugcaggugcaugcacuuauauguagaagaccauaggacaacuuuggguaugguuggucaugugcuauccaucauuuuuugagaucaagucacucauuagccuggaauguggucucuguuuccacagugcugggaugugauuucuggugaucagacuuuccaugcaagcccuguauuggcugagcugucuccucagccuuauucuuuuaguuuuuaugagauucuggugugaagcacaguuugucauuuccuauguuaagacagauuugcaugcugaaucuuaacaagagaacuggaauguuccuuuaauucugugccauagucaaggcuguggcuugucacuguuucagcuuucuguuuuccuaaugucacacucgucacucacgaagcagaaaacaucuuuaaaguuucuucuggccaugugaugauaugaggcuuuuuuuuucuucugggcagcaggaugaguaagacuggauagaacagucuguguagcuucccugauggggucagacguuuugaaagagugucaaacgacaauuuggaugcuggccagacuguggucugauuuacuguuagaucguguuuguaagagagacagaaaguagguggaugucuuccauuggcuggaacuaggacugggaagaaggugcugucuaaaucaaagaacagugugcucguaggaaccaaaaaacuaagaaaguaagaaauagcaggaaauacugugucacaguaguuguaagguuuuuuuuuucuucuuuuuucauuugaucuuuuauuaugguauacuaguuauauauaaugauagguuucaucaggauauuuucuucauguacauaagcaauuuggucacauucaccccauuacucucucuuguccccucucccucuugcuaauccugcuucucuuuccagguagcuccucuucaugucauguguguguaugaguguguaugugugugaguguauacuugugugucuguccaugucccaaugcgguaucaugggugcagguuugcuuaucggagcuuggguaccuuaccaguagcuacaucacuggaggaaaugucucuccuuaucaacuguuaacuacauauaaauccucaguggaggagcagggguggggguaggaguccaugagccccucccacuuucaugauauuguugacaagcccagucuuuuacagcuuuuaugcagguaaucacagacauaaugaguugugaguuccaguauaacucacauauaauguaaggguauauguauccuuagauacacacauagaguguaucaucuuagaauucuuccuaaccugcuucaguauccacauggcuugcucucucuuguuuauuuuguucauuggcuauaucucuccucuggaaugugaucuuguaaaauuuuugccuuuuuuuuuuuuuugucuguguuagaaucagaaguuagugguccauuccucuaaagguauacccuuccuuugacuuuuacauucuucucugcuucuuccucaaugcucccugaccuuuggagggauucauacagucauugaauuuaugcuuggcauucaauagccauuuguucucaguacuuugacuaggucaagaaucuuccaggagccucuguucuuugcaggcuaaggggcauaucaacuuucagcaugaaguaguuagucuuacugcucacugucuagagucuagcacuuacccucacugcuccuucacuagccaagacucccauugacuuagugucucuuaucagagccuuccaaacccuccuugcuucuaccuugacucuuuaggacauucucagaguaucagucaagguuccaggguccccccucucccauuugaguggcagcugaugcuaacaaggccaaguaugcuuugcucccaucaccuccugaccuuacuucucaaugcucucuaccuauuccauuugacucauacuggccgccuaauuuuuuuuccuuacauacacuaggcguacucugacuuuaaguucuuuaauucuuuuuuuccugccugcaaaguguuuauuuucuauugcuacauaguacuauauuuagcagcuuaaaaccauccaacauauauuuauuuauuaucucgcaauucccaugagugugaugugagcugggacacagauggcuuagcuacagccucugcuugugguuacagaaauggugucuggcagagcuugagucuccucugagacuugggguucuuguuuaacucccaucauuguuggcaaaguuaauuuucuugaagcugcaauaggacuuauggcagucagauuucugaagggcagcagggccacuccauggcaccagaccuugucugaaaggcaucccugacuuggucaggcucaccaagcuucccuccuuuuuggugaucuugaagccaacugguuagcaacauuacaucugcaaaggcauucuuugccguguuacaggauguaaucauaggaguaacaucccauuaccauagucuguuagugagaagcaagcuucagguccccaucacaaaggauguaauaucauauaaggauauaagggucauauaaaggucagaguguaucaucuuaaaauucuuccuaacaugcuucaauagccacguagcuuacucucucucuuuguuguugucuuuguucagccccagaacucucucuuuucuauaauauauauguaauaugcauauuacauauaauauauauuuuucaguauaucuauuauuuucuugaugguaaagugaguuaucacuuuugucuuauuuuguucauuagucaugucucuccucuggaaugugaucuuguaaaaaauuugcaauuuuuuuucccuauucuaucuucuuggugagguuggugccugagucaaguaaacauuuguugagaggaugacugaauggacugacugauacuacccuagcuguugauccuucacaggcucuuucuggaacaauauuuucuguacauucugguugucuuuggugaguugcccuagauccccaaaaguuaauccaaauguuauugauucuaagcuaugcacguaaugcuuucucuugaguccuguguuugucuggcccuguugguuuguuuaauuucugagcauccuguucccauuauuacuccacuagggugcuugcauaugucuaugucuaugucuaugucuaugucuaugucuaugucuaugucuaugucuaugucuaugucuaugucuaugucuauguugucuauuucuauaaauauuaagccuuuugccaccguaaugaguuccugagacaagucaacuuaacaggagaacggcuuguuuuggucagauugcagucuguaucuaggugguccuguugucaucauuaugggguaugugucagagaagccuguucacuuuaugguaccuggagguugggggaagagacuggcaguuuaauauucacuuugaaaucaacuucccagugauuuaacuuccuccuaguaggccccaucucucaaagauacuuuuaccuccuuuccagcaccauggacuggggaccaauucuucaauaugcacuuuuguggguacucaaauucuaauucuaacaaacaucacaaugcuucaugggcagccaguuucucuguccagucaccaugcugucuuuacaauuuaccuuuacuaugucaagcaguuucagugacacucauugaacugagauuccuuuaaggcugaccauuuuaaaguucuccgcugagccacagggcucgguagccaccauauacucaguggcucccaucauucacagaaucaaacagcaacaggguucauacacuuggccagcuguccuuccaacuuugcauuucccucauaaccuccccugucccagguagacugcacccucucucaaaacagcaguucuucuucaagaacugcuucucaaaagaaacaguucuucauccaagcagggcuccuuggauaguuaguuucucauauguuuuuuuuuuugccuguguuuuuuuuuaaacuucuaaauauauuaugaggcaugccuuuguacaacgguaaucacugucuauuugaaauauaaacucaaauugcuguaccaccaauuuagcuuucaauccauaccauuuuauguaguuacaaauuuauuuuguuaugcucagaucugucccuccagcagagcuuuucagcuuuguaagcacugguaucagcuacauugacacuuccaaauuccaugguucagaauaaucuuuauguuauaguucacauaccagaggaacuggaguuugggugaucuuguuugugccugccagggcuccuuaaaauaccucuugggcuuaguuggagcucagcuccagaugaagcagaacugggcuuguuagauggacaguucuguucuacagcuguccuaauuaggguugcuauugcugugaugaaacaccaugacaauaaauaaauaaauaaauaaauaaauaaauaaaagcaaguuggagaaguaaagguuuaucuggcguacacuugcagaucauuguccaucauuggaggaagucaggacaggcacugauauggaguccauggagggaugcugcuuacugacuuccucagcuuuucuuauagaagccaggagcaccagcaaaggaaaggcaucagugacucugaggugggcccuccauuggucacuaguugagaaaaugccuuacagcuggaucucauggaggcauuucuucaacugaugcuccuuccucucugaugaugauagcuugucucaaguugacacucaaaaccagcugguauaacaguucucauccuugucuagagagcaguaggcuagcccagucaccuuccucuguugaugcugacagaaauauaagacacaaguagaaccagcacaggcuaggcacagacauauuaagcucagcuuccaaaaaggccaaagcaagccccaugguugaacuuggaaucagugggucgauaauagcaaagaacugcagucacauucgacagguguggcuauaaggagggaagaaaugagucuuuuugcgacuugccacauacaaaguggacuuuuuugcuucccuguagugccuagcccccugaugcacacccaucuaucaguuccuuauugcuuuguaacaaauuacccuggaucaguaguuuaaaauauuaucuauuuauaguccacggacuagcucaucuguguccuguguguuguaagacuugcuugugugaccauaguuuuuguuuuguucuuuuugagacuggguuucuguguauagccuuggccaucuuagaacucacucuguagaccaagcuggccucauucucagaggucugacugccucugccuccuaagaccuaugauuaaaggcgugugccaccauugccuggcuguguggccauaauuuaauuauaggauccagaauuaacaugacuggccccuuagcugguauuucuagcugucuccauaagcuauccaagguuuccucucuuuacaauuucuccaacagaguagcuggacauuuuuguccucucauggccaauacaugguuucaagagcaugaagccacaagcaguggucucugggaaaagacccagaagcugcauaaaaauccggccacauucaguugaucagcaaagcacagggccggccuggacugaguacauuguaaaagaccaugugguuguuggacacgacccugaacaaugugaaaugcucaggaaauacuugaauaaauguuuggacaaaacaguggagcagaagcaaagugucaaugagaggcauccagggguccaaagcaauaaaaaaugauagcauguuccucccuuccuuccuccuccucuuccuccucuguuuuuauuuauuuuuagcugucuucauacauguuaaagaacucaucggauuauggauuuccagagauccguuggcaucaaacugcagacuuuggccauguccccaacccgaagaugccuaauacuuuuauggcugucgcuauugaccucugugauagagacucacccuuuggaagguauggucgccucuucagcuuuagguugccugcgaauguucuugccuggagucuuucccuacgauguucgcuuguaaugggaugcauuagacuauggguuggagcuuagaugucaucuaugcuggaaugggcugcaguaaacacaaagcaaagcauaaauccuccacccccccaucccuccucucagaaacccugacuaguuaaccaaacaaaucccccucugcaccuaccuuaguguuugaugcaacaaagccagucaugcuuacgcuccguuaaaguaggucaauagacacguugcucacagauucacagcaaacgucuccaaacaguugggauguagcuccuuagcucugaguucaagcccuaguaccaucacuaaaaaaugagucuccaaguuuaucuuuuuuccaucauaacuucuaagucuuauaugggcaaguaagugcugucacccagaaguuacauauauuagugaagguuucuaugcaaaagaccgugaccaaaggcuacuuggauaagaaagguuuuauuuccguguacaguucuuauauuuuugguugugagccuagccuuuauggcugagcuaucucucuagccccuacauacaguucuacaucacaauuccaucaucaaauggaguuagggcagaaacuugggcaggacaggaaccuaguggcagaagcuaaugcagaggcuauguagaaacuugcugcuuacuggcuugcuccccauggcuugcuuagccugcuuucuuauagaacccaggacuaccagcccauggguggcucugcccacaugaaucaccaaacaagaaaauucauuacuggcuuuucuacaggccaaucugguaggagcauuuucucaacugagguucucuuuucuaaaaugacuuaagcugugucaagacaacauaaaacuagucagcacaccgcacaagucacucacuuacacugcaucauuaaacuaaaucaugaauauaagcaccuucagugagaguaggccaugggauucucacacagacucaggaaggguagcauuuuuguuaccaaugaauacugcuguaggauacaagacuucacaugugaaauggagccucauacaauuccuuuagauuauauagaagaaacuugguaauauuuauugaacaaguaaaaggcagacagacccaaaugaagaacaucccaguagagaagacuggcacacaguaugccuaacaguccaguccacucccuucuacuccauccuucuugcuccuuuuccaucuagcccugugcuguguugcuguaaaguucuaaacccacugaaggccagcgcuucaugucugguuagcacuuguucuuaaggucacuagccacugaucauugauuucagccaacuuuuauccuuuguuuccucuucuguuucucggucuuccucuuuccuucuuugccucccacuccccucuuuuuccuuuagcauuuugagacagaaucccacuguguugaccagacuggccuugaacuugugaucuuucugccucugccucauaauugcugugauuacaggcaugugccaccauacccagaaauucuuuccuccccuuucuccuucuccuuuaacuaacuaacuaacuaacuaacuaacuaacuaacuaacuaacuaacuagaagauuuuaggggccggagagaugccucagugguuaggaacauuugccauucuuccagaggcccucauuuugguccuuagaaugcaugguggcuccugucuguaacucuacuugcagaagaucugauacccucucuuggccuccacauaugcauaugcugcagacauacaugugggcaaaacuuucauacacauaaaaauaaguacaucuuugaagaauuauuuauuuuauccuugagugcucugaaugcucuccuuuaugugguugcuagcucaaagacacuauccacuuguuuuuuuauccuguaguauccacccucgagacaaacagacuguggccuaucgucugcacuugggugcucgagcuguggcauauggugagaaaaauuugaccuuucaaggaccacuaccuaagaagauagaacucuuggcuuccaauggccugcucaaccucacauaugaccaggaaauccaggugcaaaugcaagauaacaaaacauuugaggugagaauagcaggaggaaagccuuuugguacugagaggcucuuuccaucacugcggugugaugauacugguuggcugggguggugguaagcucaucucagagggccaaaugcacaacuacugaucauuuguuugcacaccaguuugauagugcaaccaaggaagggaaaauauuauuuuauuuauuauuagccccuaauaaaccauacuacuuuucuauauccuuucucagggcagccaccuuggcuuagagaauggccucauucguacuuuuaucuguaaaaauaucauugcucuaaaguaauccccuaaaccuugguugucucuuuuuuugcacugugcuaaaacugggaaguuuuaagaguuuagcaucuccuuugaaaagcuuaaguuuggugauucccagcuuagugugaguuaauguagcaagucugcuuucugccauuauccaguaggguucacuaguguggagcuggggccacuuauuagagagaugaauuagaaucuuuuauaguugaagguagagacauuccuagaugggagugucuuugggaacucggaggucaccagacuaggagacaauguauagaaagaggacacuggagcagaugugacaauagugacaggcagucuucaugcaguuuaggguugagguguccauacaccccagaugccuggucagugucuguccucugguuccuuccacagagguuuaaggugaacuuagagacugucaagaagggucuauguacugugcucuccccuuuguuagcugguggucugucuuuuaccuggcccuuuagucuuuggguccuggauugcuugcuuucuaacccuaaggguucaguggcuguggcugcuuuguguccucugaguaccuagcuccucugggaaugcuagagggccacagcuggguuccuaccucauguguucgugcuggcuuugcugucuggagggagggaccacuagagaaaugcucaggagucucugaauaccugacuauucuuccuugucucccucaauaaguuaguauuuuauuuaauugauuuuaauuauuuaacuacuugaauauuacaauuccuuuuuuugugcugggaucaaaccuagaaccuuauacacacuaggcauguguucuuccaagcuauuaucuguagcuuacaugaacaucuauuauuaacuuuuugcucugcaaacagacacagucugguacagguucuuauuacuguaggaaacuggucuuuggcucagaauggccuuauuuucuccccuugauaguauaucuggaagaggaguucccaguuuuuugguaccaucuaacuugccuggccuuucuguuuuucucuuauuagaucuccuguuguagugaccgucauugcaaauggcuuccagcuccuguuaacacuuucuccacccagacucugauuuuggaucucaaugcuugucuuggcacagugguugcuguucgcuaugccuggaccacauggccuugugaauauaagcaaugugcuguuuaccacaccagcaguauguugccagcuccucccuucauugcucaaauuucacacagggguaucuaaggacauuuggaguagugcucgcucuucuauacaagggcaaauccuuuaguuuggguaugcaggacuuuaaaagaugacugcuguuuuuagggcaaugggauaaaccccucauugaauagcucccagcuagcauauggccccuccaguauucugacauaagcacaggcuagcagauacuugaaaugcucaucucuguccucuaguuaaccuaagccucugugcuggucuaauucucaacuauaucacugggccuuacuagcauucacuuccuugguauuagugggaguaauaugcccuauucgugcccuucuucacuacucucggacuguggacucucggaccagcaagggacuuuaaaggcuguggaggcuggugcuuuguguguucuuuacaacccccugaaaacggcuaugcaaguuuccauguguuuccuucuguaaaacaaugcucuugucaaaccuuacuaccccaugacaggccuuucaggucgccucugacagaucauguguuuuuaucacuaggcucuccaaagcuguugucagccuaacucauacucuaaagggaaucugugcauauugccaugugcuaaggaguggccuuaaggaagaaagagggcccacugcagguucucaggcagaggguggggaaaucacaggcacagggacacgcggaaguagaugugcuuggggcaaauagcucuuuaaauguaagucuuaggucccugagguaaaaguucaacuaagccuaagccuaauucccacggaaggaagaaguuaggcugaaaguuacagaacaugcuuauagaccuacaggugauuuuguaguuuaccauuugguuaaagacagcugcuagcugugaaaagugcaccucuuagaaacuggaaauaaguccagcacgguagcauacacuaaucccagcacucaggagggcagaggugagcuguucuacagaaugagcucuaggauagcaaguuaccuagagaaacacagucuugauccuuccugccccacaaagaagaaaaaaaaaaaauuagcgaugcauccauuugccuuacacugugcccuugaagcaugggagaggaguguaacugucaccugugcacagcucuuuuguucuuugaugugagaaagugggaacugaagcaaugaggacuucccaccauucucugggggcucuggagccauuagaaacagcaagagagaugugucaggaguuuaccugguuaaacacaaagaaaacaccaaaaccuauacauucugcagaggccuuugaccucugagguguucuagccugcauuuaucuucuaaugcucucucugcaucuggcccccugagaacacaaaccuaggaaccaccagcuccugagaaaaaguaaaaucuaccugccuguccugccaacccguguuagucacgaugaccaaguagugaagaaccccaagcccaagguccuuaacaacucacaagugauaaaucuucuggauuguacaucagcgcaccacauccaauaacugguacauacagcauauacucugccacauuaguacauguguuaaugaagucguggaugagccaaacuuuuaguaguugaauaguuuaaaacauuguguggggauugugcacuucucuaaauggagagaguuuuaacugaaggagaaacagugcccugcugaacauuggcccggcuuguuuuguuuccuauagcauauguaaauaauauacauccuauacuugaaagcagcguuuccaguuugauguauuuuaguaggaugugaacuuucucuaauuauuuuacuuuaaaaagauguagguguugauugacuccuuaguuuuuuuguuuguuuucaauuuuuuucugagacuauauagcucugauugucuuggaacucacuauguggaccaggauggccuugaauucagcucccucuaccuccaaaguacucagauuaaaggcauggguuacugcacucagcaacuucauaaauguaggcagucagugcauuaagguuugcaguucaaaaguugugaaccugagauaauccacuggauuguacaucagugcaccacauuacucggcuguuuacagcagcacaucuaccggacuggaagaggagagaacacaggagaauggugcuccaaaccgguugugguuuuguaucaguuuacuagagcaugcuccuuuuauuauauaaaaagcaggggcuggugaucugauauuccuaacuagggucagaaucaaguauacugaauuuucagcaucuguguaugucaugaaucagcagcugccacggacucaacuuguuaauccuaaacccucugugauguuauaguuauagccucgggaggagaguaggucagaaugacucugcauagaauuaguuuccuuauaaaagggauccaagaacucccucccauuaugccgucauagcaagacagcaaucuaagaaccagggggcaagccaucaccagacaucuuggacuuugacuuccugggcccccaaacucuugaaagauaaauucacugucuauaagcuaccuggcuuauuguauuuuguuauagcagccgaacagacuaagugccuuuauaaagacuuaaguucaucucagggagagcuaaacaaaaaugaucauaucccgacuacaagaagaaacaaauaaccgaaacugccaggauauauuuauuacugaaaguacaagcaacugagguuuacccugggaacacccacaaugaaacguguaucuucccuguuucucagaugcugccuccuuccacagagugaguuuucguuuaaaacucauaaugaggagaaggcagggggcuccaccccuuuccuguucaaucugaagacugaauugggcuacacugggauggagauuucaggugcugcaggucagugucaaccaaggguucgugugucaggaacucuggcugguaagaugacacaaaggcuucaugcugaagcucagggagguccagggagccuggaaaaagagaauucuuuaauggaaccauugucugggaaucucaggccuauuuugcugggaugcauacacagccucuaauuccuuacacuuguaaaagccaacccuauuuugcccuuaguugguaaaauaagcaaacagcuauuuacuuuaaaaaaaaaaaaaaaaaaaagaauaacucuggugauuugucacacacacacauccugcaagacccuaauauuccuugagccccugaucacuuuccauuuaugagaaauaauccagacaucacagguagggccaaagccaccacugaucuuugacuucaccucaagucaaacccuccccguuuccaugcagugucacuuaagcuauagaaggaggcacugaaguuucgcagcauguucuguaacaugggagccccaggcuggcuucagaucucccuuacuccagucuauggcuggcucaguuacuaccuagcaacgugugaugaggauacagaaggcuaaagauggucaguuuucaaaccagaaaggcaaagauaccuggcagaauggaaucaucauggucaucaucaaacgucugugucuggaaggcuucaaggcucauaguugcaucauucucuggcaguuccugagagagcugccccuuccuggguuugcacgcaucaaauuucacccacugguaacugugaaccaaggggcaucauucuugacagcuguuuguuaguc

SEQ ID NO: 5015 - RNA, 8214 nt, Mus musculus
gccuuuauaaagacuuaaguucaucucagggagagcuaaacaaaaaugaucauaucccgacuacaagaagaaacaaauaaccgaaacugccaggauauauuuauuacugaaaguacaagcaacugagguuuacccugggaacacccacaaugaaacguguaucuucccuguuucucagaugcugccuccuuccacagagugaguuuucguuuaaaacucauaaugaggagaaggcagggggcuccaccccuuuccuguucaaucugaagacugaauugggcuacacugggauggagauuucaggugcugcaggucagugucaaccaaggguucgugugucaggaacucuggcugguaagaugacacaaaggcuucaugcugaagcucagggagguccagggagccuggaaaaagagaauucuuuaauggaaccauugucugggaaucucaggccuauuuugcugggaugcauacacagccucuaauuccuuacacuuguaaaagccaacccuauuuugcccuuaguugguaaaauaagcaaacagcuauuuacuuuaaaaaaaaaaaaaaaaaaaagaauaacucuggugauuugucacacacacacauccugcaagacccuaauauuccuugagccccugaucacuuuccauuuaugagaaauaauccagacaucacagguagggccaaagccaccacugaucuuugacuucaccucaagucaaacccuccccguuuccaugcagugucacuuaagcuauagaaggaggcacugaaguuucgcagcauguucuguaacaugggagccccaggcuggcuucagaucucccuuacuccagucuauggcuggcucaguuacuaccuagcaacgugugaugaggauacagaaggcuaaagauggucaguuuucaaaccagaaaggcaaagauaccuggcagaauggaaucaucauggucaucaucaaacgucugugucuggaaggcuucaaggcucauaguugcaucauucucuggcaguuccugagagagcugccccuuccuggguuugcacgcaucaaauuucacccacugguaacugugaaccaaggggcaucauucuugacagcuguuuguuaguccauaauaaauaacccuuucuaucaaagggaucagguuauuauucuuuuuaauuaggucuucucugcuauauacacaagaaacaccagcuaagaaaaacaacccaagcaaacuugaacaggcaagccucuggugacagacaacaguguuccugaguacacacagaaaaugguguaaguugagcagccuuaaccugagaauucaaaauacuccaaaacauccuuagcaauuaugaaaagcuauagauguguaauuguauaccucacaggauggucacaguuaaaaugaagugcacuaaacuacuauguccaggguauauauguaauguguacaucuggauuucuuguaacucuuaucugaagaccaggcuggcucugaauucagagauccaccugccucugcucccugagugggaauuuaagguaggcaccaccaugccugguucaccauauaaaguauuuagaaacccauaacuaguaaaccgcaucugaaacacuucucaucucaagcauuauggguaaggagcaaucacccuacuuaaagcacaccagguaacuggcuccuacucaccugucuagaugaguaagugggucaauguugcaacacacugguuaagaagcaagcauaccguugacacagaaaugcauaugccaacaagcaguagcugccaguuuugggcacucguuaguuggcaaguggguaccuaccaaugaaacaggcuugcucacacuuacuugacacaguuuugagcuucuggacaacucugaaucagguuguggaugguuggaugagaaaacccaaagaagucggcaccgcaugaaaguggguugggcaucaguuucccucugcaaaagagagagagcuuuaacuugacagcuuaggagaugaagacaggcuuaagacaugagcggauguuaccuuuaagcauuccuacuauacugggaggcuaguuacuaaggagucugaaggauauagcuuacuuagguuucuauaaagcagaucuccaggcacugagggaaaaggucucaacuguaccaauccuuuuaguguguucucaagcugguggccaacuuacguuguggcacugauggcccugagcaguucuucauaacaggcaucugcagaggagccgacgaugguauucugggggucaucuucaggaacaauuucaaacugaagugacagaggaacaauuaggucaauuugcaagggaggagaagagccacaugaugccuauaaacauccccaguguccagagcugaacugcagcacagccugcuaggagacgggcgcaggcgcuccuuauaaugcugcaaaagccaaaugcaaggacacaaucccaggacgucugguucuccacaucucugacuuuggccauggucagcccugaauuuugcuccauaccuuucuuuccgcuuauaucccuaaguaaauacaaaugguacuuuaaagaaaugagauacacugcucuaugcuauccucuauuucucugggaaacaaaagaguacuuauguauuuguuuuucuuuaucuuugucaauacuagauauuaauaaacuaaaguuacuccauguagggaaaaauucaagcugcauuuuuaucacaaaucauauuaauacguaagaauagaaucucguuuggugaccuaagaacauuauuauuaguaguaguaguauuuuaggguuuuuuuuuucuuuugucccuaagaagaaauuaagaaucauguugugaauuuucauuaaaauucuacugagacccugacugcuaauaaacugaacuuacagauguuaagacaugguacacugcacaaugcuaaguuuuccuauccguguacuuucuguggggcacugcugugugacugagaugaugucgaccagcucugccugccagagcuccaacagagaugcacuaucccacauaggcaguguagcuccuccuccuacucaaggguccuuacucugcuuucagcucagauuucuugauugggcgcuuuuucagaaagugagccaagcaagccugagauugcuguuuuugccugaggguccuuguaucuuaaugugaagcaacaauauaccaaauaaucuuuccuguaugaacucgcacauacccuaagcuucaccguuacauugugugucauagaaauacuaugguuuaaggagaagacaacaccuagagaauuaaacacagauucguaccccaggucaaacacacagaaaaguacaggugugacaggcuagccaguuuuccugcaucucuguguuguauaaauggugagcagaguaucuuaaaguaugucagaauuagccacauagcuaaaaagccaggggucaaggagguucuccaaacagcaagaaaaaacagaaccaagaaaggaaaauaagaaucauaaugcagugaguaccugaggcuguacaccgccguccuugaucugacagguauacagacacuucuggucugggcacuucaugcuagcauacacucggguacugcaguagcccacaggauagauggcauucucaucauggaagccaggucgguuggugaugaucuauaaaagauuccuuaaucuggaacuuaaggcuuuagagcccaguuuacuaugguagccuuuagaggaacuuuggggcugacaaagagugauacaacaaacauagaaggugauggcugugagaagagaaaacugaccugguuuggaagggacuagagauuuucuggggucaguauggaucaacaaaggggugcugccagugggaacagggaaaggcucaaccccacucucaugguucucauuagccuggccauaugcuggucucacucaccucccccagacuguauacugucagacccccuaguccgauggggaacacaggcuguccugaaggauccagggcaaugggucgaaccaguuuucgagcaccucccuccauuuucuuuuucuuggauguuuucuucagaacugaaacgaaaaucuggggucacccacuuaggucucuuccagugccaagggguagggaaauuuacacaugaaugauaaagguagaaagccaaucuugauugauauggaugcucuuugugaugggauuuuauuccauaagcccaagguaagucgaaaauacaguauguuaaugcgugugauauaccuaacuuaacaaacaucaggcaacugaguacacuguggagugucaaguaucacuacaaaugugggucugugugggagcuauggcuucacaccauuagcuaauauuacugauauuacacugcguaucacuguucuaagauaagaacaaaaccaaaaguccgauuuuuauugaaugcacccugcuuuucuuuuuuucuuuuuugguuuuucaagacaggguuucucuguguagcccuggcuguucuggaacucacuuuguagaccaggcuggccucaaacucagaaaucugccugccucugccucccgagugcuuggauuaaaggcgugcaccaccacgccuggcugcacccugcuuuuuauaacauuguaaaggugagaaaaucucuaaguugaacaucuggcuguaggugagguaucaucuguauucacgaaauagccaucugggccuuucccccaaagcccaaguaucuaacuugccuacaaaccaguuuaauaugcugcuuacauaucuuaagaacuuuuaaguucucuucaacuguagaagcagcugagcuagcagcguguugagaaggcuggcuugcucauuucccugccccuaggaaagccugcagugaauacaguccagagagcaggggcacaaaacgaggggcagaggccucaagccugcuuauccucaucugucacgucuaaucagaaucucuccaaagcagcuccaaugagacacuugcuucucaagggacuucagggggugcuaugaaacacaagcggcuacuuguuacucagucagaaccaguuaguucuaccaggccuuugcuaucaguagagccuccgaggccacugcuacacuaucuucuuaaaauaccuuccaguuugcuguucuccuugcccuuuucuuucuucuccuucuuggauuucuucgcaaaugguuccucggccccagugcugggcccggcucccugcauaguucccacagagcuggugacaccauaaggcaggggcaaacuggagcugugggaaggagcagcggccuguggcuccccuucaguuagagcauguaucuggaggagcuucuucagcaaguaucugagguggagagggaugggaggacaggcaugaacucuggcuuuucucucaauucaacguuucgcuuaagcagugggaauuacagacuaaauacaaagauuaucacacaauaaggcucuuauuggagacagaggccaugaagcccugcaggauaaucaauacuugaagaaaucaagauauuggcuggaacuucucuugucccugcagggaucuucuaccuuuaggguggaaggccugaggugucuggagaauauucauacgaauagaaucagagguauccauauacccacuguaauuugcauagggaaaaacaaagccaauauuaguagaaugagaaacagugguuuuuuuuuuuuuuuuaaaucaucccuugguuuucauaauugggaaguuauuugggugggauauagcacacagguuuagaauuccucuguauugccucaaguggucaaggggcuuugcgaugugcaggaauccagaggagagggaaaaaaaaaaucagccaccauaauaauaucaauccacagcaccaguaauaaugaugacaaugauaaucacagcaacagcaaaaugaagcuggcucaccuucuuucuuccuuugcuuuaagaaauuuuuccucaagacgagcaauuucaucacagauggaagcauuuuccuuuaaggaagaaaaaaaaaaaaaggacuauaaucacauaaaaugaacuuaaaacuugaggcuccuuucuggugacaagaucuauaucucagauugaaagagcccucugugcugcaguguguaagagaagugugguucuacucugcgcaugcuguuaauaaauacagagucuguacagcuggcucagcggggaaaggcaccgaaucggagccccagaacccacaguggaaggagaggaaugaaugacaguuaccugauaacuucuaugcgugcucggcggcacacacacaguaauaagaauaaaaagaaagaaacuucuuuuaaaaaaaaaucugcagggccaaguguuuggguucuauuacagggaggguaauugcauggacaccuuuggaugaagagggacauucuuaaugcucaugccagaacaagaugguacaccagggcuugcacucuuugggcaaaucaauggguguggccacuccaauuaguguggccuuuggcagagaaaggauauaggacuuggacuuaauuuagacccccuacaaaauucuuuuuuguucuccacuacagaauucuaaagacucucuaugcuuacagcuuugaccuugcaaagacaaucugacccacuguaucuuacagaacaauuacagggagagagagagagagagagagagagagagagagagagagagagagagagggagggagggagggagggggaggggaggggaggggaggaggggaggggagagaagagaaaaggaugaaaaguuuugcauguaaaauucuuaauuaaucaucuauuugcauauacccaaguaccaucauucuuuacugauggcucagucugucuugaaaccaguuuugaaggaaaugccuauuuggguguuucacagguggagccucaaauugguguucaaggcaucaguugguuuaaguacacggagacccuuugguuucauaagaucuuuguauacuuaacgaaaccaacacuaucuuuaaaugucgacuuguaagcauuaggcaggcucugacaucaugugacaagagagaacagugaguauaagguguugacuuccugauuuacucauauuucccucgacacauauacaagcguuaaauguuuuagcaacaacaaauugaaagucaaaacuuuucccgauacgucuacaaagaccuuguagaaagaaguguuaaacugcagguucagaugugaggguauauggaccguauaccuauuaccaagcaagcacugaggugacuggcuaagcuagaauagucuauuuauuagacuguuaucagauuuauuagacccuaauacuucuuggcugguaaagaaguuuacucaucaaauccuaaaucccuacaauuaaagcaggaagugucuauacaccucagcaggaggagguagccuguuuccugauguugaguuccacuuucaguuucggauggagggaaggcagaaacaccuagaagccucgucaaagggagcuacaaccaggacaauuuugaaagauuuaggugccuguuuacgaaagcggcagccauggcguuaggguuggguguacuuaggaaacaggcuguguagaguaaauaauaaacuggaaucaggguauccaaguuggaguuagggcacgucaucccucugggcuucauuucagugugcucgccuuaaaagacacuccuuaggcucgaaacgaaaaguagcaagaagguaaugacuaaaguuugcuggcggagcacucuucaguccucauuuauagaggaguugacaggacuagaggaauaacuuaugcaaggauauggaacuaauauucccaagcgaggcaacuaacacuggacggauauucuuucucugagagaguugagguggggaagacaguccccacccaaacccagacucacaaacaccguggccuuagcugcucugcgcagccgcagguacuucagccgguacuucucguucuggcucuuccucgggagccuuuucauccuggccuugcuggacagcggggugcgcggcucggaggccaggccgcucaacacgcucaugaucagaccggguucuggagcuccggggcgcggaggggauggagcgcaggcagaaacagauggcgauccucggcacuucccagucgauuucccaaggaagacccgccggaaguugcgcaaaagcaccgccacguguaacuuccggguuuggaaguugcggugguucgga

SEQ ID NO: 5016 - RNA, 820 nt, Mus musculus
gggggauuuaaaugcacuuuauuuuuagacaacccacaugacauguuuuuguuuuuuuuuuuuuuuccuuaaaaaacaaugccaccacuccaaauaaaucacggucaaaauaaaagcucaagaugacaucugucccauucguccuaaguccugguguuguauggaugguaagcagcagccaauuauggugacaggugauagauccaauuuguuaacauuucuccaucucuaagccauccuuaaagaaaaucaugaauggacucacaccaucuucacgguaguccaggagagcaaccauaccaucuggauucauguuuucaccaauaaaaaacugguaguuauugaaauuagcaaggaugugcuuaaucugcuuugcagcuccaguuauaaaaggcuuuacucuuucugguuucugcucuucaaguuugcccuugagugauuucauguagucuuugauguacuuuuuguaggccucuuuugugaagcugguuucuuguaagugaugguucaugacaaugucaacaccggugacuacugugcuuucgguaccuucacccuccagaccuucagcggaagcauuuccaccgaugagcgagucaucgauggcacccucuguucuacugaccaucuugcccuccaccuccaggcacagcccauucgcgaucucccgaaucuuguagaugucggaaaacagcucaucauggcugaugaggucccaguagaugaucauggugacggcuggggacugugcugaggacuguggcgcuagccuaaaagcacagaagcgagcgcggugcagccggagcggcgcggggggggg

SEQ ID NO: 5017 - RNA, 953 nt, Mus musculus
acuauggcagucccagugauucacucacugugagucuccucaguguucucuuuagagcaagcuugacuuccuuauucuugagacuguaaauaaagggauucagcaaaggcaccaaaaauguacaaaauagacaaaaaaaauuccccugauucacagauucaucagaugauguuuugacauguguaagcauagcaaauccauaaaauaggacaacagucauuaugugagaacuacaggugcucauggcuuuggacaaacccuuaccugauaacugagugauauuaaaaagaaucaaagcauaggagguuaagaugagaaagcuagaugcaagaacuacugugcuuacaaaaacagaacucacaagcucauuggcauagaugcugcugcaggagagcuggagaagggggaagauaucauacauguaaugguugaugauguuugaaccacaaaaguugagccugaucauacacccuguauggacaauugcaccaauaccucccaucaaguaugaaccaaacaucaucagggaacaugucauaggagacgugaugaucauguacagcagggguugacagauggcaacauagugaucauaguccauggcugucaccaaauagcacucugaauuggcaaaaaggcacaugaaaaacagcugugucaugcauccuguaaaauaaauuauguucuucucuaagacaaaacucauuaguguuuugggaguaaaggcaaaugaauagcacaaaucaauaaaagacagauugaagagaaaaaagugcauaggugucugaagguuugaauugcagcaaauaagacucauuaaacucaaguuucccaccacagugauuaaacaguucaccaagaacaggaaaaacaggggcaucuggaguucagguugcucugucaguccagugagaauaaacucagucacagaauagugauuccccguugccauu

SEQ ID NO: 5018 - RNA, 934 nt, Mus musculus
aucaaacacucugcgugcuaaauguuuuuuucagggcaauuuucacaucuuuguuccucaaacuauagauuaagggauucaucauaggcaccaauaugguauaaaaaaccgaagaccuuuuucccugauccauagacucaggugaagaggguugaagauacaugaaugcgccugaaccaaagaauaaagaaacagcaacuaugugggaacugcaggugcugaaggcuuuggaucugcccucaguagaucucauuuggaagauguuagagagaacgaagccauaagaaguaaaaaugauaauacugggaacaaugauaucaauuccaccuacaauaauaaucucaaucucauuggcauagguguugguacaggagagcugcaauaagggaguagaucacagaaauagugguugauaaugcuccugucacagaaggucagucuaagcauccauccagugugaaucauggcaccagaaaaucccauuauguaugaaccaagcauaagauaggaacaaaccuugggagacauagcaauguuauacaagaguggauugcauauggccacauaacgaucauaggccauugaugacagaacacaacauucacuaacagcaaaaaaaacaaauaaauagagcugggucauacauccuacauaggagauaaaguucuuccuuacuaagaaguucaucagcauuuuggguguaauuacagaugaauaacaaaggucaaugaaagacaaguuuaaaaggaaaaaguacaugggggugugaaggugagaauucagugcaauuaaagugaucaaggacaaauuccccagugcuguuguuguguauauuagcagaaagaguaagaacagggguaacuggagaucaggaucacuugucaaucccugcagaaugaauucggucaccaaugaaccauucuccacacccauu

SEQ ID NO: 5019 - RNA, 2361 nt, Mus musculus
uuuaugaugaaaauauucuccuguucaaagucuuucucagggcagcuuuaacaucuuuguuccucaagcuguaaauuaaaggguucaucaugggaaccacaaugguauaaaaaagagaagagaauuuccccuuauugauagauagagcugagguagguuuaagauacaugaaugcaccugauccaaagaagagagaaacagcaagcauaugggaacugcaggugcugaaagcuuuagaccugcuuucaguggauuuuauuuugagaacacugaagaggaugaagccauaagagauaaagaugaugauaguggguacaauuaugucuuuuccugcuacaaugaacagcucuaucucauugauauaggugcugguacaggagauuugcagcaaagggaggagaucacaaaaauagugguugaugguauuuccaucacaaaaugucagucuuagaauacauccaguguguaucauggcaccagaaaaucccaugaaauacgaaccaagcaucagauaacaacauaccuuagaagacaagguaacauuauacaacaguggauugcagauugccacauagcgaucauaggccauugaggucagcacauaacacucagaaaugacaaaaaagcaaaagaaguauaacuggaucauacacccuguauaagagauaauauucuuuuuuuguauaaagcucaucagcauuuuggguguaaucacagaagaauaacagagaucaaugaaagacaaguuaaacaagagaaaguacauggguguguggaggugagaauuuagcccaauuaaaaugaucaaggucaaauuucccaacacaguuaucauguauccuacaaaaaagaguaggaaaaauggaauuuugaggucagguuggucuguuauccccaagagaaugaauucaauuaccauagaagcauuuucaaaagucauucuucucucagagaaucuguggagacaaagaaaaugaaugaaaauggucaguuucuuguuugucaauaaacaaauagcuucaaauucuuugaaccagccuuucaugauacuaugguacagaucaacauugucuuccucuaguagcaucacagagguuaauuauaguaaaaagcgucaccaauauaccacagcuuuaaccagugaccuaauauugcuaauauuauauuauuuaauacuugaaaauucaaaggcaaagggcaaauuggauguauaggaacuaauugcccuucuuuuuucucauccuuuauuacuaccgucuauucuucauucagggaaaaauuuuagcaaucuacuggugaccuuucucuagacuggucuucagcauacaguauuuccaauaucaagcaaaagaaaccaacuccucaauuggauauaccuacauacauacauacauagauacauacaucaauuggauauauauauccauauauauauauauauauacauagcuaguucacaaaauuucauaaaucuaaagaaauuggccucucuuaucgaaauucauaaaucuagaauauuuuucuguugauuucucuugaaccuuagacuugcucauaacauuacagauuuuggggcucuuuuucacaauaaagccacuaugaaaacuaaaauccaaagaaaacauuagaagaaauacuaaaucaucuaugugaagucaaauagcaauuauaaucaccuagagggaagaauaauguuggaugcuggagcuacuggaaaugaaaauggcccaagaggaagaaaauucaaucuugcgaaguaaaaagaguuuggaaaucuaauguucaaccuguuaacuucaauaaauggugaauuaguaacagaauccaccugaaauuaccuuauugcagguauauuuacacaaaaacccaaguauagagaaaaggcauaugugaaugagccucaauacuuggucauuucaaaaaggauauguggucaaaacaaauaauauacaacauaaacccuucuauacaauaauuauuucucaguaaauguauucaagaaaauguaagcuuuuaauaugaauagauuuuagaacuuacccuauuuaagagagaaaucuuaucgguccuuuucauugguacuuguuccuuuuacucuggaaaaaaacaucagacuccaaagcacugggucuuugcauucuaaaagaauccugcauaaaauuacuuucuugugugcucuggauaucuuuucgaaucacuguuuauguuuaacaauuauaguccuaauucucuaaagaaauuuagcuuucauuuuaauuauauuugcuuccuaaaaagagacauugggcauuuuauaugcuuuaauugcauguuaaacaucauaaggaagacagaaacuuuuuuagcuucuccccaggaaac

SEQ ID NO: 5020 - RNA, 2341 nt, Mus musculus
aauuucagcugcaucuauuccuaacaauuggcacaagaucauaaagacaguucuugaagucuuauuauuuaauguuuacuuuauguccaaccauugucaauacacucgggcccacauuuccauugguucagggucuagccugcagcugcucaggcauucacaaaaaauuauaaaaugugcuuucugcuccuuucauaaagagcucagacagauagcauuuaaugagugacucugugauuaacaugagaaugaaacaaugaagaacucuaagugggagccuaauggguaaaacaagaaguuaagaaaaaaacuagaguaggucggcauucauucaguaguuaaggaugaaagaaagcaaacaguagccuccagcugcauauauagcagaggauggucuuagccagcgucaaugggaggagaagcccuugguccugugaaggcuccaggccccaauguaguggaaugccagggcagugagaugggaauagguggguggaugggggaacaccuucauagaagcagggguagggggauaguacaggggguuugcagaggggaaacgaggaaaggggauaacauuagaaauaaaauaaauaaaauagccaauaaaaaaaagagaaaagaaagcaagugauaugcaauagauuuuuuuucuaaguccaagaguagaucucacauagaaaggguagacaaauaaauacucuguguuuauuuguuggcuucuuguaagugagaauugcugaggacuauguucuggagagaugacauauuucugcaucuuggacacauguagcagggcuauguuucaugcugauaucacuuaagugcaugucauuuggaaaguaauaucuuugcaggaaaauaaaauuaauuauaccuucucuuugcaagguucaucuucaucccaguuuguuguucuuggacuagaagaauggguugcacaaagugacuccuaucuauuuuagcaaauuaaccucucagcucacaucagcugacuugagggaaacugaacuguuuaauuuuuuuuuuucagauagacucuagcucucuuuuuaucaaagcagauggccaggaugaguugauggaugugguggcccaaguucaguuugauagugagaugagcauuuauagauucuaugauugugugugagaaaaggaaguauuauaaucuuuuaaaaaauauuuuccauuauaggaaggcacauuaagggcagugcuuuguccagguucuaauaacaaaauaaaccuuacauccauugacaagauaacagcauagaauugaauguuaaaaccgagauucagaggucauuguugauugaaaugggaugcaggaacaauguuuccuaagacacuagcucccagccuuguccaagggacaccaaacuccugaccacacaaacacugaagagucuuuaaaaacucuucuguuaaaguugguaauuuaucuccacuaauacuuuguuaaaagaaacgguguagagauuaacagaauaauuuuauuucagauuuuacuaauguaguguguagcuacaacuugacauucaagggaagauuagacuucuguuuugaaaguuuuccaucagguaauuucagugguuucauuuuagaaauguguuuacuguuuauuugcagauguuugacaaagggaauauuacuaaaaaagaaaacaaaaaaaauacuuaucaaaugaagaauuguuagaaaaaauuacauucuuugcuaaagaaaguuugguuagucuuagagguagguauuugcuuucuagaacuuguuuuuguugauagcuguaugcauggaacauguuuguuaugcaagguguaagucuuucauuacacuuguaagauacauuauauuguuuagggaucaagaaaguaacauaaugcugaaguaaauauaguauguaguuccuauugugaacaaugcuuuguuucuguaauguaugaaaaaaaacaucacuaaaaaaaaaccucuucuauaaagugaagcaauuucagaaguaugccucagcacucuccagucauacuuucacaccccuccauaaacauguuaggaaaccauuaucuuguuuggaauuugauccaugugcuuuguuuuacaguccagcgaaagcaaagcugaguguggacaaacuugaaaccaacacaugguuauuagagacaaaaccuuaugaagaaaaugcauccucaaagggaaagaauuaagugauauuaguuccagcaaugacuacccucccacuccaccccaaucaaaaugcugacaaaacauauugcuuauuucuggaaaacauuucucaggcauuuucaaucuauaucaugaugacaaauuaacaauauaggaacua

SEQ ID NO: 5021 - RNA, 1070 nt, Mus musculus
agggaauuauuuacuucuaacauuucccuaucucugcucaagaaaauaauuuucucuucagaguuuucuucagagcaacuuugacauccuuauuccuuaagcuguagaucaagggauucagcaugggcccgacauuuguguaaaauaccgaggccacuuuucccuuguccauagacucuacaucagaagguugcauguacauaaaugcugcugcuccaaagaagagugagacagucauuaugugagaacugcagguguugaaggcuuuagcccugcccuguguggagcugaugcguaagauguuagcaaugaugaaaccauaggagauaaaagugguacugguagacaccacaauguucaugccaaccagaacaaagaccacaaccucauuguuguaagugcuggugcaggaaagcuggagcacagggaggaugucacacagauaaugauugacaagguuggcaucacagaaggucagucuugccaugcaaaguguaugggccagggauccccagcaucccaucacauaugccccaaacacgaacacagcacagauccggggggauaauauaacauuauauagcaguggcuugcaaauagcaacauaacggucauaugccauugcagucaguagauaacauucuguaaugacgaaaaagcagaagaaguagaguugagucaagcagccuguauaggagaugguguucuucucuacuacaaaauuaauuagcauuuuggggguaaagacagaagaguaacaaauaucuacaaaugacagguuaaagaggaaauaauacaugggugugugaagguguguauucaaugaaaucaguguaauuaagcccagauuugccacuauaguaaccacauagauuccuagaaacagaaaaaacagaggcauuuggaguucuggccgauuaguuaagcccuccaggauaaauucugucaccagggaguaauuuccaugugucauucuucuguagaucuucaucuacacagguaaaaaaagaaauaauuaacacaauauugaacuuaccuaagaaauuucccauccaugcucugaacucugu

SEQ ID NO: 5022 - RNA, 1057 nt, Mus musculus
agccaaguaaaaguggcauaccuccucugauguacacaugaaguguucaugacuggucauucauuacaacugcucaggagcaaaggcagguuuacguaagaccuuccacagugaugcuuucaccucuuuauuccugagacuguagauuaauggguuuagcauaggagugaccagauuauuuaagaccugcacaguugcauccagccaagggcuuggaguuggucuuaaguauaugaggacaacuggcauguagaaaagcaagauggcagugaggugggcacugcagguggagaaggcucuacgacggcccucagcagaucggaucugcagaauagagcagacgaugcagcuguaggaggugaggaugaggaggaaacaacugagcggcaucaggcccacacugaugaaccccaccaucuccagggcugaugugucugcacaagccaguuuuagcaucacagggauaucacagaaguaguaguccaccucauugggaccacaguagggcaacuggaaggugagaguggucagaaaaguagccugaaugcagccaaaaaaggauguccccguggccaggaucgcacaaacucugugacucauaauuauugaguagcguaauggguagcauauggccacaaaacggucauaugccaucacuguguacaggaaacacucgguacaaccaaggaaaugguagaagaagagcuggcucacacagccugcauaggagauggcucugcuguuuccugagagguagaacagcaucuugggagaacucacagaagggaaaaauaugucaaaaauagacaauuuacauaggaagaaguacauggggguaugaagccgacuggaggagauaauugccaguaagauuaauaaguuucccaucagagugaagauguagaaagacaaaaacaggacaaagagcauaguuuccagacccucuguguuugggaugccgagcaggauaaacugagucacuacggaacgauuccucauagcuuugagacuaucugacuucaaagggauucaaacucaccagucugaacaccagcau

SEQ ID NO: 5023 - RNA, 1246 nt, Mus musculus
aucugcaucuacaauuaagagccuaacugaagaaaaaaaucccaucaccaggaaagacaguuuugacuagacaucucuagguaaauaucagcauccuuuucuuucuuccaccccuguaauuuaaacuccucuaauccacacacauaauaaaugucaccaagaauuucuuuccacagacucccaggagcugauucauccaugaacaugacaaacaacacuauggugacagaauucaccuugcugggcaucccugagacagagggccuggagaauguccuacucuuccuguucucaacauuauaugccugugccuugcugggaaacuugcuccuucuuacugcagucaccuccuccccacgacuccacacacccauguacuuuuucuugagcaaccucucuaucucugacaugggcuucuguuccacuacagcucccaagauguugucauaucucucaggaagggguggggggauuucuuuccagggauguguuguacaacauuucuucuaucauuguauuggaugcguuuugugcuuccuguacacagugauggccuaugaucgcuuuguugccauaugcuucccuuugagauacacaaucaucaugaaccacagaguaugcugugucuuggccacagggaccuggaugaguggcugugugcaugccaccauccuaacuugccucacuuuccaguugcccuacuguggccccagugaggugaguuauuacuucugugacaugccugcaguguuacugcuagccugugaagauuccucucuagcacagaggguagguuucacaaauguuggucuuuuaucucucauuuguuucuuucucauuguuguguccuacacucgaauugggaucuccaucucaaaaauccgcucaacagaaggcaggcagagagcguucuccaccugcagugcucaccucacagccaucaugugugucuauggaccagucaucgucaucuaccuacagcccaaccccagcccauugcuuagugcaauuauucagauuuucaacaaucuugugacacccaccaucaacccauugaucuacagccugaggaacaaggaugugaaagcagcccugaggcauguauuucuuaagagaugucuuagccuggaaguaaaugaaaacaucuaaguguuugcuuaacaaaguaugaauuacccuuuauaaggacagauuuauaucuacuacuuaguucauaggaccaguggcauuucuaacuuccaaggca

SEQ ID NO: 5024 - RNA, 1246 nt, Mus musculus
ugccuuggaaguuagaaaugccacugguccuaugaacuaaguaguagauauaaaucuguccuuauaaaggguaauucauacuuuguuaagcaaacacuuagauguuuucauuuacuuccaggcuaagacaucucuuaagaaauacaugccucagggcugcuuucacauccuuguuccucaggcuguagaucaauggguugauggugggugucacaagauuguugaaaaucugaauaauugcacuaagcaaugggcugggguugggcuguagguagaugacgaugacugguccauagacacacaugauggcugugaggugagcacugcagguggagaacgcucucugccugccuucuguugagcggauuuuugagauggagaucccaauucgaguguaggacacaacaaugagaaagaaacaaaugagagauaaaagaccaacauuugugaaaccuacccucugugcuagagaggaaucuucacaggcuagcaguaacacugcaggcaugucacagaaguaauaacucaccucacuggggccacaguagggcaacuggaaagugaggcaaguuaggaugguggcaugcacacagccacucauccaggucccuguggccaagacacagcauacucugugguucaugaugauuguguaucucaaagggaagcauauggcaacaaagcgaucauaggccaucacuguguacaggaagcacaaaacgcauccaauacaaugauagaagaaauguuguacaacacaucccuggaaagaaauccccccaccccuuccugagagauaugacaacaucuugggagcuguaguggaacagaagcccaugucagagauagagagguugcucaagaaaaaguacauggguguguggagucguggggaggaggugacugcaguaagaaggagcaaguuucccagcaaggcacaggcauauaauguugagaacaggaagaguaggacauucuccaggcccucugucucagggaugcccagcaaggugaauucugucaccauaguguuguuugucauguucauggaugaaucagcuccugggagucuguggaaagaaauucuuggugacauuuauuauguguguggauuagaggaguuuaaauuacagggguggaagaaagaaaaggaugcugauauuuaccuagagaugucuagucaaaacugucuuuccuggugaugggauuuuuuucuucaguuaggcucuuaauuguagaugcagau

SEQ ID NO: 5025 - RNA, 941 nt, Mus musculus
uuuacauaugaaaugucuucuuucgaaguaacuuauuuagagcaacuuugacauccuuauuccucagacuguagaucaacggguucagcaugggcacaacaguaguguaaaacacagaggacacuuucccuugaucuucggagcuaacugaugauggcugaaaguacaugaaucccaaagaaccaaagaagacagcaacagaagugaagugggagcugcaggugcugaaggcuuugaaucugcuuucaguggauuuaaugcggaggauucuggcaaugauaaagcuguaagagcucaagauugucagcauuggcacacagaaauuaaaaguacugaagcacagaaguacuaccucauugacaaaugugcuggagcaagcaaguugcagcaauggaagaagaucacagaagaagugguuuacuacauuagccuugcagaaaaguacucgcagcaugcaaacaguaugaaguguggcuucaaugagaccuaugcaauacaccccaccuaucauccauaaacagacuugguaagacauggugacauuauaccucaagggguuacagauggcaacauagcggucauacgccauugcagacaacauguaacacucagauauaacuaagacuaagaagcaguagagcugugucaugcauucaggguaggagaugauguucuucucugucacaaaguucaccagcauuuugggaauaaugacaguagaguaacagaggucaaugaaggacaggcugcugaggaagaaguacaugggggugugcaggugggagcuaaucgagaucaagaugaccaugcccagguuccccagcuccgugaacaaguagauuccaaggaagaggaggaagaggggcagcugcagcucugguuuguuuguuaacccugugaggaugaacucagucacuguggacugauugccuucagccauu

SEQ ID NO: 5026 - RNA, 1047 nt, Mus musculus
auuccggagaagcuggauugaaugauggaccauaauuaaauuguauugcugauguugaauagcugaaaagucuauuuaccagugguuacuggcucugagaauaugcuacuuugucuuugaguuuaacuagugcuuucuucaccucuuuguuccucaggguguacacaacaggguugaguaggggugucaacacaguguagaaaacagccacaacuccauccacagcaucccuggagccuggccucagguagauaaaaacacagggcacaaagaaacagaggaccacgaugcagugugaggcacaugucuggaaagcucugugccggcccucugaaguacgaauccucaggauggagcagacaauggacacauaggacagcgaaaucagaagaaagcagcccgaagccacuaccccgauguucacaaagaugaccaucucauuggcugaggugucugcacaagccagcuugaggaugggaggugcaucacagaaauaaugcuggaucugguugggaccacaguagggcaaacggaaggucaauguagucuggacagcagagugcagggaaccagugauccauguuccugcugccaggagggcacacacucucccacucaucaugcugcuguaccugaguggguaacugauggccagguagcgaucauaggacaugacaguguacaggaaacacucggugcuacccaggaaguggaagcaauagagcugugccacacagcuauggaaggagauagccccuccccuuggggaaaccaacgucaucaacauuuuggguacugugacuguggagaaccacauaucaauaaaggagagguuggugaggaaguaguacauggguguguggaggugggaguccacccugauuaccaucagaaucaggaaguugcccagcacagugagaauguaaaucaccaagaaggcuacaaagagcaugguguccagggcugguggauggggaauaccugagaggaagaauguggucacuagagucacauuugacauuucuuccaccuuggaucauucucccu

SEQ ID NO: 5027 - RNA, 1544 nt, Mus musculus
ccuacuuaagugaacaguuuuucuucaaagucuuccucagugcaauuugaacauccuuguuccucaaacuguagaugaagggauucaucaugggaaccaccacaguguagaacacuguggauaucuuaucuuuauccacugacccaacaggagaagacuuaaaguauaugaaugaugaugauccaaaaaacagagaaacagcaaucaugugagagcugcaggugcugagggccuuggaccuacccuuugcagaauggaugcggaggauauuggagaggaucaagguauaagaaauaaagacggugagacugggaacuauuauacugacacccacaacaaugaaaaccaccaguucauugauggaggugcuugugcaggacagcuucaagagaggggguaugucacacauguaaugauugaugauguugccaucacagaaggugagccucagcauacacacugugugggcuguggcacccacaaaccccacuguguacccacccaccaucagcacaaagcagaccugaugagacaugaugaccuuauaaagcaggggcuuacagauggcagcauaucugucauaggccauugcugucaaaauacaacauucaucaauaacaaagaaggcaaagaaaaagagcugagucaugcacucagcaugagagaugauguucugcuucacaaaacccaccagcauuuuggggguuaugacagaggaguagcagagaucugugaaggaaagguugaagagaaaauaguacaugggggugugcagaggaggauucaacacaaucagaacaaucaagcccagguuccccaccauggagaacacauagauucccaggaagaggaagaagagaggcagcuggagcucuggcagcugugucaagcccaacaggauaaacuccuucacagaagaauuguuuucugagaccauuccuggggucauagcugugagaaugggaaaagugugagcauugagauaauaucccaacuuucacgagcaaacccaugugguagaacugagagccaggauggggagaggaaugcuaguccuauauuucuggcccuuguguuugucuacauuuuuuaucauugagaggauguacaagugugaguaugaaaacacagaagacauuuacucagcaugcuaaugcccacacucuugcucugcagaaucacucugcuccauuucugccuuaacagaccaccucccuccucagcucaguggaggucucagaggacaggagacaaagcccgugaaaggcccccuggcuccucuagcugagguuucuaaucgcagaauaucuuacauacaguugaauacucaccuuuuuagauccccaccagcaaagaaaaaguuaacucuucugcccuauuuucaugcaaggcaaaucacuuggacugcuuuuagggaacaaccaugcagggggacaaacacaccuguucgaugcgucucuuuccuccucagccuucaugccuccaagcgcuaaggaacugagcuguagauagugauuucuaggguggcuuugcccagaaugucu

SEQ ID NO: 5028 - RNA, 590 nt, Mus musculus
cauggggaagcaaaagaaaacaaggaaauaugcgacuaugaagugaaugcucagucugagagucgagcgacuuaaagaaaaggauaggcugaagccuaagaagaaagaucggggcacacugaaggaaagagaauucccccagcauccuuccugcuuguucuuccaguauaauacacagcuggguccaccuuaccacauccuugucgguaccaacuucaucaacuuuuccauuaaggccaaacuggacuuaguguagucaaugauggacuguguguaugccaaguguaucccuuguauaacugauuguggaauggcugaaacugagaaauugggacagaagugucuuguggcacuaagaaucgcaaaggauccacgguuugaccgauugccuuguacacacaaaggaaccuacacugacgacugcuugguacagaaaguaacucagcacaaguguuacauuguggccacagcugacugucaccucaaacaaagaauccggaagaucccuggcaucccuaucauguacauuuuuaaccacagauacaacaucaagcggaugccagaugauuauggagucccucacuucuaau

SEQ ID NO: 5029 - RNA, 1018 nt, Mus musculus
gaacgacauccuugcugucuuccuaggagaucaaaggacaugagaaauggcacugcaaucacugaguucauccuccucgguuucccuggcauccaaggcucagaagcccuucucuucauagugaucuuucucaucuacauauuaacccuuucgggcaauggacucauuauugucauugucuggguugagcccaggcuucaaacuccaauguacuuuuuccuuugcaacuuagccuuccuagagaucugguauaccaccacugucaucccaaaauugcuagaaaccuuuguaguaucaaaaacagucaucugcacugccugcugccugcugcaggccuucuuccacuucuuccuggguaccacugaguucuugauucugggcagcaugucuuuugaccgcuaccuggccaucuguaagccccuccguuacccaaccauuaugaccagcaaucucugccuacagcuggcccucagcuccuggcuagcaggcuucaccauugucuuuugucagacaaugcugauuguacaguugccauucuguggcaacaaugucaucaaccauuucuacugugacgugggucccaucuugaaagcugccugugcggacaccagcauauuggaacuacugggucuccuggcaacgauucucgugaucccagggucacuccucuucaccaucauuucuuacaucuacaucuuauccaccauccuacggaucccuucagccacuggccgccaaaaggcuuuuucuacuugugccucucaccugacaguagucucucugcucuacggagcugucuuguuuauguaccugagacccacagcacacuccuccuuuaagauuaauaagguggugucuguacuaaacacuauccucacaccccuucuaaaucccuuuauuuacaccauuagaaacaaagaggugaagggggcccuaagaaaggccauuacuugugcaaacaggcaucaugcaaagugaaaccuucaguacaucaaaaggagccgaaugcagaugcuaa

SEQ ID NO: 5030 - RNA, 1018 nt, Mus musculus
uuagcaucugcauucggcuccuuuugauguacugaagguuucacuuugcaugaugccuguuugcacaaguaauggccuuucuuagggcccccuucaccucuuuguuucuaaugguguaaauaaagggauuuagaaggggugugaggauaguguuuaguacagacaccaccuuauuaaucuuaaaggaggagugugcugugggucucagguacauaaacaagacagcuccguagagcagagagacuacugucaggugagaggcacaaguagaaaaagccuuuuggcggccaguggcugaagggauccguaggaugguggauaagauguagauguaagaaaugauggugaagaggagugacccugggaucacgagaaucguugccaggagacccaguaguuccaauaugcugguguccgcacaggcagcuuucaagaugggacccacgucacaguagaaaugguugaugacauuguugccacagaauggcaacuguacaaucagcauugucugacaaaagacaauggugaagccugcuagccaggagcugagggccagcuguaggcagagauugcuggucauaaugguuggguaacggaggggcuuacagauggccagguagcggucaaaagacaugcugcccagaaucaagaacucagugguacccaggaagaaguggaagaaggccugcagcaggcagcaggcagugcagaugacuguuuuugauacuacaaagguuucuagcaauuuugggaugacaguggugguauaccagaucucuaggaaggcuaaguugcaaaggaaaaaguacauuggaguuugaagccugggcucaacccagacaaugacaauaaugaguccauugcccgaaaggguuaauauguagaugagaaagaucacuaugaagagaagggcuucugagccuuggaugccagggaaaccgaggaggaugaacucagugauugcagugccauuucucauguccuuugaucuccuaggaagacagcaaggaugucguuc

SEQ ID NO: 5031 - RNA, 21291 nt, Mus musculus
gcagaggacccacguguuccgacccgcugggccccgcgcgacucggaucccgcucggcucuuucggccgggagugggugggggagcaccgggcaggggaggagccgccggagccgcgggagacgugagugucggggaccuggccggcgagcgggcaccgcagcgggcggggagggaagggcaggagcauugggaggggcagcagaccccgcccccccggcgccgggggacagcgccugccagggaagggguggcggcgggguccccgcggccugggcguuguaaccaugucaccuccucgcggccagagccgggacguccggagacaaggguggcacuccaggcuucucugcccagccaccuccuuccgcccccucugggggccugcggacaugcacugugccccucggauugcguccauaccaaccgcuccggugcgcuagaagccagugggguguagccuaggccccuugacgcccaccuuccccucucuucagacuuuucacucugcaucgcacauugcuccagagcccucccugcagguuuugccuucccuccuucccagcgaaccccgcccccuucacaugcgaucuuaucaccugugauccuugccaguccuuggccgucuagcguguggcucucaccuggcuuagugacaggcucagaacuucccuguagagcuagaggcuacugucugcacugucugaacuucuuucuuccuaccccugacaaccagcucggggaccucuucuccagcucaucucaccaucugcgggacuuuccauaguggacugaaaguuugcuaguuuuuuauuccauggccgaccugguccucucacacacuuuccccugggcuguggcugucucguauucuacacauggauagcgcugucuuuucucugugcagaacuccccaaagggagaucucuagguccagcuuaucgucuuggucgugguuaggagugccacaucuaggguuuugcugucagguuauucuguccauagucuacaggugaaaggcaguagggaaagcuuggggcaacgaagucacaaggcaucucucugugcagcuuuuucuuugaagcagccccauggaccuuaauccagaaaacaguuucaaugaagugucaggauggcugugagaagcuugcuaggagaagcaagugacagugggauauuuggaggccaucaaauaucuugagucacuuucugcuauugcugccuaacauaaaaggguuaggaggaaggcaguacauuuuucuucuaagacagcugcugaccuuuccuccugucuccuauguacacacccuuugcauucuaccuguauaauugcaggagacagucauuccaaggccacugcaagaccuacaucacuauugagggacuccugucguuucagaauauacagguguggugacuauaccacucaacacaggcauaaaacaacccuaggcuuucuguuuuauuuuccucuccugccugaaugucagcguugcuggauaaguuugugcuuuucugcaugaaaccucaaauuuacuuccuuugcccagauaguggguauggaguuuaucauacaugaauccgcauguaagacugaaguggugcucuguguucuguauugaccauuuugagaaacacuauuuuuggccagaccucccucuugguaccugccuuacagagguuugaggacaaagacuugcaaauacuaguaguguugacuaaucuuugaugggugaucuuaccauucgagugugaguuauuuaugauauuacaugcuuuuaagacagaaagccaaaugcucuauuaucuuuuguggcauguuaagaugaaauacugaugaggguuuguuucugguuugguuugguugcuugcuugcuuguuugucuuaggacagugucucucuauauauagcuuuggcuguccuggaacucacuguaaagacuaggcuggccuagaacucacagggucccgccugcgucugccucaugaguacugagaguaaaggcuugcaaccagcucccuugauuuucuugauucccuugauaaagaguuucccauugcugaucacaggucagaucuuauucuagguuucgaugugaauuccugauagugcuaaaguuccugcuguucccugaucaacuuugucacggcuucuuccccgcucugcucagcacuuggaauaguaggagauauaauauucaguguaugcuuaugaacugaaucaaaucugugcacuucuccccucaaaguuucucaccauugauacuaaagcagucugucucuauugaacaguaaagcaagguagacuugauugauaaauuccccaaagaacuuagaauguuuaauacccaauuccuacagcugucugaaugaaggacuuaucaccuaggagcgcuggcacccacuaauuacgguacuucuguugaggcguguauuuauugagcuucuuuccccgcaaacuaccuggaagaaugauucaggucuaggaacauauccuugcuuaggggucccagcuuaccaaggaaaagacacuaaacuacccacgaggaaugacugcugggauuuccucugugcucucagauucugcuaggucaaaccacagagaucccaaccuuugucauauauauaugcaagagagccucaguccaagccagaaggaaaucaccuagcauagagcacuagguagccaggauguauugguuguauacacauagacaguaacuuuccugaguuaccuacauccacuccugggguccagcuauugucuuauuauuuauccuuuuccuauuaagugauccuuucucuguuguaagauuauuguugccuguauuuguugugggaauuuuaauauaucugcauaacuuuggcugccaaauaauaaaugcuguuuucuuccuggugggugucaaguguuaugucccuuacauuuucagcuucagauuaauuuguggcauuuugccuuaaauuuguauuuaaagauugacgcacauuauuuaagucaguaacuaauccuggguacuacccauuaaauguaggaugauucacuucauguggagguuaaugaacauggucauaauggccagauaugcagguuuuuuucucuuaaaauauguauuaucucgguucuuaaauaagccuccuucauuaucccucacugauccauugugaauccaacaguaaacaaagaguuugucuuuguuaaucuugaagccccuccuuagcauccuaagaucuggaaagcuucucaaagguugauccacuucuuugccuuuagauagaaaaaucaucuccuucaaaaugagccuauugauacaacugguccaggaugccacaccuuacaaaguagagcaggguauaggaugugagccucugucucuuuaucauugcuacgcacaucuguguguauaaggaaacauauuauuaauuuucaauuuaccauauugucaaugacauuuuuuauucaccuuaaaccuugauguugacuauaaaggcagucaaauuucagaguagaagauaauuaagccucugaccaccugaccaucuuguaccagccacugccuauuugaccucuccucuucuuccuaucuucucauuuuccauuccucuuucuguuucuuaaaagcuauuguaauaagcuuugagccaauauucucuugcuucucaaauaugacuuuuaugagagaagaaguggcaaaacaaaacauuucuccagguggggcuguagcccagugguagagcacuugccuaaaaugcagaguucuggacuccaucccaggucuucggaauuaaaccaguuucagcaugguuuaaggcacacugaucaugacaugcuagaaggacaaaagccagggcaugcgucacuuucacuuucuuugccuuccggguugagcuuucacaagacuuggcauauucauggcuaugagucacaugcauccugacaacugcagaaagggaagggucuuugcuuuggguaaguagaagccuuacugauuccaucuucagauaaagacucuaucaccaagguucugucccaucuguguucaacaacuuacuuaauucaauuuauacugccuccagagcaaguccuguuugcuuuuugguuugaguuuaacacuucauuugugauaugacaauaaacagaccaacccuuuccccucauuuuucauuuguaauuaugaagaaauaaaauagacuguaugcuuauuuucuaagucuugauuucucaaaagaacuuaaaggagcuugaagcagaaaaugagccauauugaacaucuacccugugccaucuucuacgccaagagauuuauauaaauuauaucauuuacuccauaaaauaagcaugugagauaggcauguuaaccaccuuucaagaguaaggcugagaguuagagaaauugugccauguggcuuaugagaguagagauacauauucaaaauuccaaagccauguuaccauuacauggaaagcaguggugugcaucuguauacauagcaguugaaauaaggucaagaauuuggcgaguggaauggccauauuguuacauccuuuuguggcacagcagcauuggaagacaacagucaagaauuuaguuuaguuuuuuguuuguuuuuuaauuugaauucuagaacagcuugaaggcccuaguaagcuccaguaagcaguuguuuucacagucccagacuaugaggcuacauuugucacuuaaauuuugugacuuuuccuggagagaugugacgaacuaucccuacaauacaagauauaaaugacagaucaaagaaauucuucuacccauauagguugguaagucauugaguucauuaguaacagcuugaguaaagggcuacucagaggcacaaagguaacuacggcaccaaaaaguucacuccaacucuuguagcuaugugcccauaguucccuguucagucucaagguggcuccaccagagucuucacuaccaguugcuuccuguuuguaucagaagagggggcucaugaaucuuguguaugagcuugcuaagucagugaccuuucugagucauuaauuuaugaggcuuaugggccauacccucugccuuuccgaaggggaaugucuuauuuggaaggaaauagcuacauggcauucacuccuguggcucuuauguucuuuccacucuaucuuccaagauguucccugacccuuggacgggguaaaaaagauggguggauauuuucuuccauuccuaccuuagcauaggggccagucacuuauucucagcagcuugacagauuauaucagucucuucaguuuugcaauacccauuuggagggacagccuuuucuuccauauuagacacugaugacagcagaaaucugugaauauaaacaacuguuucaaggacagguaggugcaucacauugauauauuaaaacugaaacaguaguuuguuucuuuuuuuuuucuuuuauuagauauuuucuucauuuacauuucaaauacuaucccgaaaguccccuauacccucccccugcccugcuccccaacccacccacucccacuuccuggcccuggcauuccccuguacuggggcauauaaucuucacaagaccaagggccucuccucccauugauggccuacuaggccauccucugcuacauaugcaacuaaagacacaagcucugggguuuacugguuagcucauauuguuguuccuccuauaggguuacagacgccuuuaacuccuuggguacuuucucuagcuccuucauugggggccuuguguuccauccaauagcugacuguaagcauccacuucuguauuugccaggcacuggcauagccucacaagagacagcuauaucaggguccugucagcaaaaucuugcuggcgaaugcaauagugucuguguuuggugguuguuuaugggauggauccccagguggggcagucucuggaugguccuuccuuccaucucagcuccaaacuucgucucuguaacuccuuccauggguauuuuguuccccauucuaagaaggaaggaaguauccacacuuuggucuuccuucgucuugaguuuccuguguuuugcaaauuguaucguggguacucuuaguuucugugcuaauauccgcuuaucagggaguacauaacauguguguucuuuugugauuggguuaccucacucaagaugauauccuccagauccauccauuugccuaggaauuucaugaauucauucuuuuuaauugcugaguaguacuccauuguguaaauguaccacauuuucuguauccauucuucuguugagggacaucuggguucuuuccagcuucuggcuaguauaaauaaggcugcuaugaacauaguggagcaugugucuuucuuacuaguuggaacaucuucuggauauaugcccaggagagguauugcgggauccuccuguaguacuauguccaguuuucugaggaaccgccagacugauuuccagagugguuguacaagcuugcaaucccaccaacaauggaggaguguuccuuucuccacauccucgccagcaucugcugucaccugaauuuuugauguuagccauucugacuggugugagguggaaucucaggguuguuuugauuuauuugcauuucccugaugauuaaggguguugagcauuuuuucaggugcuucucagccauucaguauuccucauugagaauucuuuguuuagcucuauaccccauuuuuuaaugggauuaguaguuaauuucuuaacccuuggucuuccugcccucuguagccacaaauuuuugaacagaaguaguuaucaucccucuuguagaauaaucauuaaaucuaagcagaaagcaauuggcugcauauguaauuguuguaaccgcuauauguucauaguaguaguacauagaauuuauagagcaggacuguuggugacauuucucucacaguagacugcauaguaccuucugacacuaugaaagccagaaccagcaggugagaaccuuccagcucagucccagauugauuucucauguuccauagacaaaguaugcagugucuucaguaguagucuuacuauuuguuucuaauguaaaaccaacagcagugucaauagcuuauagggaagcgggguaggaggugagcagggaacucagccuccuuggccaguagcucauagcuaaucacuccuaacacuggaauuuacucaaaaacuucagagacugguuuuucucauugcuuuagguuauauauacucugucucaagaaggcauaguaaguacuuauguuucugguucucuaccuugauacuuggacugcccaucuguacucaugucccauagccuugugaaucaggcuaugagggacuaucucauucuuuguuuuaacaucuguucaguuaaaacuuuucaugcauagggcauucacuuagguauugggccacuagccaccgcaacaccucaugcugaaucaugaauuucccuuuugauuagagguuaaaauugagggcuauguucuuuuacuucugacuuacuuuugcccucuucacucacuuauuuucccagugggauuccaguuuuuuaguugggggugggggguuggaguggaaugcuuuuuagcaggggucuaauuuguauugucuuccuugcaccugccaaaugcaggaaaugacagcgcaacaccucaucuuaccuuaccagguuuuuguuuucuugcuugcuugcuugcuugcuuuuugcaccuucuaccaaaucagaggauagcauccaugugucuuuuuucauaucagaauuccucuuccauggacaagugcuuuccagacagacagcugagcucagcugugacuuuucacucacaacaguggccaaaauuguugcuauagccugcuuauggccauagcccauguauuguacuuucaggauuggcauacauucucaaguuuauuagcauuuuugggaaugcccccaaagucaccugauaggcucaguucccuggggaagcaugccaccucauagcauguagauaagaugguaaacuuagcauucccucaaaggacacucgauucucaguggcuuuaccuuggguggcgugucuuaucacccauuaguggaaacauguuucugaauuugccacuacagaaaggaagcacacuauccucuggcacaugcagaaaggccgucaacauuggaauugccucuguaagugcucuggucuccgaucaguguuagugcaugccucaaccugucauugucacugugcagcugcuccuccccaacucaucuuugauccuuucagauucuguguccuuguuaguuguguugcaugccuuuugaaugggcaugugaauaaaugucucuucaccacccccaccccccaaagugcugacgacauaccaaaaagaaaugguuccguccagaccugauuucguggucuggugaauuuauuaggguuauuuacaagaacaugggugaaucaaaggcauuuacaucaccgaaaaggucugucccagcaugggugaaaucauaaagcuaucugucacccuggaucgcccuacuuaaaggcagugccaccaaggaguuugcucuucccagcaguugcuugcugcucauguaaucuugggaacugagcuugaugaucuaacaacuuacugagcuuccugaguuuuguaaguuuuguggacauccuaagccuuguuuuauuagcccccuaaguuuuuuugagcuucacucuuuccucgggaauguuucaacuuaaaggaaauggauacacacgcaauaucuaagucuacuaaauauaaucauuuaaguccaaauagcuaguuaauugucugaagacuauuuuccagaaaaaaaggcaagucacccuuuuccuauagcuacaaaagaugucuuuuaggguacagaauugauaauucuuuuaugucuucugguuuucagugcuuaagagaacugaguuagccaccucugucaugugacaucuucagauaaggaacagagaaagcuaagccaagaguggcaaauagaucuuaguuuccccuugccuccuuccaaaucaucccucauguacuuagcagugcauacucaaaaggccaggucaugagacugccccaucuuaugaagugucuuugcagacauuuucuaggugacucuucuuaacgaaucauuuacuauuccuggccugguuaucauggacucccacaugaguauccaagagccaucccacuucaggagacuaggaaagggccacuggugacagggagugagcacuggguagaggggccagcagcccaacccaaaaaaacuugcuacagagccaccaggguugaugccaggguuuuaucuggcuguggaacuuuuccaaggacaccaaagaaagauaauggaguuggaaggccaacaaauuguagguaucaugcauguaaccaugcacaucccaugaacuguaggguaagcggugaaaaccaguuauucuugucuccauuaaugcuugacauuugcauagcauauuugaauucaugccacuucacugcauuaaaguaguuaucuacagggcuuuaccuuuuacaggguugguucuggugugugugagucuggagcuggaucgugguucuuuuggaaccuaauguauauauagcuuugcccagcugccaugccuauccaaccccaucuccugccagggcaaggaguccuuccccucuucuuugccacuguugaugaccucuuucccuccaccugaguuuuugcgauugcuaaaguaaauacaaagcgagcagcaggacuaucaacuguggaacauuuaaacacccuggcaaggcugcguugguuuuuggguuuguuuuuguuuuuuuuuuuuugguuuuuuuaagagugaaaucacucaaagcaggauuccuucuuucagaacucgcaguguauggaaccuuuuggacaugaugcuccuugaagaccaagggaauuucuagaugacuucacugaucugguucucagacauuuaaaauaauagagaucuuuuuauuaagcuaaguuaccuugcauagcaacucuguuuaucugccuuaaaggugaauguuagcauaaagggauauauaucuggguaaauagugaguauugacauuaaauuauuuaaugucugguugguguuuauuaaagcugauugaaaucucaaaaaaauuuuuuucaaaugcccaguuauguguaauguacauuugaguuaucccuaaugugaccugaagauuacuuaugacuucaucacacuugaaacuugggaaugucuuguuuauguaccauacaaacaauaaauuuuucuuuauucagcacacauuuugcugaacacaugacuaaguacuaauucauauggcaugguaacgauccuucccagaggcagagacucagugaauguucucugcccucaccaguuaugaagcaaguaccuaucuucuugcuagacuuugguuuagggugcagugugcuccucccuucaggaucuuauagucucguuuguaauucugccacuagaggagcaguuuuacaacaccaugcacacugugcuauggagaccaugucuuuacucaucaucuaagaggguucaguggggcaaacucagaauagaucagaugcaagaauggagccaggcagaugaaggcuuaggauaguucauagagaagcuugggaaaucuugguaaagggaaacaagaugcaaaaauaguaauuuaagcaauggcucucauggaaguggcacucacaguagagaagagaggccccaagagaucuggucuugaauuuugaguauuggagaaauucuuuggugagacaaaaaucucuugggggacuggaagacaauugagugguuaagaacacuugcucucacagaggugcucccagcaccaaauaucaggcagcucagucaccuguaacucuucuggccuccucagguaccuguacaaacgguaaaucacagucuucuuaaaaggaaaagggaagagguucaaacaacauacuaaaacuacuuuuucagggauaccgugaaaagguaacauuaaaaccaauccgaggccgggcgugguggcgcacgccuuuaaucccagcacucgggaggcagaggcaggcagauuucugaguucgaggccagccuggucuacagagugaguuccaggacagccagggcuacacagagaaauccugucucgaaaaaacaaaaaaaaaaaaaaaagaaagaaagaaaagaauuuaauuugguucuagcucagcacuaaugguuuuaguaaucucagauuuuuuuuuuuuuuuuuuuuugguuuuucgagacaggguuucucuguguagcccuggcuguccuggaacucacucuguagaccaggcuagccucgaacucagaaaucugccugccucugccucccaagugcuaggauuaaaggugugcaccaccaguuuuaauucuaccaaaauacaaaacaacaacaauaaauaaauaaauaaauaaauaaaacacuaaagaugaucauauaauuaaaaacaaaaauguaagcuaucaaguaguagagaaacuuagcauaagauaccauaagaauaauagaacuaggcaagaugguuuaauggguaauggugcuuacugcuaagcuuaguaaccugauucauagaacccaggugguaggcagagaaccaucuucugcaaguuguccucugaccuccaguguacacuguggcaugaccacauccacacacaauuuuuaagaauaguugcauaacuaucaaaaacauagaagccauguuacaaaugauugaagacaauaaaaugaaauaacuuagauuaagagaaauuuggaaaacaugauuauauaauuauuauauaugacacuuuauaugucauauaaagugucccaacagucaagggucagcuggugagagucaagugauaaccuugagaguuuauugcaggcaacugcaaugcagaacaaaaaugacugaucaauaagggacccugggcuggcuaucauucuugucuggaggaggacagagccaagaccccuuguaaaacuugaacucagugguucacucugcucacacauaguaccagacacaggccaguacuuuuccagggugagacuuuagucacucagaauguggcagauacugaacuagagcauuuaaugcagaugaagacaugauggauuugaaagacauuuguuagacagaauuaacaagacucaaugacccagcaaaguaugaguauaggugggggaagacuggcuaugggugcuaagauagcaagaaaguaugagaguagagauucauagggcuuaagugcauuuauuguguucuuuguaauaggagaguaaaaaaaucacaguugcuaacaucaaguuucucaaggaaaauaagcaguggcuauguaauaagacagaaaacagaauggauggaccaagguugcuuuugacccauuuaggugacuucuaaccauguguaaggguagagagaauaggaucaaauuaaauuucagaagacaugaaccuaagcugucuuaaaagauaaaguuuagccaagcuaaaggucacagguacuaagagucaugugugacuuuucuccaagccaaccagcuuccaucuuggagcauucagcugugcccccuugccaaggaucccagcugcgcuuuuuuaauaguucauucccaaccccaaguauacaacuggcaacucagcaaauucccugcaggaggggccagaauacacacagucacaccagagaagacgagagcagggcuuccaucugugcaguuguggggaagccuuuggguaaagcuuucuaggugugaacuuugggggaagagugaccacauccuguaaguaaccccucaccuauacuccauaaggauguccaauaaacucuuuuguucccuagagugaaauuugguggaaucaugccuucauuuauuaggaacuugagacaaaggauagauauuguuuauguuuucccuugggaaggaauuuuaacaacugcuauuccaaagcuaaaguucaugggacacuuguaaagauuguaugcacccaguucaggaaugggggguggggggaggagcgcauggcuauaaaggauugcaaagggaauaacuaccuuaaggccagcuagugugugauauacuuaaagaaucuuacuuaagagaaaagcaggaaugauugaaugaucuucacuaggggaagaacaugaccagauuuagauuuacugugacagccaacaaugagaacacuguaaauugggguguccaaacuuuuggcacuaaaaaauaauguuaucuacaaaugugcuuguuggacuguauucauaacuauccugggaaauguguggcccacaggcugcagagagaucuuccuacuaaagaaugcugacuuggaauagcaacuccagaggcaguuaccguuaucuagaugagaauugguuaggacagcaucagagcaagggagugacacaagguaacagccacccaguaaagagugugccacggguauauucuucaaaagacagcaaggccugaaaagccagguuggcccucagugguacgggggauggguaagauagacuauaaaaagcuuugcauccucugcacaguuuuuucauuuaaaacacauuuuuauaauaccaaguaauagcauuaagaaaauacuuuagaaaguuaauaguuaacauugaaauuccaucucccuucugaacacagaaaacaguaagacauuugaucucaaauuuacucuaacagaaauauuuucagcuccauacuguugaugagcaaauaauuuacagaaaaaaaaaacuucccaugaggcuauacuucuaucccacaccuuuucagugauagcaggcaaauauaaguccuuuucgucccccuucucuuuauauuacccaaucgggaucucauuagaaugauaagcaguccuuggaaagcuauaacuacauagacauacugaaucagauugugagaaaaagcuucacaacuaauguauuaucucuuacuccuuguugaguacugagggagcacacguaggaagucaugacuguaguucaggcaagguggugaggaccacccugaaguagcaggcagaaagaagaguaaagguugagaaguuuaagagguagcauugguuuaauuuuaaacagugagaaaaaaaucauaaaguugaauccacaaauuacuaaacuaaguauuuucuuuacaauuggucccugccaaggcagaaagaagguaaguuugcaaacaaggcuagaauaaaugaguguccuuugaacaguuaggggucagugagucaucccgguaaagaugucuuagcaagauaaaggcaggcucuggggguggugcuguuagugucuuuccucuagagugcugaaaaucuccaagaguuuccauuugaccaagguuaauauuaguuucgugcagccuugcguaacauauguccacccugcugauggcucaagauauaaauacuauacgccugugaaacaaaucauggccacuggggcauuguuuguaggcauucugagcaucguuucucccaaccauguaaggacuguggggaacucacaaugugcuggcuguaguacagacaggaauugaaggagccaaacuaaagaacugagcaggaaggaaguagaagaaaggcauuaggagguaaagccacacuauugugaguagagcgguguacuguuuuuuuaugggcuaggaaccuucccuaggaagugagggaagaggaccuugccaggccuaucccaacuugauuuuauugcaacaugcaguuauggagacuggggaaggggggaguuaauuauuucagaaguauacaaaggaucacaaagucagaacuguugucucugcauaacugcaggcuucuauucucuuucaucuuuacuacucuacccuaggucccuuaggaggaaccccuugagcuacccggucuaaaacacguuaucgccagugugagggcuaaauggugugauaacacccaagagccaggaaauggcaacagccuuggagccagaggaccaagaucuuugggaagaagaaggaguucugauggugaaacuggaggaugauuucacgugcgggccagaauccgccuuggagggcgaugauccuguacuggagaccucucaccagaacuuccgacgcuuucgauaccaggaagcaucaagcccucgagaagcucucaucagacuucgagagcuuugucaucaguggcugaggccagagaggagaacuaaggagcagauucuugagcugcucguguuggagcaguuccucacuguccugccuggagaacugcagagcugggugcgaggccagcggcccgagaguggcgaggaggcagugacgcugguggaggguuugcagaaacaacccaggagaccaaggcggugggugaggagggggaguccugaucugugugauguggagggggacuguuccucaaggcuggaucuggggagaguaugagggucccauaaauuauccuuuaaauuuuacugguucugcuuuuggguuucaucuagaaccaugagcccgguggggccgggauggaugugugcgagugugacuuucuaggcuuugaaucaccugccugugccaccuaaagauuggguuuuaaauuucuuuggauguugaaccuugggguccuuagaaagcaacuauucugacuuccucuaguuucaccuagacccuuaaucccaagaccccuuuccuaggaugguaaucugagaaaacaaacaguaagcagcccugaaggauagauggaaaccucagggccccaggugaugagauuaaagguugaaagaagggggaaauuagaagaguccuaggguguccccugccuugucuuuguaaagauaacugguucuucgugugccuuugcagcuugaguuuccccuccucaucucguucccuuugugaguguuccucccaaaguaccccugaugacaagcaggaauuuucuccugacuccaucaugacuggaaguuaaaauuguucccagguaaccguccauguucagggccaggaaguccugucagaggagacccuacaccuagggcuggagccggaguccuccagugagcaacaagauccaacacagaccuugaccacugagcagccccaugaggaagcccuccgaagcccagaucuggggacacaggaacaggagaccuugcagcaugacgaggagcaccugccccugccggaaugugguaggaagaagccucagcagaaaggagaaauuuuggcaaagugaagaagaaauugggaggcgggguucucuuguaccacaaaggcugaacaaauucuaauagaaagcacagaauauugaugcugagaacacgaccagcuagaaccugccuacaaauggggccaaguuuaaguagugguauucuugaguguucccagcauuccaguggaguuauaggucguugugacaauucugcccacuuuagaucagcuucucgacucucuuagcagagagaguaaguaguuaaggacacuuuguguucacucuaguagaggaggcucagccucuggcauuucauguugcugaccuccuuuuguuuuguagagguuccagugucccaggauguagaccuucccacagaacaagggucuggacacccagagaugguugcucuucucacugcucucucucagguaaauccuaauucaaaauacauauuugaggauuuguuggguguuagcgauaugcugaacaauaacggauguaagugugcaugcuuagaguaaguuuucuguucuuucuguggggaugcaggauaggggaagaaacuauaaaauuaaacagcuguuuucagcuccagucuucaucgucucuuuauuugccagagguacuaacuguucuuuucuucagcuagacuacaacuccagaaguaguaacuaaaggcacuaaguggggucauuuugcaguauucaguacaacuuugaaguuguuaagugaacagauuuaucauuuguaagagugccuagcgugacugugauaauauuuaugagcuaaaucucuugaucugaaauuacggggcugagaaaagcagauagaauucacuagugguuuagaguuguagucuaguaguuguagucaaguagucuuucuuguucugaccauggaacaauucuuagaaaagaugguuuuuaccaaggccucccauuaaaacagcaauuagggaguugaaugauuuaaggcccaucuuggguuuuaaaccauaaccugaagaagaauauaguuuggccugaagaaagaugauagguuggagaagcagaaguaaggccaguguuuuccucaagugcugaagguuccgaaucagcaccauuaccaggcuccccauggaaauccuucugcaucuucccauucccuuugucucuggauggagccuaccucaaaauacaguaggauaccugaagcaucacguccugaugggauccuugugucauugcagggacuggucacauucaaggauguggcucugugcuucucacaggaucaguggagugaucuggauccaacacaaaaagaauucuauggagaguaugucuuggaagaagacuguggaauuguggucucucuguguaaggaguuuuauguauuuccaugccauucuagccacaaacaucuuuuccuguuggaauauagggaaucggagaccuugaacuacauguacuaaacuuucacuaaugcaugccuaccccacagugagauuaaagaucaguuagcugacaaagaugacacccuuccaacagaaaggaagaaagaacggugcuugaaaaaacagugaauagaaaaugagaaaauacaguuauuguuuuugaguucaauauuuaacuuuugaaguaagcauaugaguuuugaagcagucaaaacaaagauaaucguccuucaacaagaggggaaagagcaaggaacacggcaaguagucuaguuacugaggcucgggugaaagcacuagaaaugcucaagaugggcagcacagagaaacgccaagaugaagaguagugauguccgaccaguuaacagaggccuuugcucugccgucuacccguccagacagaugcucuuaagucaaagaaguguugagccaaucaugauguacucuuuuucccgucucuugagcagcauuuccaauucccagacuagaugauaccucccagauuagagaagaagagccucaggucccagguguccaugagucucaagagccugcagaaccagaaauccugaguuuuaccuauacaggugaggaguaucagacagggcuggccaccacaaugggcaguucccucuagucagugugucucuuuccuccggggccuuucucauugguucuuuuucaugauuugauuuuuuuguuauggucuuacuuuauugacuugccccacagcccacucacugguucuucuaauaugccaucuaucacuaaugcuuccuuccgaaaggcagaccccuccaccauuauccuuuccuucacucuuccuuccauuucuuagaaaacccauucaaaauccucucauuguauaacagauaaaauuguucuuauagcuucucuuuuucuguucuugccccuucuauaggagacaugagugaagcugaggaagaaaguguugagcaacaagauacacacaagucuacuuuggcaaacacagaaguucaccagucuccagauugggaaauagucauugaggauaauaccaguagacuuaaugaaagauuugguacaaacguuucuaaaguuaauaguuucacaaauauuagggaaacuaugccuguucacucccaaucagggaggcagcaucauugcccucuaugugcaaaaagcuucacguguaauucucaucuuauuaggcacuuaagaacucacacaggagaaaaacccuauaaauguauggagugugggaaaaguuacacacggagcucacaucuagcuaggcaccagaaaguccauaagaugaacacuccucauaaacauccuccaaaccggaagacuguggauggcccucugguccagucugagguaacuacccguguggagaaaccauauaccugugaugauuguggaaaacauuuccguuggacgucggaccuggucaggcaccagaggacacauacaggagaaaaaccuuuuuucuguacuaucuguagcaaaagcuucagccagaaaucuguguuaacgacacaccaaagaauccauguuggaggcaagcccuacgugugugcgaacuguggcgagaacuucagugagcagaagcaguaucugacacaccgcaagacacacgugucugaggagcaccaucugugcaaugaguguggccgcuccuucagccauagugcagcauuugccaagcaccugaaaggccaugcuucagugaggaacugccgcugcgaugagugugguaaaaccuuuagcaggagggaucaccuugucagacaucaacgaacacacacuggggaaaagccuuuuaccugugccaccugugggaaaagcuucagcagaggcuaucacuuaauccggcaucagagaguccacacaggaaagaccaagaccuagcuaggggccuuauguggagagcuuaauuccgccgccaacugagacggauggguucuguguucaaccugagaagaacucuucugaggcaucucugaccugcccguaccuuacaucaccucuuccaacuaccaaacaaaagccccauccagaacgacucagcuuuucucaguugaggcuucuguuucacuggcaugcuccugccucuaccucauaggugugguguaggagaugugggacuuaaggaaauuugggucacuguauuuugagaaacauaggcugcucuagauccuggagacuacuugacagccucaacuucaguguggucaaggauaaguacguaggucugauaagcgaccaacuuaaaacggucuguccuuacuggacucaaaccuuaaagcacaaaacccuaaacucaagauaggagguuuggguccugauagauuugccacacugacgggauagcuacaguuucucacuaacucgccucuucacuguacacuuuccuuugaugcuggagacaaaggggaagaauuuugaaggacaaauccuuaaggcuccuucacaaggauuuugacaggcugcuccuuuccccauugucagaaugacacuaagugccacauacugcuacaaaagcgggccuaagcaaaagccucuugggguguaccaccccugucuaaauacuccugucuacuauucagccacugucaguuugucccuuacaugccuacugcaaaagagguguaguacuggagugcugaagaacucaguaaagcauaauuaagacauggugaaauccauuccauucccacauaauguuuaagccugcccuccuucauuuggcuugugagaagggaucuaaagcucuuguuagcauagaaaggcacuguaucuagugcagaaucauaauugacugagagagacuagaggagauauaaaaccaguucggaagacuaugaaacagcuguugccacuggcugagacuauucugacacccaguccuugguaucccugccuggguucucuaauuucugggaagauuaugaacccuaguacuugggacccugagaauucaucagaguaaagggauuuuuaugugucuuguguuacuugguuuuucauguguaaguucauuuucauguaauugugaacuaaaaaguaguaucuccugguggccuacgggucuuuuaccuguucaauguucccaggaggcugaaauuuuaugaccuuacaugucugaucaucuaucugaaaaggacugaggacagauauuccauaaauggggcacaggaugugggauuaaagcaugagaaggaagauauacaucuaugccugguuucuucugcuuauuuuacaaucacaaagggauaugguggguuagcaggcaucuucucagcucuaauccaauagggaaauucucuuaacgauggacuagucaaauuuuaaugccagucaaucauugucgugaagauacauaagaaauaaauaaagugggcuggagagauggcucagugguuaagagcacugacugcucuucuggagguccugaguucaaaucccagcaaccgcaugguggcucacaaccaucuguaaugagaucugaugcccucuucugguauguuugaagacagcuacaguguacuuacauauaauaaaauaaaacaauaaaucuuggggccggagugagaagacaaaaaaaaauuauuuaaaagaaagaaauaaagugauauuugcaacca

SEQ ID NO: 5032 - RNA, 21291 nt, Mus musculus
ugguugcaaauaucacuuuauuucuuucuuuuaaauaauuuuuuuuugucuucucacuccggccccaagauuuauuguuuuauuuuauuauauguaaguacacuguagcugucuucaaacauaccagaagagggcaucagaucucauuacagaugguugugagccaccaugcgguugcugggauuugaacucaggaccuccagaagagcagucagugcucuuaaccacugagccaucucuccagcccacuuuauuuauuucuuauguaucuucacgacaaugauugacuggcauuaaaauuugacuaguccaucguuaagagaauuucccuauuggauuagagcugagaagaugccugcuaacccaccauaucccuuugugauuguaaaauaagcagaagaaaccaggcauagauguauaucuuccuucucaugcuuuaaucccacauccugugccccauuuauggaauaucuguccucaguccuuuucagauagaugaucagacauguaaggucauaaaauuucagccuccugggaacauugaacagguaaaagacccguaggccaccaggagauacuacuuuuuaguucacaauuacaugaaaaugaacuuacacaugaaaaaccaaguaacacaagacacauaaaaaucccuuuacucugaugaauucucagggucccaaguacuaggguucauaaucuucccagaaauuagagaacccaggcagggauaccaaggacugggugucagaauagucucagccaguggcaacagcuguuucauagucuuccgaacugguuuuauaucuccucuagucucucucagucaauuaugauucugcacuagauacagugccuuucuaugcuaacaagagcuuuagaucccuucucacaagccaaaugaaggagggcaggcuuaaacauuaugugggaauggaauggauuucaccaugucuuaauuaugcuuuacugaguucuucagcacuccaguacuacaccucuuuugcaguaggcauguaagggacaaacugacaguggcugaauaguagacaggaguauuuagacaggggugguacaccccaagaggcuuuugcuuaggcccgcuuuuguagcaguauguggcacuuagugucauucugacaauggggaaaggagcagccugucaaaauccuugugaaggagccuuaaggauuuguccuucaaaauucuuccccuuugucuccagcaucaaaggaaaguguacagugaagaggcgaguuagugagaaacuguagcuaucccgucaguguggcaaaucuaucaggacccaaaccuccuaucuugaguuuaggguuuugugcuuuaagguuugaguccaguaaggacagaccguuuuaaguuggucgcuuaucagaccuacguacuuauccuugaccacacugaaguugaggcugucaaguagucuccaggaucuagagcagccuauguuucucaaaauacagugacccaaauuuccuuaagucccacaucuccuacaccacaccuaugagguagaggcaggagcaugccagugaaacagaagccucaacugagaaaagcugagucguucuggauggggcuuuuguuugguaguuggaagaggugauguaagguacgggcaggucagagaugccucagaagaguucuucucagguugaacacagaacccauccgucucaguuggcggcggaauuaagcucuccacauaaggccccuagcuaggucuuggucuuuccuguguggacucucugaugccggauuaagugauagccucugcugaagcuuuucccacagguggcacagguaaaaggcuuuuccccaguguguguucguugaugucugacaaggugaucccuccugcuaaagguuuuaccacacucaucgcagcggcaguuccucacugaagcauggccuuucaggugcuuggcaaaugcugcacuauggcugaaggagcggccacacucauugcacagauggugcuccucagacacgugugucuugcggugugucagauacugcuucugcucacugaaguucucgccacaguucgcacacacguagggcuugccuccaacauggauucuuuggugugucguuaacacagauuucuggcugaagcuuuugcuacagauaguacagaaaaaagguuuuucuccuguauguguccucuggugccugaccagguccgacguccaacggaaauguuuuccacaaucaucacagguauaugguuucuccacacggguaguuaccucagacuggaccagagggccauccacagucuuccgguuuggaggauguuuaugaggaguguucaucuuauggacuuucuggugccuagcuagaugugagcuccguguguaacuuuucccacacuccauacauuuauaggguuuuucuccugugugaguucuuaagugccuaauaagaugagaauuacacgugaagcuuuuugcacauagagggcaaugaugcugccucccugauugggagugaacaggcauaguuucccuaauauuugugaaacuauuaacuuuagaaacguuuguaccaaaucuuucauuaagucuacugguauuauccucaaugacuauuucccaaucuggagacuggugaacuucuguguuugccaaaguagacuuguguguaucuuguugcucaacacuuucuuccucagcuucacucaugucuccuauagaaggggcaagaacagaaaaagagaagcuauaagaacaauuuuaucuguuauacaaugagaggauuuugaauggguuuucuaagaaauggaaggaagagugaaggaaaggauaaugguggaggggucugccuuucggaaggaagcauuagugauagauggcauauuagaagaaccagugagugggcuguggggcaagucaauaaaguaagaccauaacaaaaaaaucaaaucaugaaaaagaaccaaugagaaaggccccggaggaaagagacacacugacuagagggaacugcccauugugguggccagcccugucugauacuccucaccuguauagguaaaacucaggauuucugguucugcaggcucuugagacucauggacaccugggaccugaggcucuucuucucuaaucugggagguaucaucuagucugggaauuggaaaugcugcucaagagacgggaaaaagaguacaucaugauuggcucaacacuucuuugacuuaagagcaucugucuggacggguagacggcagagcaaaggccucuguuaacuggucggacaucacuacucuucaucuuggcguuucucugugcugcccaucuugagcauuucuagugcuuucacccgagccucaguaacuagacuacuugccguguuccuugcucuuuccccucuuguugaaggacgauuaucuuuguuuugacugcuucaaaacucauaugcuuacuucaaaaguuaaauauugaacucaaaaacaauaacuguauuuucucauuuucuauucacuguuuuuucaagcaccguucuuucuuccuuucuguuggaagggugucaucuuugucagcuaacugaucuuuaaucucacugugggguaggcaugcauuagugaaaguuuaguacauguaguucaaggucuccgauucccuauauuccaacaggaaaagauguuuguggcuagaauggcauggaaauacauaaaacuccuuacacagagagaccacaauuccacagucuucuuccaagacauacucuccauagaauucuuuuuguguuggauccagaucacuccacugauccugugagaagcacagagccacauccuugaaugugaccagucccugcaaugacacaaggaucccaucaggacgugaugcuucagguauccuacuguauuuugagguaggcuccauccagagacaaagggaaugggaagaugcagaaggauuuccauggggagccugguaauggugcugauucggaaccuucagcacuugaggaaaacacuggccuuacuucugcuucuccaaccuaucaucuuucuucaggccaaacuauauucuucuucagguuaugguuuaaaacccaagaugggccuuaaaucauucaacucccuaauugcuguuuuaaugggaggccuugguaaaaaccaucuuuucuaagaauuguuccauggucagaacaagaaagacuacuugacuacaacuacuagacuacaacucuaaaccacuagugaauucuaucugcuuuucucagccccguaauuucagaucaagagauuuagcucauaaauauuaucacagucacgcuaggcacucuuacaaaugauaaaucuguucacuuaacaacuucaaaguuguacugaauacugcaaaaugaccccacuuagugccuuuaguuacuacuucuggaguuguagucuagcugaagaaaagaacaguuaguaccucuggcaaauaaagagacgaugaagacuggagcugaaaacagcuguuuaauuuuauaguuucuuccccuauccugcauccccacagaaagaacagaaaacuuacucuaagcaugcacacuuacauccguuauuguucagcauaucgcuaacacccaacaaauccucaaauauguauuuugaauuaggauuuaccugagagagagcagugagaagagcaaccaucucuggguguccagacccuuguucugugggaaggucuacauccugggacacuggaaccucuacaaaacaaaaggaggucagcaacaugaaaugccagaggcugagccuccucuacuagagugaacacaaaguguccuuaacuacuuacucucucugcuaagagagucgagaagcugaucuaaagugggcagaauugucacaacgaccuauaacuccacuggaaugcugggaacacucaagaauaccacuacuuaaacuuggccccauuuguaggcagguucuagcuggucguguucucagcaucaauauucugugcuuucuauuagaauuuguucagccuuugugguacaagagaaccccgccucccaauuucuucuucacuuugccaaaauuucuccuuucugcugaggcuucuuccuaccacauuccggcaggggcaggugcuccucgucaugcugcaaggucuccuguuccuguguccccagaucugggcuucggagggcuuccucauggggcugcucaguggucaaggucuguguuggaucuuguugcucacuggaggacuccggcuccagcccuagguguagggucuccucugacaggacuuccuggcccugaacauggacgguuaccugggaacaauuuuaacuuccagucaugauggagucaggagaaaauuccugcuugucaucagggguacuuugggaggaacacucacaaagggaacgagaugaggaggggaaacucaagcugcaaaggcacacgaagaaccaguuaucuuuacaaagacaaggcaggggacacccuaggacucuucuaauuucccccuucuuucaaccuuuaaucucaucaccuggggcccugagguuuccaucuauccuucagggcugcuuacuguuuguuuucucagauuaccauccuaggaaaggggucuugggauuaagggucuaggugaaacuagaggaagucagaauaguugcuuucuaaggaccccaagguucaacauccaaagaaauuuaaaacccaaucuuuagguggcacaggcaggugauucaaagccuagaaagucacacucgcacacauccaucccggccccaccgggcucaugguucuagaugaaacccaaaagcagaaccaguaaaauuuaaaggauaauuuaugggacccucauacucuccccagauccagccuugaggaacagucccccuccacaucacacagaucaggacucccccuccucacccaccgccuuggucuccuggguuguuucugcaaacccuccaccagcgucacugccuccucgccacucucgggccgcuggccucgcacccagcucugcaguucuccaggcaggacagugaggaacugcuccaacacgagcagcucaagaaucugcuccuuaguucuccucucuggccucagccacugaugacaaagcucucgaagucugaugagagcuucucgagggcuugaugcuuccugguaucgaaagcgucggaaguucuggugagaggucuccaguacaggaucaucgcccuccaaggcggauucuggcccgcacgugaaaucauccuccaguuucaccaucagaacuccuucuucuucccaaagaucuugguccucuggcuccaaggcuguugccauuuccuggcucuuggguguuaucacaccauuuagcccucacacuggcgauaacguguuuuagaccggguagcucaagggguuccuccuaagggaccuaggguagaguaguaaagaugaaagagaauagaagccugcaguuaugcagagacaacaguucugacuuugugauccuuuguauacuucugaaauaauuaacuccccccuuccccagucuccauaacugcauguugcaauaaaaucaaguugggauaggccuggcaagguccucuucccucacuuccuagggaagguuccuagcccauaaaaaaacaguacaccgcucuacucacaauaguguggcuuuaccuccuaaugccuuucuucuacuuccuuccugcucaguucuuuaguuuggcuccuucaauuccugucuguacuacagccagcacauugugaguuccccacaguccuuacaugguugggagaaacgaugcucagaaugccuacaaacaaugccccaguggccaugauuuguuucacaggcguauaguauuuauaucuugagccaucagcaggguggacauauguuacgcaaggcugcacgaaacuaauauuaaccuuggucaaauggaaacucuuggagauuuucagcacucuagaggaaagacacuaacagcaccacccccagagccugccuuuaucuugcuaagacaucuuuaccgggaugacucacugaccccuaacuguucaaaggacacucauuuauucuagccuuguuugcaaacuuaccuucuuucugccuuggcagggaccaauuguaaagaaaauacuuaguuuaguaauuuguggauucaacuuuaugauuuuuuucucacuguuuaaaauuaaaccaaugcuaccucuuaaacuucucaaccuuuacucuucuuucugccugcuacuucagggugguccucaccaccuugccugaacuacagucaugacuuccuacgugugcucccucaguacucaacaaggaguaagagauaauacauuaguugugaagcuuuuucucacaaucugauucaguaugucuauguaguuauagcuuuccaaggacugcuuaucauucuaaugagaucccgauuggguaauauaaagagaagggggacgaaaaggacuuauauuugccugcuaucacugaaaaggugugggauagaaguauagccucaugggaaguuuuuuuuuucuguaaauuauuugcucaucaacaguauggagcugaaaauauuucuguuagaguaaauuugagaucaaaugucuuacuguuuucuguguucagaagggagauggaauuucaauguuaacuauuaacuuucuaaaguauuuucuuaaugcuauuacuugguauuauaaaaauguguuuuaaaugaaaaaacugugcagaggaugcaaagcuuuuuauagucuaucuuacccaucccccguaccacugagggccaaccuggcuuuucaggccuugcugucuuuugaagaauauacccguggcacacucuuuacuggguggcuguuaccuugugucacucccuugcucugaugcuguccuaaccaauucucaucuagauaacgguaacugccucuggaguugcuauuccaagucagcauucuuuaguaggaagaucucucugcagccugugggccacacauuucccaggauaguuaugaauacaguccaacaagcacauuuguagauaacauuauuuuuuagugccaaaaguuuggacaccccaauuuacaguguucucauuguuggcugucacaguaaaucuaaaucuggucauguucuuccccuagugaagaucauucaaucauuccugcuuuucucuuaaguaagauucuuuaaguauaucacacacuagcuggccuuaagguaguuauucccuuugcaauccuuuauagccaugcgcuccuccccccaccccccauuccugaacugggugcauacaaucuuuacaagugucccaugaacuuuagcuuuggaauagcaguuguuaaaauuccuucccaagggaaaacauaaacaauaucuauccuuugucucaaguuccuaauaaaugaaggcaugauuccaccaaauuucacucuagggaacaaaagaguuuauuggacauccuuauggaguauaggugagggguuacuuacaggauguggucacucuucccccaaaguucacaccuagaaagcuuuacccaaaggcuuccccacaacugcacagauggaagcccugcucucgucuucucuggugugacuguguguauucuggccccuccugcagggaauuugcugaguugccaguuguauacuugggguugggaaugaacuauuaaaaaagcgcagcugggauccuuggcaagggggcacagcugaaugcuccaagauggaagcugguuggcuuggagaaaagucacacaugacucuuaguaccugugaccuuuagcuuggcuaaacuuuaucuuuuaagacagcuuagguucaugucuucugaaauuuaauuugauccuauucucucuacccuuacacaugguuagaagucaccuaaaugggucaaaagcaaccuugguccauccauucuguuuucugucuuauuacauagccacugcuuauuuuccuugagaaacuugauguuagcaacugugauuuuuuuacucuccuauuacaaagaacacaauaaaugcacuuaagcccuaugaaucucuacucucauacuuucuugcuaucuuagcacccauagccagucuucccccaccuauacucauacuuugcugggucauugagucuuguuaauucugucuaacaaaugucuuucaaauccaucaugucuucaucugcauuaaaugcucuaguucaguaucugccacauucugagugacuaaagucucacccuggaaaaguacuggccugugucugguacuaugugugagcagagugaaccacugaguucaaguuuuacaaggggucuuggcucuguccuccuccagacaagaaugauagccagcccagggucccuuauugaucagucauuuuuguucugcauugcaguugccugcaauaaacucucaagguuaucacuugacucucaccagcugacccuugacuguugggacacuuuauaugacauauaaagugucauauauaauaauuauauaaucauguuuuccaaauuucucuuaaucuaaguuauuucauuuuauugucuucaaucauuuguaacauggcuucuauguuuuugauaguuaugcaacuauucuuaaaaauuguguguggauguggucaugccacaguguacacuggaggucagaggacaacuugcagaagaugguucucugccuaccaccuggguucuaugaaucagguuacuaagcuuagcaguaagcaccauuacccauuaaaccaucuugccuaguucuauuauucuuaugguaucuuaugcuaaguuucucuacuacuugauagcuuacauuuuuguuuuuaauuauaugaucaucuuuaguguuuuauuuauuuauuuauuuauuuauuguuguuguuuuguauuuugguagaauuaaaacugguggugcacaccuuuaauccuagcacuugggaggcagaggcaggcagauuucugaguucgaggcuagccuggucuacagagugaguuccaggacagccagggcuacacagagaaacccugucucgaaaaaccaaaaaaaaaaaaaaaaaaaaaucugagauuacuaaaaccauuagugcugagcuagaaccaaauuaaauucuuuucuuucuuucuuuuuuuuuuuuuuuuguuuuuucgagacaggauuucucuguguagcccuggcuguccuggaacucacucuguagaccaggcuggccucgaacucagaaaucugccugccucugccucccgagugcugggauuaaaggcgugcgccaccacgcccggccucggauugguuuuaauguuaccuuuucacgguaucccugaaaaaguaguuuuaguauguuguuugaaccucuucccuuuuccuuuuaagaagacugugauuuaccguuuguacagguaccugaggaggccagaagaguuacaggugacugagcugccugauauuuggugcugggagcaccucugugagagcaaguguucuuaaccacucaauugucuuccagucccccaagagauuuuugucucaccaaagaauuucuccaauacucaaaauucaagaccagaucucuuggggccucucuucucuacugugagugccacuuccaugagagccauugcuuaaauuacuauuuuugcaucuuguuucccuuuaccaagauuucccaagcuucucuaugaacuauccuaagccuucaucugccuggcuccauucuugcaucugaucuauucugaguuugccccacugaacccucuuagaugaugaguaaagacauggucuccauagcacagugugcaugguguuguaaaacugcuccucuaguggcagaauuacaaacgagacuauaagauccugaagggaggagcacacugcacccuaaaccaaagucuagcaagaagauagguacuugcuucauaacuggugagggcagagaacauucacugagucucugccucugggaaggaucguuaccaugccauaugaauuaguacuuagucauguguucagcaaaaugugugcugaauaaagaaaaauuuauuguuuguaugguacauaaacaagacauucccaaguuucaagugugaugaagucauaaguaaucuucaggucacauuagggauaacucaaauguacauuacacauaacugggcauuugaaaaaaauuuuuuugagauuucaaucagcuuuaauaaacaccaaccagacauuaaauaauuuaaugucaauacucacuauuuacccagauauauaucccuuuaugcuaacauucaccuuuaaggcagauaaacagaguugcuaugcaagguaacuuagcuuaauaaaaagaucucuauuauuuuaaaugucugagaaccagaucagugaagucaucuagaaauucccuuggucuucaaggagcaucauguccaaaagguuccauacacugcgaguucugaaagaaggaauccugcuuugagugauuucacucuuaaaaaaaccaaaaaaaaaaaaacaaaaacaaacccaaaaaccaacgcagccuugccaggguguuuaaauguuccacaguugauaguccugcugcucgcuuuguauuuacuuuagcaaucgcaaaaacucagguggagggaaagaggucaucaacaguggcaaagaagaggggaaggacuccuugcccuggcaggagaugggguuggauaggcauggcagcugggcaaagcuauauauacauuagguuccaaaagaaccacgauccagcuccagacucacacacaccagaaccaacccuguaaaagguaaagcccuguagauaacuacuuuaaugcagugaaguggcaugaauucaaauaugcuaugcaaaugucaagcauuaauggagacaagaauaacugguuuucaccgcuuacccuacaguucaugggaugugcaugguuacaugcaugauaccuacaauuuguuggccuuccaacuccauuaucuuucuuugguguccuuggaaaaguuccacagccagauaaaacccuggcaucaacccugguggcucuguagcaaguuuuuuuggguugggcugcuggccccucuacccagugcucacucccugucaccaguggcccuuuccuagucuccugaagugggauggcucuuggauacucaugugggaguccaugauaaccaggccaggaauaguaaaugauucguuaagaagagucaccuagaaaaugucugcaaagacacuucauaagauggggcagucucaugaccuggccuuuugaguaugcacugcuaaguacaugagggaugauuuggaaggaggcaaggggaaacuaagaucuauuugccacucuuggcuuagcuuucucuguuccuuaucugaagaugucacaugacagagguggcuaacucaguucucuuaagcacugaaaaccagaagacauaaaagaauuaucaauucuguacccuaaaagacaucuuuuguagcuauaggaaaagggugacuugccuuuuuuucuggaaaauagucuucagacaauuaacuagcuauuuggacuuaaaugauuauauuuaguagacuuagauauugcguguguauccauuuccuuuaaguugaaacauucccgaggaaagagugaagcucaaaaaaacuuagggggcuaauaaaacaaggcuuaggauguccacaaaacuuacaaaacucaggaagcucaguaaguuguuagaucaucaagcucaguucccaagauuacaugagcagcaagcaacugcugggaagagcaaacuccuugguggcacugccuuuaaguagggcgauccagggugacagauagcuuuaugauuucacccaugcugggacagaccuuuucggugauguaaaugccuuugauucacccauguucuuguaaauaacccuaauaaauucaccagaccacgaaaucaggucuggacggaaccauuucuuuuugguaugucgucagcacuuugggggguggggguggugaagagacauuuauucacaugcccauucaaaaggcaugcaacacaacuaacaaggacacagaaucugaaaggaucaaagaugaguuggggaggagcagcugcacagugacaaugacagguugaggcaugcacuaacacugaucggagaccagagcacuuacagaggcaauuccaauguugacggccuuucugcaugugccagaggauagugugcuuccuuucuguaguggcaaauucagaaacauguuuccacuaaugggugauaagacacgccacccaagguaaagccacugagaaucgaguguccuuugagggaaugcuaaguuuaccaucuuaucuacaugcuaugagguggcaugcuuccccagggaacugagccuaucaggugacuuugggggcauucccaaaaaugcuaauaaacuugagaauguaugccaauccugaaaguacaauacaugggcuauggccauaagcaggcuauagcaacaauuuuggccacuguugugagugaaaagucacagcugagcucagcugucugucuggaaagcacuuguccauggaagaggaauucugauaugaaaaaagacacauggaugcuauccucugauuugguagaaggugcaaaaagcaagcaagcaagcaagcaagaaaacaaaaaccugguaagguaagaugagguguugcgcugucauuuccugcauuuggcaggugcaaggaagacaauacaaauuagaccccugcuaaaaagcauuccacuccaaccccccacccccaacuaaaaaacuggaaucccacugggaaaauaagugagugaagagggcaaaaguaagucagaaguaaaagaacauagcccucaauuuuaaccucuaaucaaaagggaaauucaugauucagcaugagguguugcgguggcuaguggcccaauaccuaagugaaugcccuaugcaugaaaaguuuuaacugaacagauguuaaaacaaagaaugagauagucccucauagccugauucacaaggcuaugggacaugaguacagaugggcaguccaaguaucaagguagagaaccagaaacauaaguacuuacuaugccuucuugagacagaguauauauaaccuaaagcaaugagaaaaaccagucucugaaguuuuugaguaaauuccaguguuaggagugauuagcuaugagcuacuggccaaggaggcugaguucccugcucaccuccuaccccgcuucccuauaagcuauugacacugcuguugguuuuacauuagaaacaaauaguaagacuacuacugaagacacugcauacuuugucuauggaacaugagaaaucaaucugggacugagcuggaagguucucaccugcugguucuggcuuucauagugucagaagguacuaugcagucuacugugagagaaaugucaccaacaguccugcucuauaaauucuauguacuacuacuaugaacauauagcgguuacaacaauuacauaugcagccaauugcuuucugcuuagauuuaaugauuauucuacaagagggaugauaacuacuucuguucaaaaauuuguggcuacagagggcaggaagaccaaggguuaagaaauuaacuacuaaucccauuaaaaaaugggguauagagcuaaacaaagaauucucaaugaggaauacugaauggcugagaagcaccugaaaaaaugcucaacacccuuaaucaucagggaaaugcaaauaaaucaaaacaacccugagauuccaccucacaccagucagaauggcuaacaucaaaaauucaggugacagcagaugcuggcgaggauguggagaaaggaacacuccuccauuguuggugggauugcaagcuuguacaaccacucuggaaaucagucuggcgguuccucagaaaacuggacauaguacuacaggaggaucccgcaauaccucuccugggcauauauccagaagauguuccaacuaguaagaaagacacaugcuccacuauguucauagcagccuuauuuauacuagccagaagcuggaaagaacccagaugucccucaacagaagaauggauacagaaaaugugguacauuuacacaauggaguacuacucagcaauuaaaaagaaugaauucaugaaauuccuaggcaaauggauggaucuggaggauaucaucuugagugagguaacccaaucacaaaagaacacacauguuauguacucccugauaagcggauauuagcacagaaacuaagaguacccacgauacaauuugcaaaacacaggaaacucaagacgaaggaagaccaaaguguggauacuuccuuccuucuuagaauggggaacaaaauacccauggaaggaguuacagagacgaaguuuggagcugagauggaaggaaggaccauccagagacugccccaccuggggauccaucccauaaacaaccaccaaacacagacacuauugcauucgccagcaagauuuugcugacaggacccugauauagcugucucuugugaggcuaugccagugccuggcaaauacagaaguggaugcuuacagucagcuauuggauggaacacaaggcccccaaugaaggagcuagagaaaguacccaaggaguuaaaggcgucuguaacccuauaggaggaacaacaauaugagcuaaccaguaaaccccagagcuugugucuuuaguugcauauguagcagaggauggccuaguaggccaucaaugggaggagaggcccuuggucuugugaagauuauaugccccaguacaggggaaugccagggccaggaagugggaguggguggguuggggagcagggcagggggaggguauaggggacuuucgggauaguauuugaaauguaaaugaagaaaauaucuaauaaaagaaaaaaaaaagaaacaaacuacuguuucaguuuuaauauaucaaugugaugcaccuaccuguccuugaaacaguuguuuauauucacagauuucugcugucaucagugucuaauauggaagaaaaggcugucccuccaaauggguauugcaaaacugaagagacugauauaaucugucaagcugcugagaauaagugacuggccccuaugcuaagguaggaauggaagaaaauauccacccaucuuuuuuaccccguccaagggucagggaacaucuuggaagauagaguggaaagaacauaagagccacaggagugaaugccauguagcuauuuccuuccaaauaagacauuccccuucggaaaggcagaggguauggcccauaagccucauaaauuaaugacucagaaaggucacugacuuagcaagcucauacacaagauucaugagcccccucuucugauacaaacaggaagcaacugguagugaagacucugguggagccaccuugagacugaacagggaacuaugggcacauagcuacaagaguuggagugaacuuuuuggugccguaguuaccuuugugccucugaguagcccuuuacucaagcuguuacuaaugaacucaaugacuuaccaaccuauauggguagaagaauuucuuugaucugucauuuauaucuuguauuguagggauaguucgucacaucucuccaggaaaagucacaaaauuuaagugacaaauguagccucauagucugggacugugaaaacaacugcuuacuggagcuuacuagggccuucaagcuguucuagaauucaaauuaaaaaacaaacaaaaaacuaaacuaaauucuugacuguugucuuccaaugcugcugugccacaaaaggauguaacaauauggccauuccacucgccaaauucuugaccuuauuucaacugcuauguauacagaugcacaccacugcuuuccauguaaugguaacauggcuuuggaauuuugaauauguaucucuacucucauaagccacauggcacaauuucucuaacucucagccuuacucuugaaaggugguuaacaugccuaucucacaugcuuauuuuauggaguaaaugauauaauuuauauaaaucucuuggcguagaagauggcacaggguagauguucaauauggcucauuuucugcuucaagcuccuuuaaguucuuuugagaaaucaagacuuagaaaauaagcauacagucuauuuuauuucuucauaauuacaaaugaaaaaugaggggaaaggguuggucuguuuauugucauaucacaaaugaaguguuaaacucaaaccaaaaagcaaacaggacuugcucuggaggcaguauaaauugaauuaaguaaguuguugaacacagaugggacagaaccuuggugauagagucuuuaucugaagauggaaucaguaaggcuucuacuuacccaaagcaaagacccuucccuuucugcaguugucaggaugcaugugacucauagccaugaauaugccaagucuugugaaagcucaacccggaaggcaaagaaagugaaagugacgcaugcccuggcuuuuguccuucuagcaugucaugaucagugugccuuaaaccaugcugaaacugguuuaauuccgaagaccugggauggaguccagaacucugcauuuuaggcaagugcucuaccacugggcuacagccccaccuggagaaauguuuuguuuugccacuucuucucucauaaaagucauauuugagaagcaagagaauauuggcucaaagcuuauuacaauagcuuuuaagaaacagaaagaggaauggaaaaugagaagauaggaagaagaggagaggucaaauaggcaguggcugguacaagauggucagguggucagaggcuuaauuaucuucuacucugaaauuugacugccuuuauagucaacaucaagguuuaaggugaauaaaaaaugucauugacaauaugguaaauugaaaauuaauaauauguuuccuuauacacacagaugugcguagcaaugauaaagagacagaggcucacauccuauacccugcucuacuuuguaagguguggcauccuggaccaguuguaucaauaggcucauuuugaaggagaugauuuuucuaucuaaaggcaaagaaguggaucaaccuuugagaagcuuuccagaucuuaggaugcuaaggaggggcuucaagauuaacaaagacaaacucuuuguuuacuguuggauucacaauggaucagugagggauaaugaaggaggcuuauuuaagaaccgagauaauacauauuuuaagagaaaaaaaccugcauaucuggccauuaugaccauguucauuaaccuccacaugaagugaaucauccuacauuuaauggguaguacccaggauuaguuacugacuuaaauaaugugcgucaaucuuuaaauacaaauuuaaggcaaaaugccacaaauuaaucugaagcugaaaauguaagggacauaacacuugacacccaccaggaagaaaacagcauuuauuauuuggcagccaaaguuaugcagauauauuaaaauucccacaacaaauacaggcaacaauaaucuuacaacagagaaaggaucacuuaauaggaaaaggauaaauaauaagacaauagcuggaccccaggaguggauguagguaacucaggaaaguuacugucuauguguauacaaccaauacauccuggcuaccuagugcucuaugcuaggugauuuccuucuggcuuggacugaggcucucuugcauauauauaugacaaagguugggaucucugugguuugaccuagcagaaucugagagcacagaggaaaucccagcagucauuccucguggguaguuuagugucuuuuccuugguaagcugggaccccuaagcaaggauauguuccuagaccugaaucauucuuccagguaguuugcggggaaagaagcucaauaaauacacgccucaacagaaguaccguaauuagugggugccagcgcuccuaggugauaaguccuucauucagacagcuguaggaauuggguauuaaacauucuaaguucuuuggggaauuuaucaaucaagucuaccuugcuuuacuguucaauagagacagacugcuuuaguaucaauggugagaaacuuugaggggagaagugcacagauuugauucaguucauaagcauacacugaauauuauaucuccuacuauuccaagugcugagcagagcggggaagaagccgugacaaaguugaucagggaacagcaggaacuuuagcacuaucaggaauucacaucgaaaccuagaauaagaucugaccugugaucagcaaugggaaacucuuuaucaagggaaucaagaaaaucaagggagcugguugcaagccuuuacucucaguacucaugaggcagacgcaggcgggacccugugaguucuaggccagccuagucuuuacagugaguuccaggacagccaaagcuauauauagagagacacuguccuaagacaaacaagcaagcaagcaaccaaaccaaaccagaaacaaacccucaucaguauuucaucuuaacaugccacaaaagauaauagagcauuuggcuuucugucuuaaaagcauguaauaucauaaauaacucacacucgaaugguaagaucacccaucaaagauuagucaacacuacuaguauuugcaagucuuuguccucaaaccucuguaaggcagguaccaagagggaggucuggccaaaaauaguguuucucaaaauggucaauacagaacacagagcaccacuucagucuuacaugcggauucauguaugauaaacuccauacccacuaucugggcaaaggaaguaaauuugagguuucaugcagaaaagcacaaacuuauccagcaacgcugacauucaggcaggagaggaaaauaaaacagaaagccuaggguuguuuuaugccuguguugagugguauagucaccacaccuguauauucugaaacgacaggagucccucaauagugauguaggucuugcaguggccuuggaaugacugucuccugcaauuauacagguagaaugcaaaggguguguacauaggagacaggaggaaaggucagcagcugucuuagaagaaaaauguacugccuuccuccuaacccuuuuauguuaggcagcaauagcagaaagugacucaagauauuugauggccuccaaauaucccacugucacuugcuucuccuagcaagcuucucacagccauccugacacuucauugaaacuguuuucuggauuaagguccauggggcugcuucaaagaaaaagcugcacagagagaugccuugugacuucguugccccaagcuuucccuacugccuuucaccuguagacuauggacagaauaaccugacagcaaaacccuagauguggcacuccuaaccacgaccaagacgauaagcuggaccuagagaucucccuuuggggaguucugcacagagaaaagacagcgcuauccauguguagaauacgagacagccacagcccaggggaaagugugugagaggaccaggucggccauggaauaaaaaacuagcaaacuuucaguccacuauggaaagucccgcagauggugagaugagcuggagaagagguccccgagcugguugucagggguaggaagaaagaaguucagacagugcagacaguagccucuagcucuacagggaaguucugagccugucacuaagccaggugagagccacacgcuagacggccaaggacuggcaaggaucacaggugauaagaucgcaugugaagggggcgggguucgcugggaaggagggaaggcaaaaccugcagggagggcucuggagcaaugugcgaugcagagugaaaagucugaagagaggggaaggugggcgucaaggggccuaggcuacaccccacuggcuucuagcgcaccggagcgguugguauggacgcaauccgaggggcacagugcauguccgcaggcccccagagggggcggaaggagguggcugggcagagaagccuggagugccacccuugucuccggacgucccggcucuggccgcgaggaggugacaugguuacaacgcccaggccgcggggaccccgccgccaccccuucccuggcaggcgcugucccccggcgccgggggggcggggucugcugccccucccaaugcuccugcccuucccuccccgcccgcugcggugcccgcucgccggccagguccccgacacucacgucucccgcggcuccggcggcuccuccccugcccggugcucccccacccacucccggccgaaagagccgagcgggauccgagucgcgcggggcccagcgggucggaacacguggguccucugc

SEQ ID NO: 5033 - RNA, 3442 nt, Mus musculus
agaauuauaugcugugggcuauauucuauuuuauuuuacugguagagaggggcaguuagauaaagaggggcagagcuagaagacugcccagaaggauucuaugaagguugaauuuuucuuuacacgacacaauaacuuucccagccuguuuuaucaugugaacagagacagacguagucacuaaaaucuaagcaaaccaguaaaguggugcaguaacuucagcuugcaagaauauggaaaggcacagucacagcaugcgaggguugcuggguguggucuggaagccacccuguccgggcuucuguccuggguaugcaggaaucuccgagcuuauguuugacgguacuucugucugugcuuccgaggaaacagaugugcagagcauuggcaugguggcaggagcagugacaggcauaguggcaggagcccugcucauuuuccuccugauauggcugcuaauacgaaggaaaagcaaagacagauacgaggaagaagacagaccuaaugaaauccgguaagcuucccuauuugugcaaacucccuuuacaggccaauuccauaguaaccagucaauaucauuccguagguccccugcauuauuaaucucuucaaaggguuauccuagcaaguaggaaauuacagucuggggacaggagaugugauucacuuauugugaaacuaucuuuguccuggcuugcuuuuuguugcuauggcaaacaacaugaccaaaagcagccuggaaagaaaaggguuucuuucccccuacagcuuacaguccguuaccaagggaaggcaggaaaggaaaagaauucaaggcaggaaaggaauucaaggcaggaaaggaauucaaggcaggaaaggaauucaaggcaggaaaggaauucaaggcaggaagcugggggugccaacugaagcagaggccauggaggggugcugcuuacugguuugcuccucacagcuugcucagccugcuuucuaauagaacccagcaucgccuucccaggaguggcaccacccacaaugagcaguacucucagacagccaucauuaguccagaaaaaaaagcaccacaggcuugccaaccagccauucugauggagacauuucuucagcugaggcucccucuccccgaugacucuagcuugugucaugcuaacaaccaaccagcuuaagucucagcuuuaccucugauucacuuccacuuagcaaggguagaugauaaaaaggguauaacccacaggacaugaaaggguuuaaguacgcaaacccccaaaucaaagcaauucuaucaaagcaaucaaagucuccuguugagcuguauccuggugcaacuggcucaaccucucuggcagucacucaacaaacauuuuccuaaacugagcauuaagucuuaggaaaccagaaacugcucaguuccuuaacugacugccuuggagguuuauggcuugaggaguuuauuggaaaaaaaaaaaaaaaucucaggaggaaguaacuuuaacgagcgucaacccagccccggcaguacuaaaguuuaucuuugcuaucuguucacuuuuccgcuuucagagaagacgccgaagcgccccgagcccgccuugugaagccuagcuccucuuccucaggcucccggagcucacgcucuggcuccuccuccacccgcuccaccgggaacagugccuccagaagccagcggacgcugucgagugaagcagcgccgcagcagcccgggcuagccccgcaggcauacagccucauaggaccggaagugagagguucugaaccaaagaaaguccaccauacgacccugaccaaagcagaaaccacacucagcacaacgcccagccagagcaaagccuuccaaacugucugacuuagaguggacuugacuugcgcuugccccaaagucaggaucuuagccuagucacuggagcucguccaccagccacgcaagccccucagccagauacgaucucacuuaaguagcugcagaaauggcacggaccaguucugaugaguacccuccuuauauaggauaccaaacaaacacaaggacggaggcugaccaucuaucucuaaaggcaccucacugugccuucagacagaguggaggggaggaggggcccaagcuuauuuggugaaaauaaagggaaaggugaggcugcacacaccugaaacaucuuaccuaggauguugcaagucaccacagucaagaagaagcgggaaucucguagaucaauuuucuauucauuucugcaaauuuauuggauuagugugauuauucagauagucaaaacagaagcccacgccuuauaauauaccuaucugcaacauguacugggagaacugcguuuaagaaauucacauuaaaaaaaaaaaaaaaagaaggaaacacauuuuuuuucuacuuugacuugacuucuugugucauaagguuugaacguugguuggggaggauuugcaaugugggagacagagaaaagggacuuuucucuuaccucaucaacagccaaucuuccuauuuccgucgaacccuaaaauaauaacuaaggagggaguccaaccaagaugggacaugauucucugaagagcuuuccuuuuugauauucagaggcuugacaacagauaucaagacgauuaucccggggcaguuguggcucuuuauuccaauuugacugacuccccuaaagacuucucugcuggauguuucuaggagaaacaaauacucacuacaugucacuuaaugaauguccuuagggacaguccucuagagaaagucucucagggauguugaaagauccccuugcauaccacuuccugcuccucuuucugggaacaagagcaaccagaauuucaagacugcuuggaauagagagggagaguagaccuuucucucaguaggucaaaggacauuugauacuggcccaaaacuuggcgauucuuucauucuagaaggaugcaaaugugggacuuuugaugauucuaggccuuaaauuuucagcaaucauuuccuaaaggcacugaaacccaaaccccucccauggcccucuccccgcugagagguugaacgguauccucgcugucuuucuucucagcgguagacuccaagagacuuggaaggaguaaacugccauuagggaguagguggugagcaaaacaagggguggugggcggugggaguggguucagcucaaggcuguuaacauuuuuggcguuggcgcuugggaaggaauuagcagaaaggauucacuaccagcaaaaguaucaaacaacucacacaaggagaagaaaggugucugagaaauguuuaaaaaaaaaaaaaaaaaaaaaggcagccuuuccaggacaaguaacuugccuuuuagaagguuuugaagauuagggcacuuaaggcacagcugcuaaaccugaaugagcccuucaaagaacaaagcaaagucagcug

SEQ ID NO: 5034 - RNA, 1347 nt, Mus musculus
aucaaucucaauacuggccugggugcuggaggagagggugcgcuuggcccgcucgcaggccgugcggagacggcggacagcucucuuguucucacugaugucuuucuugugcuuucgcuugaacucagcaaugaaaugauugaccauucgguugucaaaaucuucuccaccuaagugggugucuccagcuguugauuugaccucaaaaauuccauccucaauagugaggauugacacaucaaaagugccaccucccaagucaaaaaugagcacauuccuuucagcuccgaccugucaaauaagacauucuuagcucaggccuguuucuggcaaguuaacccuaacaaaguuguacuugauuugaaaugccuaccuucuuaucuaagccguaagcaauagcagcagcaguugguucauugaugauucgaaguacauugaggccagcaauaguuccagcaucuuuuguugccugucgcugagagucauugaaguaagcgggcacugugaccacagcguugguaacggucuaaaaaacaaugaauugcacaauuguuugguuggcaaauucccgaucagaaugugugaauuaaacauaaagguaacacccaucucaaauggcaccuguuaaaaaaaaaacccaccuuuccgagguacgcuucugcaauuuccuucaucuuugucagaaccauggaggacacuuccucuggguagaaacuuuuugucuccccuuuguauuccacuuggaccuugggccugccugcaucauucaccaccaugaagggccagugcuucauaucagacugaacaacagcaucaucaaaccuacgcccgaucagacguuuggcaucuguaaaauauuaaacauaccucaucacacuccuuagugccuaucacugcaaaaaaaaaaaaaaccaaaaaaacagaaaacaaaaaccugcagcacccaucuagauggacguaaucucuagugcaggaagccaaggcccauauuuaaaaucuuguggccuuauauugucauauuuaaacaguugcaaucucaggcugcaguuauuaaggcagaucuguuucuacauuccaaaugcccugccccccagcccuuuuacucaugcuaguggcacaaagaugcuggcgacuuaccaaaaacuguguuggugggguucauugcaaccugauucuuggccgcauccccaauuaaucucucuguguccgugaaagcaacauagcuuggcguggugcgguuacccuggucauuggcaauaauuuccaccuuuccaugcuggaagacacccacacaggaguagguggugccgagaucaaugccaacugcaggucccuuagacaugguug

SEQ ID NO: 5035 - RNA, 159591 nt, Mus musculus
cgagcgagcgggacccggcggcggcgguggccguggcugcgguggcgggcgcagcggagcggcccgggcggcuuggagccccgggagcggcgcgcgcggccccggcccuggccccgcgcugucccggcgcgcgcugcacauucucuccuggcggcggcgccaccugcgggagcguucgcccgaacauggcgacacggagcagcaggagggagucgagacucccuuuccuauucgcccuggucgcgcugcuaccccgcggggcucucggcgggggcuggacgcagagauugcacgguggcccggcgcccuugccccaggaccggggcuucuucguggugcagggcgacccgcgcgaucuccggcuaggaacgcacggggaugccccgggggcgagcccggcggccaggaagccacucaggacccggcggagcgcugcucugcagccccagccuauccagguguauggacaggugagcacuucugcaagccaccuccuuccagccccuuucucucccaccacuuccucacccccgcacccauccuuugcagucgcuucccaggugcuggcuccgcuuggggacuucccggcuggcauguuuguuucauuucuuuuucuucuccuuucccccuguacaucacaugaguacagccgucagcacucuggucgcauagaucuuuuuucuuuuuccuccuuucugucgauuuuagcagauguguuccagguaacuggaagggugcagagccucucuucccuagccuguaugcagacagacuaggguaguuucuggcaggauuuugagggguacagcauaaauuuuacaucuggauaaaaacgggcauaaccccccucccuuccaccccaacucccguaccauccuuuggcagcgggagcgagaauccugcaguuguaaagcacuuaagcagaauugcagaggagggcaugccauguuuauucucaugaaccccaguaaaggugggcaacucucaaagcgcuacgaaugccccuuguguacccaguagacauaugugugcgugugagcucgugaauaucugcguguaaggcuggauucucuucguugggaguacagcacaucaauccguccccuuuccaucccagcccuucaaggugauggcuuuauuuuagauagaaacuaucucuuaugacacuugggauuugagacuacugcaagaaauuugcugggcuuaauauucauuaaaggauuuauuucuauccaggcaauggguuuauuaggucauaaguaacacacauuucacucauggcccccacugacugcuggguugccaaguugaauuugucccccuucguaucagcgcugguggaaucaauuugcccguauuauugucuacucagagacucccaguccuucaguuaagauugacaucagcaaaacuagaaggucggugggagagaaauggugggccugauggagcugaccaacacaaccaugucccagagcgacuguugcuuucuaaaguacaaauuaagugauuagcuggggguucugccuuucuucacugauuuuggcuauagcaaagucuuccuucaggccauacauagaguuaagcaaucaacuccuggagccagaaagcgucucauaaaacaugccacccuauugugucacccuauugugucacguuuugagugaagaaacccaaacugugacaggugcgaugacugguccaaggucacgcaggaaagggcugugagcacuguaguucucuugccugcauggucucacugaccuuugggugcugggagguggggggucaccuugucucugcucagugcuuccuaaacaucuccuuucuaaaauaaaauguauauaucguuaugaagacagaggggcgguugugugugggugggaguagcugacaucugcccaccaccagaccacuugccccugggcaggaauguauaccagaugaccuguaacugcuugaugguguauguaugugcgugugcgucuguguguacguggugugugcagcgcuuagacuccugaagcccaccugcccuguuuugggcccagauccuugugccccccuuuucauccccaucugaaacuuccuuuuuguaauuuggaagucagcaagauugcucuuggcaggcauggcagcuuggaauugccgagggugggucucuccagcuugcugagcucugcugugcuccugagagggugggcugggugugggaggagugaguguucagguccccuccagccuagcuuugguggacagaggcaccuucuagucuccguggcauccaugcaggugcucuuuauuuccuccuuccuuaggguuugcccugugaaaaucucccagggauuuauagcaagcuagagacgaacucuguccucuuugggagccucuccaaacacuucccccccaccccccgcccccugcgcuuugcuuucaugucuucaggccagccagacugguuccauugaaggaugcagauccagccaacaguuggacucagaaugaggcauucccacacaacagugaggaucccuccuguacccguccucacuagggcugccuuccuaggcccccauucccuauugcuacagguuaaggaaaaaaauagcauuacccuuccuuguggaggaguggacucagacagaaggaagaccuaacuuuaugguaugggauuucugccacaagcucuaaccuggugcaggcccuucggacuacaggcucaggaagcagugacugaauggcuuaggggcucuucucugggucucuggggugauguaugucuauuuggaaucaccucuguagcugagguggccauauguguaccucgguuuuuccugggacauacccagguaugaauagugccuccacccccuacccccccaaaugcggcuguguuauuaaucuguaugcuuguuugaacucuuacccugcaccaaguuauauaaauucccuucaauucuuaaacccacauaauuacaguggacaguugucugaaggggauauguuucucaaaacacacacacacaaacaagcagcaaacaaagaaaacaauugaacucgaggucauuguaaacaaacaggugauaaccagcagaccugucacacucaaccggcccuuacccuaccgugggcuuauguggcugagggaggcucuggaccuggagugauggcuggggacagggagacuuaggugcucugcaguuucuuguccuugggccuuggugaggguaagggaguaaggggacacuugucagagcuggaagcagaagccagggagguggugagaaggucacuagccucaggggggacagaaggaaggcuuugccagggaaauuuuggcagagaaaggagccuguuaacagcaugucacacuggagugacccuucuuuuaccuuccucacuuuauggaguaaagauuuuguuauuuugacuauauuccuucucaggaucuuuuucuuagaaagauuuccuaauacgaggagagugguucugacaugaucacccagaaacacauuugcaauaguagagaccaacagaccagauucuaaggcuuuucuacauaaguucaaauuuuacaaggaaggccuauccuuuaaaagaggucaaauuaaaggaggaggaagcaauagcuuuuaaauauauaauauauguaauuauuauugacaauaaucucuaguacauuucuugauaacugugcauauuauuaaugauuuaauaauguauaaauauauuuaauuaauuuauauauuaaauuguuuugguggugguggggucucauuuagccgaaguuggccugaaacugaccaugaagcucaggcuagccucuuaacuggcguuccuccucucucugccuccagaguacugggguuagaggcguggauuggcacgcgcaguuuguccaugguucuugccacacugauuucuuuccuguucuuuguaaucacucuugcuuuguguucuuccccuaaggucuucuucaccucuucucuuugcuuagagaacccccuuucuguucuccaagccucccgggcccuuaguauucccagcucugugggaaccguugugugccugguuccagcccuuacugcccuggauuauaaggaaugccugaucucccugugugcuucuugugugugugugugguggaggggcaggauuugcuccucugugucucacuguaugggagacccuugauaaccaucuguggaccaguuuucuaccuggaagaagcgguguagagagugggcagcacaguaaguuauauaaaguuaucuacgagcaggagcaagggaaggcccaccaacugacaaaaggcuuuggcucacuccguggugcugaagcugaugggauggcccuugggaguguagcccuggguuuccugugcuaucugggaguuaauuccaauaaagacguagaauucuauuuuugcaguguucucccuuuuagggcucucauauugguuuuugcuaaugguauuuuuaauuuguguggggggggggaggggagagagaguuggggaucggggauccuuuggaaugaggcauaaggccuaacaggauuuacagguuuauuuugcuugcaacaagcucucuguucauaauucuugcauuuuagaggacggagaggauacaguguccugguuugagacuagaaacaaaguguccauuacagcacaagggccuuggacaaaaggccuccuuuggggaaagaauacuguuuggcuuuagaucacucugcuguugauucuuacacgauauacuugccugggaaagaauuggccgguugauucugaaguuaggaugucugaccugugggcuuccagaugaagccgagaaggcuacacgcuggcggugccaagcugaguuuugcguaggugaagaccugguugcccucuuggguuggugagggaugugaccuugaaaucccucuccugguugcgccuggaucccuucucuugaguucugggcugugucuggcacgguuugguucaucgguagauuagagccuggaacaguagaggcuuugugguugaagggauggaaaaaagggggcccacggagagacacugagaauucaaaggaugggaggagaacuuacccacugagcuuccauagucuucagcagauaaugccugcuaacaaagccauugugcucugaggaaauguguggaggccggugaauccuuuugcggucuccuguauccccuucucaguugguaacacuuguugccagguuauuguuacgauuuccuuacagaaaucuaacgcacaacauauaaguaugaaugcacacaaaaucgaguuaucagcagccuuuuauugcccauagcccuuggugucaugaauaaugagguuaauuuaaacucuaaauauauuugugggguggugaccauggguagucaggaugucaccuagagagucacauauaaaauagaugacuacuccuuuuccaggccagguguaagagugcccuccccuuuccucccauaggccagaagggcacuguugcagagcccccucggagcuggcagaggguccagcagccccuagaggaguggaaccccacuuugugaggacaucagaauacagggagcguguuagcuuugugucccuuuugacacucuuuccauuguauuccuguaagaugaaguuagugccuugcuuaguaaauugcuuugagaccuggauccaugaggcagauccuaaccgcacugcauacccaaggcaaagagcagcuguuggaggagccucgcauuguugacuggagucuucuuccuuagagauugcagacguguuugugguguccuucuuauuccagggcagccauaagcaagcaagcccuguccgguccauuguagagagaugcagggguaguacaguauuccaaaaggcaugaaauagccaagcuaauuuuauuugcuuuugcauauuuauuuagugucucuuuuagagcaucaguuuaccuucuuaauuaacauuugcucaggugaauauuaagugagucugcauucgucguguugcagauaggggaaauggucauauaaauguauuccaggaaagccagugaguguagaauuuacaauauuugacaauuauggauaauugaugauugauuacacagaacuguuuuaaaccuggggugcuauguggaccuuuauuucaucccucccucccccaggguuaaauuuaugugcugggaaggagaguucagucucuuuuggcuugaacauuuggggguuggucuuucucugggaauugucugggauuccagggaggagguguuuucuuuguuaaugagaacauggccuuccugugcauucuccagguaggucaggaucugcuggcagauggcauauucaguccaaccacguacaugcacaaaucaauuucccccaguuuaaaaugagucacaguuaauuucgaccuaauuuauugguuuaucgacuugcgaaccuuaggccuucgaagaaguggccuggguggcccuugagcaucagagcagcugaugaugccagaaagcaggacaauuggggugggcugcugcucagggucaagcugugggguuuauccuaguuacugggagaugcugggaguugaaauggguagacagugaugcucugugcauaguaguguggguucugugagcauggaacuugguaacagucauaacuacaauugugaaauaaagaguaauuacaaaauucagguguuuacuggguaauugcgugugcgugcgugcgugcguguguguguguguguguguguguaugugugugugugugugugugugcgugugggugucugaggauugaacccgaugccuggugcaugcuaagcacauaagagauaggcccuuagcccugagcaacuguugaauauuauggugacuccaagccucauuauugcugucagcagagagcuaucggauccuguguuguccuuguauccaaucuuccgauggaacauuacugaauaggcaugucugcuaggcauauguagcuccugaacacuugaacuacagggaguguaaccgaagagcugaauuucuuuucguguaguauuaaugaauuuaaagcuuaguagccacgugguggcccuggcugcugcuguccugccugccagcagaucucugguaaguagaaugaggccuagcaucugagcuguagguaucucccguuucacugagagaggcuaaucauagacaggggaaguagaagcaagaguugagcgcugugaacaaacccuaggucuuggaggcugcugaugacuagggcgggcuucaugggccacugugaaggaugaguggacacuguguucauugggggaggguugccucugcacaguugccuccuuccaucaggcccuuggaaggcugacccuucagacaagcucuuuaaaccugagugccucuucucuugugcugugcucaugcuaacagcccagggccaccccagcugugcagaggugugcggaggugugcggaggugugcggauccugagagucuuagcagggagcuguuagcggugaggcagccucuuuguccccguccuccacuuccuguacucuuacugacuuaccccaguggaccuggcucugucuuccaucccuuccacccuucaggcuggcaccaagacaaacaauagagguguguggucuccaucacuguacugaagccccccuccuugcuggcuggcccuuuaacuuagcaugccauugcuguugcugccgcggcugcaggcucuuggcuuggaaaaucgggacccuucaggaugauuuaucuccaggccccugaauuagauuaaaaacacagcuaggaauucucagaaaggcaggcugaugugauuauauccccaaucugaguggcagacgagggcaauaaaaagacguaggauaucaaaugcguuuugugccauguagagaccaauguaugaggcuaccccucccuuaaaaaaaaaaaugaaaacaaaaccaaaacaaaauacccaaagaggacuauaagggcuuuguuuauuuugaaagaagacuuaucuguggucuggggagcuugucccucacugcugacuaaagggaggccuggggaagguggcuagagucauuguuauguggaguaaguggguaagagccaaugagcgucauaggacucuaaaugugcuucaucuuucauccccccuuguaagcugagggaugguguccugcuaacacacacacacacacacacacacacacacacacacacacacacacacacacacaggagagaagcaauaugugcacaugcacacacacauacuauacacacauaaacauaaaacacaaacacacacaaacauacagacauguauacaugcauacacaaucucacacauacaacagacacacgagaaacacauacaugcacaugcacacauauguauaugcacacacauauacauaaaaacacacacacacaaagcacacagacauguacacauacacacacaauuucacacaaacaacacaugcacacuaucagaagccacuugggaaagaaauuggcucagacucugucauccuggaugcuuguugggccuggaccccauggaaccuuguuugucuauuuacugagauguccgugguaguugaagcaugauaauccugagaccuaggaaggucaaaacugaccuccuggauccaggacaaggaucuuagaagaaggggcccuugauucuagguaguggggacagaguggaacuagguaagcuaucuggaggcugagacugaaggaauuuaaauauuugagaccugugcccaauuaauugaguaacaugacaccauaccuaaaauuuaccucaucuguacauauuuaguuccuuggaagucccacacugaguaguuauaaaaauauaucuugcaguuaacugugcgcgggguuugcuggagcuggcgaggcgugccaggguggaaaugacaggguuacuguagagaccaagcaggagaagaaguauuaggugugccgggcgaaaguuggggagaggugaauaggcuguuaaaacagaguuagagaguuaggcaagcagaagagagguguggccagcuccugucaccagguugagccucuggucgaucccaggccauuuccuguuacugagaauuuagucuuccuuggcuuuggggggcugaaaugccuguaccuucuggauuaguugucucauuuguguuucuuucucaguauggaaaggcagcuggcaaugaggucucagcgucuucugcucugggaggacagguuuaaaugcuaugccuuuggggugugggccuugguagggaguagugucaccucgguagugacaauuugggacuuggacuuugggccuccccagcuuucugagccuuguuuucaagcaugagccagguuuccugaaaguguuaauugucacuaguugaaaaaguuaguguaguauguguugucuuauuauuugacauaugccaugucuuacucuuagguuccaggccuagugaugccgauguuaaauuuguauguggagcugugcuguaaagaacggcugauuggggcagaaagccauugugaugagaaaauaagugacacuuuuggaugucaagguuuacgaaacacauccaugguuuauaucuuguuugcuucuugcaacagcccugugagcuuggaaagaguuccugcuccucuccauucccagauggauauccuguagcucagacagagaagcgacuuuccccagguuagacagcuaaugaauuguggagaugaagacccaagcugagcuucugauuuguuucaaauuuaugugacaccacugucucaugcauaaaacauagaggauccucuuggguagagaaucacagcuugcuuuuuaguucccauccugucccuuguucccuuccuuuccucccccucccucccucucucccuccuucccucccucucucccuccuucccucccucucucccuccuuucuucccucuuucccuccuuccuuucccuuccucuuucuuucuuucuuucuuucuuucuuucuuucuuucuuucuuucuuucuuucuuucuuucuuucuuuuuuucuuucuuucuuucuuucuuucuuucuuucuuucuuucuuuuucuuucuuuccccucucucuuuuccuuccuuccuuccuuccuuccuuccuuccuuccuuccuuccuuccuuccuuccuuccuuccuuccuuccuuccuuccuuccuuccuuccuucccuguguaauccuuccccuaagccccagaguucucauauaauccccucuucuccuaggcuauucuggcucugcuccuguuuuuaacuuuuucaaagaugguagauuuuagggcucuuccaaucugagucuuauucuucccuagguuugugugccucuccuucugucacagccuuccaccccuaacugcucccucuccaucuuugguuuuauuagcucauccaggaagugcuauuguccucuccacgugaagucacagccucuguuugacaacuggaguuuaaccacucauuaaauuuguuacuugguguuucuuccucuacuaauuugagagaagcgaggcaagacagagaagucuggugcuuuccuaacaccuagcauagcaucuggauuacaguaaaugcucaauaaacauuuauugaaugagcgaaguaagcagcuauuuauagcaaagcugugggagccaaauaagagaguuuggggaaaguggguggccuggaacccugcugcggguaguagaaguaccuuugggggaaguggaagcaggggaauugauaguucaaggucagccugaacuucucgguaaguuccggugcagcuuggguuacacagcuagacucuugucucuaaaggaguucgugcauggcuuuggguuuucuugggaaauccucacaggaggcaggugagccauggcuucucuuguacacuuuggagauguuuuacuguguuugcaugccuagcccuggagaucccagaucccaucucaaggcagucgggaauguucccuguaagucucagagcagagccucucuagucaguaguuguuagauguucuuuugaguguccuucugauucugauauuuccuuuauuaucuuacccacaaguaaaggaagggaagguuuuccccuccccccaccccccccacccccagguucauugucuggugacaguguucaccuggaggguguggcauauggcagugaaugacaguuaggggugaucaugcaagccagugagaaugugguucuuguucuccuggugugguagaaagaaaagccuucccuuccucccucuucucuucccccucaaugcaucucuuugucugugagaaccucauagcuccggugaagaugguagugaaaugccagguuuuaguucaaggucauucuuucgcuuccucgucuauacaaugcgcaggaugacuuugucagcuaagugguuagugaguucugugaguacaggucgcaucuugagccgacuccaaggucaagugagugagugugcugaccccacagacaggccugucuucagggagcacucagaugcuggaguucaguucuccugagguaggaaguccagggaguguaaugagcuuucuaaauauaguagagacuuggucuggaaaggggacacugggagcugauuugcaugccucacauuuaggucaccugguuggaaaaaaaccuuguuguuggacaugggcaguccaucuuggauuuuggaggucccugugguaucagguacuugggggugcugacucacuccucagaguugaaggauaaggguguuuauuuuauaucucuguugauuuaaaacaacaacaacaacaacaacuacuacuacuacuacuacuauaacuacaaccaccacuucuuuguauuucauagccagugaggcagagaaccgaaccaggcugccuuguuuguaacaccucgaggucuguucuagaaacaagcaugcaggaggcaugauguugucuagcugggggugucuagggcaucuucagcucuguguuuggccaaugugaaggagguaauaguagaagaaaugagugaagagaggugggacccacuccaggaaggggguucccgucuucucgaguaaggauccaagaccauaaugaguuugguggcuuucuugacaaucccucagccugucuucagaccugcaacccugauuucucccagaaguccuugguaugcuuacagagguaagacaugauuaaagacccgcaggguaccuggcauccagcagaccucagugugcacuucauggcggugcgcagcucuuccuucauacgcuuagcaauuuauuuccucccuucuauuuauaacagcucagagcccaaggaauggacagcagaagauucucuucugcccugccgcccccccccagccucccaauaauaagaaucagaucugcguaccucuaggauacuccuucacaucccuugggucccuagggcaugcagggggauugagagauggccagagcgggugguaauguuugguaaagacuuugagcuaugccaaggagugggugauugcugagagccugcaguagcuaauauucaggagcugagccuguaagccugugacugucgcucuagcuggggacaacaagguugaugugcaugccgugacuauguagaugcuguuuacagcgcuuugaaguauugcuuuggccagagacccuguccccagccagccuccauuaugacuccuuugagcugcauauuuugguaguaucgggcucacugugagcugaaaggaaauaaguacuucuuacaaguaggagcuccuagguauuggaucugcacuugagaaguguaguguucuacccgggucauagaaaugcuuuuaaaaugaggcggcauuuacauaacagccauugagaauccaguggcauuuggaauguccgugcauugugcauuguguaucuauuuucucugucugcguccaugauguucucuaccuccuaaagaaacccaguucuucccuccucuccuccuccucagccuccuggcugccccucaucugcuuucuguccuuguggauuucucugcccaggauauuuuauauaaacugagucauacaguaugugaccuuuugugccuggcacauuguaguaaagcaaugaguuagcaucacauagagucuucauuaacaaccaugccagcuccccggcaaagaccaugcugauuucucuuuagcccaccaacacaguguuuucuucgcuucucacuaccuggaagcaagagaacagaccagacucaucaucucccaaaugagcuagagacuuuuauguguuuucuaaaugcucauucauggguuaccuuccgagggccuccgaauggaggaguuugcagggcuucugaucuuaggcagcagaucucuugaucucuguuuuuuaaccaggugaauucugggauacugauccugggccccauggcuuccaggguuuugcuuauggaccaggcaaccucugauuuugaagccagagugaguaaccucuagaggucugagccuaaaggaguuaccuccagcgcuuucauccuagaccagguggcuucuugggguucucuuaaaccccucgccugugagccuaccagaggucugacaggccuuuagauuuaguuugucaucuaagauggaguuuuauucagagaucccuauagcaugcaaucacauccccgcccccccccaagcagaggcacucggcuccucccuguugccguuacaggccccaauuaauugcaucucauuuaucaggcuccggcuaugcccugugcgccagagacaagagaaggaagguuguucacagcccgggguuaugguuaugacugacuacacaucaagguuauguuccuggaaaagucacacucccaccuucucccgcccacuggcagaccggugucuccuagaucagccuguggaacuaagugggagaggcugguggaaccagucugcaagccugcagcugcuguagagggcaggugauccggagagcuggcaguggagccgggcaaaggacccaaacacacuagaaaucaccaaggggaucaagccacaggaaucugugcguucuccaugcugugggcugcccugggggcuguuggcuucucggucacaguccccuggggacugcauccugccuuuuccuguaguucggcuauggacaggaggaaaauagacugcaugucaugaucuuaauaaaauuuauggugugcugaccuuccucuccuggcucccuugacuguccuuggggugcaucgauuccugcuacugauuuggguccugugcuuugggcguggggggaugggcaccugggcugccuugaagauuaguggugacucaccagggagguauucucaugacuggauaugcuugacaucucugccaaggcaaggaacugaacuguuugugugagugccuggugacccuuggacaagccuuugcuugucagggagccuucucuuucaccuugcugggcugcccuuuuccagucugcucuuagggauaaaggggacaucagauagaaaaggcuuuaaaaaaaaaaguuccacugaguuugcucuuccccucagaggcucucuuuauaagaauacccuggaauauuuugaugccucucuuuugugcccauuuuaucccucaccccuuaggaucaguuaacgaaaccuaugcucucugcuacaaagaccccagcaaguguugucagaccuccuccccacucugauccuguaacacuuuguagccuguucaacguguccucugauuguuaaccugccagagggagggcuucgcccacuuuugaggauggccagguugaguacaggugggccuuuuuaucucugaccucuggugaacuuccggugauuccccuagguuccuaaccccuuucugagugucauuuacauaggugucuuguuuguuccuagggugcagaugguuuuguaggcgagagaggguuuuagcccgagugucugaggugucuguguuggugggcuucugauccagcaguauucccaguuucuuccuggaagccuagguuggaagggaggggaagggaaagaaaguaacaguaaaguuugacucuugggggcaggaggaggugggggagucccuuagcugguuuuauuauuauuuuuuuugaguuaaauaauuuauuuguuuuugauuugcauguuucuguugaugcuugccuggacuuaucuacugguaaugagauguauacauauauauauauauuaucaucucuuuuuauuugaagccgucucucuucagguaguuuuuaguguuugguucuuggaucaaauuagaugcaggugccucaaauccaaagcagggccuuugcagguuaguuagcuucuugguggggcuggcugccaaguuuguggcccagguguuuuucuucucccuugugacaucugagagcaccccuacggaguggguggggagauacaaggguggaggaagaagggaaaggaagaggguggagcugugaagaggggcagguuuucugccagagcucugcagaaagaagugugggcccacucaacuugaacuuuuccuuaguucuagaguggugcuagggccgggcaggugagcucucuggcuucagaggcaggcucugagucccuaaagcuccgccuccaagccuguggguuugagaugacucaggaggcuggcagcagacaaggcuuauuucagacaacucugcaggagcucuggguuuggggaggccuuguucagcuucucagugaugcaccagagcuugucgguguccccacagguugaguagagcucaaguguucuggaaagugagucaucuuggagcugaugucugucagugcauggcaacuaagucgagaacacgugugcucagagugguagccacagccacaauagggaaaggagaaaaggccacacagcuaggcccaugaggcaagaucgagcugaaggaacaaagggcucuuuauuccccuuauagccuuccucaguuucuacagacagacgcugaaagcuuucuagcgucaggauagcucucaauucuaaucaguucagagggaguguuccuggaucagcggcaggccuaucaaucaggaacccaggaucuuucuacccuguuucucugcuugcaucugggccauuaggauccggaguugccaccuguggaugggggaagaaaacagaauugugcaugguccaggguagagugguccuauggaucaucucuuaaagucuucugucuagaacucuguuccugggauacaccuuugcugucucaggcuggagaagaagagucuauggugacuucagaaaguauaucaagagaguagguggucaagcugcgacaugguggcuuagccacagaaauggcuaccuaguccuugguugguuggcuuauauauucuuuuuuuaauuuugcugguuuacaaaauugcaagucuggggacuucuguuagcaguaaucuaaaaggcuacuuuuguucagaucugagaaagguuuccucauuugagacauuaaaagggaaauaaaugugacacauuguuaucucucuuagcacugaggcaggaggaucaugaucacuaaggcuaccuaaugagacccugucuuaaacaaauaacaaggaaaaguagagagacugcauaaggcagccuuccuuucgccucucaugcuuagcugacguggagcagugaugucucccugccacgaaacacugguuuagcaugaagcucaaaaagcaugugaccuuuuggccugugaaauuuugaaaaauacuuuaaguuguuuuuuaauuggcauaccacuggcccguguucccgagguacagugugaagauguuucagggggugugcgauagagauaacugguacauucagggaacgguuggggaacuaagagacagacaccccagucagagucagcggggagacuacuuaaaaucuccuucauuuuugaauacaauuagccgggcgugguggcuuguugccaaugauagccauccuaccaugcugcagaccaucugguuuuuccugcugaugggugagauggcucaggagguaaaggugcuuguggccaagacagauaaccuaaauucaauuccaggaaccaugugguugaagggagaggccugacuccaaggaaguuguccuguucucugagcuccacacaugcucuguagugcguucaugcgugugugugcgugugcgcgugugugugugugugugugugugugugcacgugcuugcuaaauauguguaaauguaaauuuuaaaaaagaccagcuauuccuuccauucauugcccauccuuaacuagcuagcccucucccaucccacgauuucaagccuauggagaauuucguuuugaacaaacaggacauuucagugauucguuuacaguuuuacaggugcacaucacacacacagaguaaagaucagcguagcuggggacugacgucaacaacgauaaaacaaagcaaguagucccuuggguagugcuauccugggaagauuuucugcagucugguuaaaugcacagggucaccgauuacaaaagggguugguguuucuuccugaggaaggugcuaaugguagaacuugcagggcagugagaagcgucugcccugacccccacacuucccaucucagagucugagugacagaggaggacuaagagaccugauuuggaauguguguggcugucggucacugugggucuugauuuccuuuuggucucuuucaggucagucugaaugacucccacaaucagaugguggugcacugggccggagagaaaagcaacgugaucguggcauuagcccgagacagccuggcguuggcaaggcccaagagcagugauguaaguaucuguguggcucuggguccuccuggugacaugcccuuucugaucuaauagguugucaugucagaaaaaaaaauaguggguaguuagggauggaugguaaggacuauacaucagugaagagauauggaaaguaaugcgugcaucccucguguacugcacacagaguggaggcauccaaggagaugugugcaguguagggugacuuugugacgucauagguagucugccuugauaggucuaaagcucacagguggucugcacucauagcuccacuaagugccaaagagcacucuagugcugaguugacuuggagcugguccagaucaaguuaaacuguuuuuguuuuguuuuuuuuccauaugccaacaagauugaugagcuauugacagaugaugucuguuucuucuuuacucaucauauacuaucccuuuaucugcauguauauccaugcucucuauauaucuccuauggaucugucugucagucaucuaucuuguaucaucuaucucucuaucuucuaucauccuaucuaucuaucuaucuaucuaucuaucuaucuaucaucuaucaaguuuguuuguuuguuuuguuacagggucucacucucuagcauacuccauagcuucuuuggcugucuuguggcuggccuugaacuuugcaguccuccagccucagccuuucuagugcuggguugcugagccggagccaccaugucugccugacacaaauucucuuaauuucuaauuuccacuguuucuguugaugaugaugauguuuugguuagaugauuugaagaaauaaaaacaaguuuacaagcugagaagccugcgcacgagccccagauccaggauggggccagaaagcuaccuccaaggguguuuguuuguuuguuuuuguuuuuuucugagacagggccucacuaugcagcccugguuagucugcagcuuucuaugcagaccaggcuugccuuggauaggccauuucugcaccuuuaaaaggagacacaggcucaagaaacauugucugucucuugauuucaguguggugucuggugcuuggugagugguagagagagaggcauuaagaagcagcagaaacacuucucagggccgugcugaaacaggucuuaggaugugggagccaugcagguuacuggcccaguacagccagaucugauuuuucagcacaaggccauauaggucauugguuuuauucucugguauugaggauggaaucuaggggcuagcacaugcuaggcaaccucucugccacugagcuuucaaccccaguccagaagucuuuuuuuuuuuuuuuuuuuuuuuuuuuuugugaaaaacugcuaagucuuaccaguaggcagauaaaguauauuaccuaggccaaguaaaaacguagggucagagcuggucuuugucucccaagucuacgguccaggcuucuccuugugggcaaagcaauugcucugcuuuuggguggcugucuaccuucuucacaagggugaccuuguacauagaacaugcuguagaccuuccauuguaugcauucuggccagagcuuucuauacucuugcuuuaaaggugcuuuugugauucgugggugugcguuuggggucugagagcucccugucuguguaccugcugucuggguuggguguauucagaguuagucucaggauguuuucuagagaaguugauuaggguggccacagucagggaugcuuacagaagggcugccuaucagcugcaggcugccuagagagcauucugagccauggagugugagauaaugcagauaauggcuagucuggguguuuugcucuugacaaggcugggcuuguuucgggcaacaacuuagaccaauuuauaaauaaauauguucaagguuugcaagcaguagcuguggucacacguggguggcuguguaugaaugccugcuggcuggggaugcucuguaguuaccuguguauacauuuagucuaguaccucuuaauaggagccucuucuaggcaccaaagccagcucuaugcuauucuauguugagaaaccuucaggguguuuuaugcaugaaaaauaaucucuuuccuauaaacuauuugucuuuguuuaccuauuuuagcugaacauauuuaagcauuuuuuaauauuuuuguuggacaugcaaagggauuuagggcacaaaugaauucacaacgggucauucaacaugucauugggggagugggguggaacaucaugaaaauggagguccuaccguggucuuagaaucaccagaaagacccauuuuuuugugugugugugugugugugugugugccaagcacugaaaggucacaucuuagacccucucagucuugagugaaccgggaguguuugaccacccacauaucacuagucuguccaacucagcucuuauuuuguggaaauguuuauguguuuugaagaacuuauugucauuauucuacagugacauaugagagaagauuaaauggaaaggaaacuuaauguccagaguuaauaaguagagauggcagaauguucuucuguccguguacaaacugcauuaaagaguuggcugccaaagccgaaauguucggaugugaaaaguuagugcaaaaauaaacggugacucagaggccgagucgguggcacuggcaagggagcauccaaauguuccuuaaagaggacuggaagcaugggucagaaaggccccaucugaggggauagagcuugugugcagguaaggccugccugaagggccgagaauggcugaggucaggaguacucuguauguaaacaaggcugggccuggacacugggaucccagauggcuuacuuauaagcaaaagccaaaccaaaccaaaccaaaccaccugucaucaguaaucauuagcugaggguggucuccugcaaaggugaucuguuccugcaaugagcagaagaacuacaacauaggaugcgcuucagccggccucugcccaguucuuuacuuuugcuuucuggugauguguuucagaaaguacuuguguacugcuguacacaagguaaugauacuagcacucaaggggcugcgacagggggauugugaguucaagccuaaccugggcuacagaaugaguuccuauucaaaaaacaaauacaguaccucccauucccaauaacaaacaaucaaccaacuaccagcaggcauaagggaguacucaggugcaaugucauugaucaaaaugcuaccuagggacacuauccaccagagggucagaaucaaccaagaugcuaugaauagucagacucauucuucuuguccguggaccagugugauaugaugauugguuucuuccuggaccaacuggguggcagaacucccauccuugcuaauggaacauagagcaucugaaaucagaaugcuugggcuggaguccuggcucugccauuuaugaucugacuuugagccaagcaauuuacauuauccucgucuuacaguuuuuguuguuguuacuaugacaaaauacuugagacaaucuguuuauaaggagaaaaguuuauuuugacugacagcuuuagggguucuaguucaugaucguugaucccacuguauucaguucucuguguguacagccuagugcuacagcucaguguacguaaaacaauugcuugggguguccaagguugugggguugcuuuucaguacugcaaaaacaaacagcuccccuacucccaaggguuggugcccuugcugguuagcuuuuuuuuuuuuuuuuuuuuuuccuaaacuugacacaagcuagagucauuuggcaagagggaaccucaauugagaagaaaauaccauuggaucggccuguagguuccucuguggggcauuuucuuguugaauaauugauguggaagagcccagaacacugugaguagagccacccugggcuagggaaucuggauuguaugaaaggcaugcugagggagccacggggagcaagcuaggaagcagcauccuccauggccucugcgucagcuccugccuccagguucuugcuuugaauucccgcuuuggcuuguccggacggugagcuguaaccucuaggucaaccaggcccauuuuucccuaagaagagcccugagaaggcucugugucugcccaagagaagguaagaaguuacaaggauaggcuaaaaauagcuuguuugaauuguuccacccggacaaggcaaggcagguugaugaguggcccgggauuggcuucagggcuaggguugguucuugucaacuuccucuuaaccucuauuaaguguaagacucuggagacaguccaguuuguuugcaggugucuugaggcagauguuuuuccuccauaugccccauggcagccccguuguugauaaucucaggaagucuauguguucugccugccuaggucucuucucccuucuagcuagacuuccugacauuaguauggagaaggggaccaucaccaugaggguaacuugcagagagaaaagacuagcaagcaggcucggaaccucuagagacuggcaaagccaugccaguuacugccagcgugacccugggcuaguccuuugcagcuguggugcuuagauuuuauuaucucaaaaugaaacaguaacagcagaucgucuguguguccgugaaucgucugugugucugugagcucuaccuccgugauucugccacuugugagcagaaaaaugugagggcagaagguuauauccguucugaauacagagagaguccucccccucccuugucacuguuaaaacaaugcaguacaaacaauaaguauccauucauguauuauaagauauauauuaucugaauuaugguaagcuguuuagcgaugguuucaaguaugugggagaaucugcguagguucuaugcuauuuugugucagagacuugugugucaccagauuuuaguauccauggggacucuggaaccaauccacggcagauaccgagagccaucuucuccaugacucaccaauuaauccgguucacucuccuuguucauugauucugcacauucauuuacucauucuuugguuuauaggcauauuuguucauuaccuaagucuuuguugacuaagcuguguacaccagcuaccccgaagcuacacggaggcagaggccaaaugugugggagggaauauuacacacugaaaaaaaccccugcuuugauguaaacacaggaccccauuugcgccucucacagugaauuaucaccucacaggauauuggagucugaaggggucuugcucaguuuccuauuuaagaagccauaaguuugcgugguauagcuucccaaccuuucaugcucauuuuuggcaagcagaaugcaagaaggucccaccuggucucuugaugauaacucagguuaucugugaacuaucaucuaccugcuagcuggcccugugccagcaccguccugcgaacacccacguagaggcagagacacccugccuccuuucaccuugccacguauuuauuaaacgguaaugaccccuuguuuccugcguccagccucggguccuuaaauauauguucauggcuucauuaacaagcaagcauucacguguuuacaggcccauccuugucugaugacccugucuuuugugucucccugugucuggcacccagcacuggacuuggcuccuguuaaacucucaaggcucauuuguaguugaaucaaauggguggggaugacacuauaguuucuggcuugaguccagccagucucuccuuggaaauugccugcuguuuuccuuucaugccucccucaauuaccuuucccauaaguaauugaaaaaaaaaauaacacugugauauucaucugucagguuuguuuuucaucccuugauuauauuaguauuucauagcucacagacaguaaagucuagguuacagauaccccacagcagccugggugaggcucucucucuccugguucuuuuuuuauguuuuucuuuuagauuuauuuuuauuauuuauuuauguauaugccuauguacgugcagguacuagaggaggccagaagaggacguuagaucccuggagucagaguugcaagugcuugguugugagcuuucugaugugggugcugggaacggaacgccauuccuuuggaagagcagcaagugcucuuggccacugugccaucucuucagcccccgcccuguugacuuccucugcuguuaccugggcaaguccccgaucucacaaaccuuaugguguucucugggccaugacuuugcaauugcgcucuccagguaggguugcugugccgcugacccaagcucaucccugugaugggaucagcauugucucugugcacaguguguaaaugacaguuguucugaugcugugucucugugguuacuguauuauuagaagccaggaggcaguggaaaagcaagucauuggcaguguccaggaucuugcugcuucugcugcuauggucucccaugcuacaaaguuacaaaacacugaugggugcugauacggauggugcauauguguauacgcuugugcuaggggguaugcauucuagacaacgcuguaucucugugccucccccuccagcccgcuggcauuguaaccucugugcauguuuuaucacucagcaccuccucccucuccacucauggaggccguugauggguuucugucuucaggaaugccaacuuccuggcugaaggaggaagaauucaauuguccugauuaccuguuggggacaugucaacagaugcaaaagcaaauuucugagacagagugcauucugucuacaucuggacuggaacacgucaccuggcaggaggaggauguccuauugacaguguuugccaacugauccugggaccucuguagugagagaacugcgugguccaggagcaggcguggcuguaguguucucaugcuuucuauugcccggcccauccuaucuuugaggacaguuacagaagucacaugcuucuccuuuguaggucaugugaugcucaucagaaguucgugauaucagggccuccccaggggaccaugcucuuucaggaucaggaguagaagugagcaagcauguggacaucaguuagaggcugcucuguuuagcacuucucugacucguguuuuuucucuccuucgguguguuccagguguaugugucuuacgacuauggaaaaucauucaguaagauuucagagaagcugaacuuuggcgugggcaacaacagcgaagcugugaucucccaguucuaccacagcccugcugacaacaagaggguaaggaggcucuguuuucggagcugugcauucugggaagauggcugcacugaaggggacugggccacggagcccuuuacugucuuugcagcacagaugggucaccagcuacugguuuucagucugcucuugggaguuggugacagaauacauuucucaagguggaucuuugcauaauccgagugaguacuuggucaggcaggauuucuggacaaacaagggcagguucaaccacagaaagucugccaaccaauaaauugccugacucacugguggcuggagcguuuccuagguacacagggcgaauauggggccuccaagaguggaugcugaacuguuucuuuuguuggcuuuaucaacaugugucugucucucucucucucucucucucucucucucucucucuguguguuuguguuuuuucuuuucccuccuuggaaacuuauauagauacagaaaagaaacucuaagaaacagguauggcuguguccacaccucauaccuuccccauuuagcacgcucaguuaccuuccuauuuuggucaguagccccaggcaugcacugggagaaagcauugaccuuacucugggccacaggcagauggagcuggcagagugugaagggaaccugacagccuacuaggcuuuccugcuacuugguaacucuuugcucugggaguuauauuagaccccagguuucuagagguagagauuucauggcuucuaggaaaugucccaggguagaaaacaaccuccgcaguaaaagcuuccugaggugaagggagcggcuagcuucugccuguccagaaggacccgcugggccaaggccacagaguccuuccaaggccuccauguugguuucucagguugccuugggucuuuuagcaaaggcugcauuaaaaagauuuaacaagucaugugguugguugucugaccaaucagaacagaccuucucaggagggagcugggucugggaggguccuuuuaguugcuggauuugugaagauguccugucauucucccccucccaguccuccccgcuuccuccuccccacuuccugggggccuggccagcccugcuuuaggaggaagugcuuaagauguuuccaggcagugacuccuuaccggcaccgguguuacugguaccugcuggauaaaucaacaguccugccuggugaccucaggguaaugggcaguuagcuguacacuucccaaggggaaagcaaggagaaauuggaggaacugacucuggucuucacuucaccucccgccccuaccuuaugaugagucaggcuggucuugagggcccuagagguggggaguggccaccuuauuaugggauuguaagaggugagaugcuguauccgggaugcuaagggccuggcugcugcuucuggaugguucucugauuguuaccagagugugcuuucguaaugaugauugucacugcuaggucuccaccccagcucacagcuugggcuaaaguccuggcccugaagccuccuuccccacacccuggacucuccccugcuuuaguaccaguauacccucuccaguuuaggguccaaauguaggcaaggugaccuuccuccccguuucuaauuagaccacagcuuguagaccacaaagcugaagacaggaaggaugcuuugugugcccgugaacuuccuuagagcagacagaagaccugagcuuuuggagcaucuggucugcagaagguguagagcaucugacaugaugggcuaagaggggagcagggauaccugaauggucaccauaaagagacuuuggcauugcacagagagguggggacaguguguuuauagcucaggugcauggugcgcaccuacuuccccagacaaagccgucacacuccccagauaucuccggaaggacgugaugacauuuacuguacugguggggcuucuuuuaccuuuguccccugcaaggcagauacugcccccaccagacacuuaaaccacuuccugagaaaagccacacagggcugggugccuugguguuaagaguacagugcugggcccaggcuauguaaggauguuuaguggggcuggcagugucucauguggcugccagcaguagcuauggaaggccuggacagcaagaagcaacaauauggaggcgcuguggauugggaaagaggaucaucugugccuuugccuguacacaaaacauauauucuguugcuggcuaauugguccuguaugcugcucccugauccgauguuuaggucuggccaucuggaagcccuccuagccuuagaggcacccacagccaugcaggcagucacucuccauggagacaugguuggcuuuuacagucuaaccuuagcaggaaugcagaugaauccaguccuuauccaggcugaggguggauguggggacauaggaaacgguuuguuugucuucuuucccugcuugccuccucugugcuuccaacucaccaucauaacuggguuccugcaucaaagcuggagaaaguccacuguguggauaaaucuguaaccuacugucuucaguuaggguuucuauggcagccaugagacuccaugaccaaagcaacuugggggagaaaggguuuaucuuagacacaguuccaaauaacagaucaucaucaaaaacgguaagggcaggaacucaaguggaccagaaacccgaagggaggagcugaugcagaggccauggagagugcugcuuacugacuuacucccauggcuugcucagccagucugcuuucuaauagagcccuggaccaccauuccagagauggaaccacccacaguagucugggcucuccuccaucaaucacuaaauaagaacugcccuucaggcuuaccuguggccucaauugagacucccuccucucugaugaucccaauuugugacaaguugacaucgaacuauccaguacucucacuuuaucuuugcagaaguagcucugggaagcuaagagauugcaaacaggcugcugagguuagaguaggcagagaugcuucugagaucucaauuuaggaaacaguaggucagguccguuggacaguccgugugguuggccaccacagaccccaccagccagguguuuagagacuuaagacucuuaaggccuccuaagacuuaagguagaauauucgguuugugccaugugacauagcaucaagguauacgagaugcuguggguggcgagugaagccuguuucuaaguggaacggggaugauuugaggugauacggcccucugggaugcuguggauuaagaauggggcuuaguguagacaucugaggucaguagugggagcagaguugguaggggccuacacguaggaggaaggcguuggugaagagacuccgggaagcuggcucauggcaucggugcaggacgcucaguauugccacccugucugccauuuggaaguagaagggauugacuuugaccuugaggacaguggggagcaccgagagaaucucugagucugggaguggugggcaggaaccuuuugggaaguguggcuccuucuaauauguguggugaauuagagcagaaagagcagagaaaagucugaaaaaaaaugaagcauuaguucucagugaugggauuggaaggaggaaccaugacaccuggcuuuuuguguggcugcugaggauccagacucaguucaacuugaacaaguacuguguugacugagucaucuucccauucccaguccugagaggccaccucuuuaauggcaccaccacuuaacguugccucuccaagggucaagcuucuaaucuguagaccuguauaggaccaaccacaucggaacgguagcaagcacucaguaucgaguguuaaaggcaggguugaggcuguguggaagaauacugcauugguaaaggacaucauaagacucuaagcauccaagcagggagguagggaugaggaaucugcagagaaucgaaguccaagguugucaugggaggggcaugggggcugcagagggguggagcagaagguauagggggaugagucucaggggaaagcugaggaacauucgaggggaagaggugcacgcgugcguuaaagcccacagugaaaugcuuugaggucaggggaugcugcuucugguucggagagcacuaaagauugaugggcuguuuaaaacugggcucugcaccagcuggcucugacuccgcuccugcgucaucucgggcauuuagcugccacgagcuucgguguucucguuauuagaagggggggggggugugacagaaugacccaaaacacugagucacugugaaugaggaacagucuaaacaagacauagccugggaaacuucuaguucccugccuaucauggagcaaguguucuucaccaacaaccaaacccaccaaccaaccaaccaaagagaaacaaacaaaaauuagcuuaucauaaucaguaugguauuuuacacucacaaauugauauuguaggaaggcaugacacagauuucucuggagcaauccuuucugauugagagcaccaccuuccuucucaaggagccaggaugguuugggagcagggaggcaggcuauuuuuagggaagacauccauggccacauuauaaugcucuugcugggcucauaauuguuucuauugcauugaguuugcuuagaguaguucuugcuuucaaaacauuuacuaccuuuuuuuuucucagauuuaaugaggcugcugccgagugugagauuuacauuagaugcuggggaggaaguacaggagagagaacgcaggagggacaggccaagaagaaggaaggagggaccuggggcagggcagcuucugugcaggcugcugagagggaugugaagauggaagcucaugugucauggagggagauguccuuggacugauucccuugccuugguugccuuguagaaugugaagaacugguuguggguggcgcugggucccuucugcucugucucugauucauugucugguccuuggggcccccguucuuguucuucugggagcacgcccguccuugccacgcccagguuccugucucaacugagcuucccuggcuucuuucuuucuuuuucuuaggccucugagccugucaucaaaccuauauccuaguaccuaacucccuacuuuguacccaaagucacauuaacccagaccugcagugcucuuuccuuguagaauuauaccuucugugcuggugaauuuuggucaacuugacacaaaacuagaguuguuugguuagagggaaccucaccugagaauuugccucugucagacuggccuauagucaagucugugggggcauuuucuugauuauuaaguugauauggaagggguccagcugacuaugagugcugcuacaccuaggcagguggucuuggguugucuaagaaagcaaacugaacaggccauggggagcaagccagauagcagcuuucuuccaugguuccugcuucugcucuugcuugaguuucuacccuaacucuccucagcaaugagcuaugauugggccauauaagccaaauaaauccuucccccacuaaguugguuuuggucauuuuuuuuuuccccauggcaacagaaaacacacuaauucccacccacucuucagugacuaccucuucuacauuguagccucugauacuuggggcuggacagguucucacagugguccaucugugucaccgcucacuuacccuccaucuguggcgagccgugggcauguccaccucucauguaggcucugccaccuaggaaaggauucuggaccgugacaugacggcggcacaccuagcauauagcugauggaaucugcagucuucacguguuaaauuauacaaccuuagucuggucuucaugaagucuggagguggcagcugccgccauucaaguagaacuuguuuaaagucacugacguaugaagaaguaaaacaaggccauggccccugcuucccacagccaguuucagcagcgcaguuggcuccugggggucauacagucaccuggcguaagagcaaagaggagaaccacgucuuagauguagagaccuuaaugguuuuccuggaaaggcaugaucuaugguugcucagaagaugcauggggugauggcagccccuauccagguucagcuaaucugaugggcaucuguguucuggcugccaguagccaccuucugacuguaaccaaguggcuugccagugagcaagaguagccaaguuggccaagucaaugggaaggaauaaaaaaaaaaaaaaguuugccagccucaugaccugguuaaacaggcuuccuuuguagucuuaccuggccugucucugcaauccuuucuauaugggugucacaugagggauagaggucaacuucugguacugguccacaggcacugcccaccuuuuuuuuuuuucuuucuuucuuucuuaaagauagguccuaauauaugcaagguaggaaccuucuucaugaguuaucucccugcccugcccccauccuaaccaagccugguuugaugcauccagcaucuuuugguugccaggagcuguagaggaagaaggugaagcccuguuagugccaugcccacucacccaggguuacuuggacaugguuuggggaccugucaggcggcucuggugugccagacacugcucugagauugccuguucugucuugcaguacaucuuuguggaugcuuacgcccaauaccucuggaucacauuugacuucugcagcacuauccauggcuucuccaucccauuccgggcggcugaucuccuccuccauagcaaggccuccaaccuccucuugggcuuugacaggucucaccccaacaagcagguaagaaccuucuggaacacagacugacauguguguguguguguguguguguguguguguguaugugcauuguguguguaugugugugugugcauguauguguguaugugcauuguguguguguguauguguguguaugugcauguguguguguauguguguguauguauguguguauguguguguauguauguguguaugugcauuguguguguauguguguguguuugcauguguguguauguguguauguauguauguauguguguauguguguguauguucauuguguguauaugugcauguguguauguauguguguauguauguguguguguguaugugugugugugugcaugugcguguguguguucacgcauguacacauguguuucuuuugaaauccucugcucugcuuggguggauuacauguccuuuucaugaccucaccuccucccuccucuucacucaggcuuagccuucguagcuucuauuucacuuaccacagcuaaggaaaaguauacuccucuuggcacucucucucucuaugucccugccagcacccagcgcccaacacuuggcagguccugugacuucagcccuaggcaggccuuccuugcuguauaugcaucuuugcaagccuguggguaaguugaggcccagacauuugguuagagagagucacaugagaaguuuggagccugagcucuuuuguggcuucugggcauacuccuguuugacuuuucuguucugugcugccuugauuugguuugacuuuugacaaacugggauuggacucaggcccucaugccucucgcucaucuuuaucuuggccccaccuuaagcacacagcacuugcauuugagguuauuauaaacguuaauagcauauuaaacgcuaauagucuuccucuguauuugugcgugcccaugaguucuaaagcgaaugaugucuauuucccauugugaaucaaguuucaaggaaacuaacaggggacagagagccuguggggguuucugucucaaggcuccaaugugucuuguugcauaaaccugugaacucuucagguucuguauaaguucuggcugggaaggcuugaaugcuuuugcucagaagagccuugaaacaguucuuuugcucugagguuguuuaaccaaaacacagaucuguuuaccguugcaagccuuagggaguaaccuaagcuuaggggcagggucaguuuaccaguggagguggacaauuguuagguuuggucucaggcuucuuaaucuuuucugccagggaccauggaagccucuggugucuauagguuguggggauuugauaaagaugagcuggcuaaagucaccggcuaaguucagacauucaguugaucuuugugcucugggcuuagcuagugcccucugcagucagcagaaacgaccgaggcauauuuacuuauuuaaugcuagguaugagacccagggcaucuuacauggcaggugagaauucugccaccaccaagccauucccauagccuacagauuguauuucaguucucuuuuuagucuauguuucuuuuuuagagcauuuuaucaucuuaacuuuuugugcguucaguugacggauauggguuacauuuauacggugcaauaucaccacuaccaagcuccagaacucugucuuguagaucugaaccccgucuauguuaaauccauacucccugcugccucuccuucccccagccccugcuggccaccauagugcuuucagucucugaucuuggcucccuggaucccucauagaagugaagccaucugauuugucuuuuugugucuggcuuacuucacuuagcacaguguuuucaauguccuggacuccagggugugccaggaucacauuucguuugcaaggagggucauaaacuguuguauggauagccugcauaucacuccaucuguaccccaguggauacuugcauuguucccccauuucuugcuuugguuuuuugcagugcuagguaaggaaccccgggccuuacacaugcuaggcaagucuccuauucugacaccuccucacucaagcagugacacaacccguaaguggcaggcaaguuguccucauuuuuccucccagccguucuagaaaacagaucuguccuuccuucugcuccugcuugcuguacugugccugagagcaggucuucacagcgccccguggagggcuaggcuccaguucgugcugggggcuaucauaugguggggauaugcaucucuucucaugucaugacugcuucuugucauuuuggucucugcagcuauggaagucagaugauuuuggccagaccuggaucaugauucaggaacacgugaaguccuucucuugguaaguugugccacgaaacaaacaagcaaacaaacaaacaaaacccuuggcuccaucaacuuagauuaguucauuggcaugacugggaccaaaauaucugacaguaacaagaggauuauuucagcuccugguaucaaagggugacgguuugagaugcugaggaaggauaggggguggggguggggguggggggagucuguggcagugggaggggcugcaugagacuguucacaucacaucagaccuggagacagggugaggaaggaacuagggacaggguaugaccuuaaguccugaccugguguacuggcuaguuuugugucaacuugacacaggcuggaguuaucacagagaaaggagcuucaguuggggaaaugccuccaugagauccagcuguaaggcauuuucucaauuagugaucaagggggaaaggccccuuguggguggugccaucucugggcugguagucuugguucuauaagagagcaggcugagcaagccaggggaagcaagccgguaaagaacaucccuucauggcuugugcgucagcuccugcuuucugaccugcuugaguuccaguccugacuuccuuggugaugaacagcaguauggaaguguaagccaaauaaacucuuuccuccccaacuugcuucuuggucaugauguuugugcaggaauagaaaccuugacuaagacaccuggucaccuucugcuagccaggccuuaccuccuauagguuugacaacuuccagcugagaacaguguucagaauaagcagacuuuaacugugccaguggacaguggaugggcucuuugcucuccugugaagugaggggcauuuggaucaagcaauaugcuguucugaccugagaaguagaacuuggagcaaacuuaccagguggggguggggaaggggaugcuuugcaguugguuagacaaccugggguaaccuugagacucuugcaugucuuagagccccuacacuugcauguucagggcauuauuaucgcaccagggauuuuuuuuccaugguauaaaaauccagacuuuguuacaucuauuacauggguugguuuuguuuuuuguuuuuguaaugccagcuaaacaaaaucuuuggauacaguuguggaggagaguguaguuuaugacgucagaaaaggcauuugguauacacgccacacauuuugguggaagcaugaaaguaccaggcaacccuggcuccucugauccaggcugugaguggcaagggggaagcaggaaauagcaugcuguagaugguuguagcgaacaggacuucaugaugggagcuagcuggcuggaagcagcuguguguuacugugguacucggguggggaauacugaauuuuauguuuggacaauguguuguuucguguuugugaagagaaauuguguaagaaucuuuaguacugagggacagacauauggcucaagagguaaaggugcuugcugccaagacuuuugaccugaguucaauucccagaagccauagguagaagaagacuaacuccuauaagcuguucucugagcucuguacagugcuugcacuguggucugcauacucauucgcgagugugcgcgcacgcacacacgcacacacaaacacacacacacacacacaaacacacauacacacacauacacauaaagcaaaauuaaagaaucugcaauguuugaggaagguauuuugacugaauucugagugcacuagguaaccacugaagguuuugaagagagugaagcagacagagugucugucaaugauuccugugccuaaguauugcuaccgcuugucaccguguaaugugaccacaguggaaugcaagaucuugaccacagcuauuugcacaugugcagugagugggaacagauucuugggacuugguuauaaggcaagugggucugucuucuuuuggucauucuguucccaugaauaauagagagaaagcacaaacgaaugucucuggaauugacucuuuagcguccuuuugcagggguccuugucacuuuguccagagcaucuaggaucaguuuucuagacauuguuguuagaugugguggagcauacuuuugaucccaacccucaggcagcaaaggaagguggaucuugguguguuugaagccauucugucugaucacacagccaguuccaggacagccagggcuacguaauaagaccuugucuuaagaaagaaagagagggaaaacaaaacaaaacaaaaaaggcagaaaagaauggaagacauugugaucguugauucuacguuuguuuuaagcuccacacuuucuccaucuggauaucuuguggguucagugacccguguauguguguaugugguguguguuuguguacguguggauagacauguuugucucauguauguacacguaaaaggcuuggaguugucacccaugucuuccgacauuacucuccaccgugucuguugagagagggucucucugugaauccagagcucacuggucugacucuccuagccagcaaaggcagucuugcuccaggaaaccuucucugccuccaacgugcugggauuacagggcuuccacaccugccuguguuuuucuuuaguuugagggaccugaaugccuguccuugugcuugcaugguuaagugcuuuacccacugagccaccuccccagccccuaaaugaccuuacuugccuacccagaacugccugcucaauuacggcuuuaccugaacgaagccacugcucuugcucaugagucuuagcugucucucuggggucacucuuguccucuggcaguucauccucagaacacaggcagaacaaucuuuuugaaccaguuuggaucauguucuuuuuuucugagccuuuguguuauguauggcguauaauguucacaugucugugugcacaugugugcagauauguauauacuuuccccuguauuuuuaagacagggucuaucaaugaaccuagagcucauuaauuugacaagacuggcuagccagaguuucccagcccccacccccuuagcagaagccuccacauccaugucuuacaugggucucauauagcaagcaccuuaccugcugcaccaucuccccagcccuccugugagccuuugcaugcaucaucauaucccuaagauggagugugcauggaccacagggcacauggccuuugcucuuguucuuagcucuggcuagaauguucuuuccuagcuuguccuuccugcccucccuuuggguuuaucguuuaucaguccccgagacuuuuccaucagagcuuacuuauuuacuuacauuuuauuagcggauguucuauguugcuaugggagagauguaguuaguaaagugaugcccacagccaagcagauuauaugucuggucacaccuggcuguccuuuugcguguagcaagagcagcugcgauccguucauuuagcaaaaaucccaaacaccagcuaugauugugagguccaguccucuguguauuggcucucuugacuucuuucuccuccauggcuucuacuuuuauuuccuccuacuuuccucucccgucuccacccccaugugaguuuuuacauuuuuaaaaggaagugagagcauacuacgcuuuuucgugugucuggccuguuugacuuaacauaauaucuucuaggucucuccgcaucgucacgcagcagcuucauuuaaagauggacuaauaucccacugugucuauaugccacagucucuucuugcauuucucugucuguuaaucaacacuuuagcuaucucagcucgagaaucgugccgcaguacacaugggggugcggaccucaggggcagugaguucauuuccggugggguuuauauccagacugcacagucauauggcagugcuacuuuuaauuucugcagguccuccccaggcuuggggacgugcucacgaugcgagccucacacagguucugccuuucuccccacucucccaacaccccggucuacugucuuuuaagugauagcuguuuuucuguagggaacuuucugaagauucuacuuagaauuacaaguauugcucugcugguucagcuacaugguacccuuuuuguguguaauccuuuauuuugcucuagcauacaguuguauggcuuauuaacuguuugccuucaauagggcgaaaguaucgcagggaugagauuuugguagucucgugcacugcugaguccccagggaaauuguaacuuggguagacauugccaaauguuccauggacauugucaaauuuacuuucaucuuaguagaauagaauagcgucuuuaucuacagcuaagggcacagugucucauuuagcuuuaauuugcauuuuucucauuaugaaugaguuugaaugucuuugcuuaagaacacuaccugccuccuauaagauaggccucauguaauacuggauagcuuugaacucuuuauguauuugguaagaaucaugaacuccuaaucaagcaugaauuuaaaaaaaauguucuucuuagcaaguuccaugacaacuaugauggcuacacagagaagucccauauaaaucaaucaaucaaucaauccauccauccaucaaucaaauaaaaagaacaaaacaaaauguucuucuuuuggggcauuucugcuaaugucucuugccccuucucugauuauuacucuucuuauugauuucugagaacucuuuauauauugagauuaggcucuuuagguaucauaugagagagguuauauaugugcuuuuguuugucaguuauuauuugacuucugagauuuauauuuaguuuuagucuacauugacuauaguggauaaagaggauguaguuucugcccguguuuauuuuggcugcuuguuugaacugaauguuuucgagucgauauuauucccuuaguaacuaaggauggugaagaaagaugauagcuaagcaucuuccaagucacaaggacuuugcucucagagcaggcagcuucccugaucccuugguuauuuuccuugggcagaggcuguggguauuuuaggaaaauuauaacgaugcugucaggaaagaacugccuccauccaggagucccguaaauuucucuugccuucuggggagaaauugauugaaaacaauuuuagguuuauaugcaugaguguuuuaccugcauguauauguauggaucccaagugugccuggugcguacagagucagaagagagcauuggaucacuggaguuagaugguugugagccaccacguguguucugggaacuggacccugguccucucugagagcagccagaacucuuaaccacggagccaucucuaccauccccaaauuuaucauuuuaaugagcagcauauugagaggucgagccagcaguguaaccaaaugcaggaguauuuagcuuaggccuuugcucucuaacuucugcaggcucacagguguguuaaaggguuuggcucacuuuauuucagauccuuggaagucuaguauugagauuuaugguggcuggggggauuucuucauaaaugucuuucaacauaagaaacagugcaagccgaucuuucaaagaauuaacacagguuucauucaccaugcuugucagccuuggaacaacaggcaaggaggaaggggccggggccgagaaagcuaguaaauguaugugcagauaggauaggggaagaccuguaacagggcagcccaugcaaggguguccugugcagcuucccuauggggcuaugggugaggcaguggggccucgugugaaacuaugcuuagaaauagccaauggaugggauuucuuuauggaagacagaaugaaaaguaucuaagauccagagagaagcaggaggcaaggagaugccagaguauaggaaucuguagguugaaccaaccccagaauuaggauguccaaauauggacgagaggagagagcugggauuagagguauaaggcuucugucucuagaccuuggcuuccucuuuuggcuagagcaagggauaauagaaaugaguucaucucaaaauaugucaagaaggguuccuuccucucugcuuuuuaaaaauacccaccagccuccuugucauuugcauauccuccaggcuagaggaaguacuuuaaucaguacuucuaauuguggagaagagaacaugucaccagccgcccccacacuagcaucugaucgggaagaauggauuucucccacgcugggaccaggcugcuggcuucucuaucacucugcucagaguccagauuguagggccaacaucaagucuucugcuagugugaaaugagacucucuccuuuuaucucuugucaucuucuugugugcguguucacauguguguauguguucacauuuguguguucacaugugugugcguguaggccagagguugaugugcaucuuccucuaucuaauguguaucagucucuaucuuauguuucugggauagggucuuugauugaacuuggcacucacuggcuagacuccguucccaucuccccggugcuaggauuggaggacaccacacacugccugucacacgguacaacagccacuugcuuuaauggcuguaccacguccccgguucuauuucuuccuuuuaaaagaaucuguuuucuuugacgaacauggccuugaugguccaucucaggaggaauuggaaaugacccucaccuccaauaugcuaagugcccccaggguauuguggaacuguguacaggcagcugcagaaaugccacccucagcucagugcccaagucgucuccgcauggcuacucuggaguucuuuccuugacuucccaguuaguuuuccauuugcuggcucaccagcuuuggcagguuuugugagugugaggaauccugggcacaucaguggccuucccagguucugguuggugcuuuacuugagggcacuagcuuagagcuucuccacuggacuuugaccuuacuccuaaguuacaguugggguugguauguauaguagugggccaggcaucgaauacagugagcaucucuuuagccagggauccuguuaucucauuguccccaggccaugugacaugcccacggagcuugcccaaaaccaugugacucgguggguaagaggccccacuauagcacaaugagacugacuccagaauucacccagccucaguacuuucaucccuuauguugaguuaaaaacucccccacaaaagccuugcuagugcauguuccgagugagugaguggcuaacacugggaggagaaagaggagcacugggaaggaugcuuggaggacggugauuugaacuuggucucagaggagaggauuuaggugggaggauugaguuuguacaaagggugccucuacacagagguauccaccgaagcaugaggaggacgagggugccugcccucucugaaggaugccuugcgugacagcugagcaggugccucgagagagacgagauguacugguaagacgacuccagauggcauggauuagugaugucugcaaggaacaggcaaggaaacaccugaaagacaggccacugggcucugaggguucucauguggcccgugugcuacuguaccaucgagucuguggcaccuggcaaaaaugccucuccgggcaagguuccgagcuuggcacuaggaacuugcuucuugccuccaggagcccgaugaugcuuauuucuucagagccucccuaccuuuugccuuuugcuuuuuccguucuuuugcaacagggccagagauggcugcgcacaaaucccaggaugucuuggaaacagccacagcagaguaaaacgcuugauaaguggcagauccccaauuucugucccucacuaaggaacaaccaaaggcacaugcuugaggcagagugccauuuguagcuggcacuacgccgauccugcacgguuguccucccagggaaaugucugugcuuuagugauuaacuaggaaaugguaacaguugcuucuucuuuccaggggaaucgaccccuaugaucagccaaacgcuaucuacauugagcgacaugaacccuuuggguucuccacagugcuccgcaguacagacuucuuccagucccgggaaaaccaggaagugauccuggaggaagugagagacuuucagcuucgcgacaaguauauguuugcuacaaagguggugguaaguugaggacgcucagcagugcgcggcucccgcacccaccuggacgaguuuguaugacgucagcuggaugauagacuugccguagcuuggcugaaggauccugguugucagugaacauaccugaagaagguagaaggccagaguggagaaauuuagagcaggcaaucaaaguaucgaucaggaaaaaaaaaaucuagaaagcugcuugucucccuguagccaagcaucccagacaaagacagaucucacuuuaggugugugugguugaguguguauguguuagcaugugugugugggcauuuguguggugucaacaaagguugaccucaagugguuuuguuguuguuuguuuuuguuuguugguuuuuuucucucucucucucuccacugcaguucaguuagaggcuugcuggucagucagcuccagggaaccuuccaucccagcuuccccagaaccacugugucugguuccucacccccaauggggccuggggauugaacucaggaccucaugcuugcccaguaaaugucucaccaacugagcuagcuccucagcuccuaaaaacaaccuucuuuguacucucaguaaaaagaauauggacaggagccauggugcuugaaggcucauguuccuuuaaaucccacuaccugguuuccuucccauuuagacucaucucucugagauuucuggacgcuuucauuuacauggcucauaggauguguugucacucccgaguggaagcuaauauucaaagaaaaggaguaauuaagcguccagcugucaguaagucgcuuaaugcucagccuugaggagguuuugaugugcaagagccagaugcugacacuggaggccucaaaccagagcagguuaccgagcaggacucugugaccucguuccaagggacugagccugcucugccaagggcaccuuggauccuugcuccugcuuacugaccguggaaagccucugguacucgggagguugucaaugcuuucugucacuguuaacugagggacugaagccgggaagaguguuucucuucagauucucguucauugauuccuacaguugguagcaggugggcagaggcagaucagccucauugauagaauccuaggguccucacaaccaggggaagcaacgagcgaggagggcuggagaaagaguagagauggccaaaagcuacagacaguccccaggauguaccuugcaaaaauguguuuucuuaguuuauuaaaaguugcauuauauuuguuucuuauuuagcacgcgcacgcgcgugcgugcgugugugugugugugugugugugugugugugugugugugugugugugugagacuaugugguuauguguucuaugggggcauguauguggaggucaaagggcggccugugggaguugguuuucuccuucaaccauuucauccuggggauggaacuccaugcaucagacuuggccaaaagcaccuccacuccugaguuaccucacuggcccgcaaaauguuuugucuuuaaaagucauuuaaaauuuuuuauuuaugugugucugcguguggguaugcauaugagugcuccccuggagcuagagcucuggguaguggugagcugcugccugacaugggugcugggaauugaaccucuguucucugcaagagccguguacacucuuaaucucaaggucaucuuuccagcccccagaaaugauuuuuaaaaccacugauuuguggccauuuuuuucugauuauauuaacuccuaggucaucccuuucuugcuuugucugccuuucucauauacacccguacguauguguguguguauguguaaguguauacacauaaaauauacauacccauauauguguauauacacacauguauauagaccuauacaugugcauacauacaugcaugcauacacgcguacauacaugcuuucagaguagcucaggaacauacccuccaucaguuaccuuggaaaugaguagaguaauugagagcaggcagaaguggaaaccaggccuuagcucugaugcuuugugacccaaaucggauaacccugaguccuuuuucagccugcaaucuuaucucuggcuccccaguggcuaugggccuuuuuucuuugaaguuguuggcuuggaauuaaugcgcgccuuuaaguuuucaguucucacacacuuuggugaugcccuggcuugcucuugccuuugccugaguggggccagaagcggguggcuguuguuccuuuucucagcuggaucucauguccaacaguugaagguacaauagcgggggcugucugucugucugucuguuugucccucuguggucuagcaagaggcacaaaggagaaccuguggaguuucuauuacuucuggggucgugucugcuuugauggucacugauguuagacccaguggcagguaugaagcagaguugaacauaugcugccuuggaaccacacaauuaaaaaaaaaaauccaaauaacaaaaaacccagauaaguacauuuuuuaaauucuggaaggguguauguauaguccugccagguugaucacauugagaaguguaggagguagugaagcaugcucugcgacauaaccauaaaggguuaaaugggagagaagguauggggacccccauccuacccauaggcuggggaccuaccugagacacaguauuuuaucacagcaacaggcaagugacuccuucagaugcacgaauguaguaggcccauaugguaaaaauggaacccagggcuuucuacaggccaggcaagucauuuaccuaagucaugaccugccuuuaaaaaaauucuuuucugagacaagaucucuauacauagcccaggcucauggcaaacuuguaauccuccuaccucacucuccaaguguugggugauaggugggucugcuauuugucaugucugcugagccauuauuuaauauucuuuuguucuuuaaccguauuugugguaccugauuuugguuugcugauucuaauacuuguacuuacccuuggauaguuuacgcugagacuucuucuuucuugccuuugauuuuucuuuguguguuaaggggacacgggaaggagggggaagacaaagauggaagucaaggcuucauguauguuuggccagcacuguccuacugagccacaucucaccauguagcccagccuagguuuagccuuccugccuuggccuguguagugguggauugcagguguguaccaccauccccggcucaucgucuguucuagauugauuucuguuauugugauaaaacccuccaacuaaaaucaucuuagaggagacagaaauguauauuuggcgcacacguccuagauacagccaguccaucauggagggaaguuagggcuggaacacuacuugcuggcucacuuuucacaggcucaggcuuagcuaagcuuucuuauagagccuagggaaugguacugcccacagugggcuggccccuccuacauuaauuaacaauaaagacaauucuccauagauagacacauaagcuaguguaauugagguaaauuccucaaccacucacugaaggcuuucagaugacucuaggcuaugucaaguugacagcuacagcucaccaguaguagauuuuguugaaaaugauaucguuacugugauacuguggcucuugauaccuaccccugggucuauguuguuguucugugaugugcucuuuauugcacaucuacagaauugucuguaauuuaguucagcaggcagucaguguuuguuagaauuuccuuggguacuuugaagcagcacaucucugcccuuccuaauuggcucuggugcaggguaaaaaucuccuacucucugccugguaaguuacagaguugcccucacccccuauuucugccuucuguggggcccuccagguuagcuggaggugagacagacucuguuuuguucuuucuggggcguacucacagcucuuaugagcucugccucaaagauucuuagaaaucuuucagagcuuuucaaauggugccucuuagggcuauuuucuuucuggguuuuucauguuaagcuuuuguuaggcccagcugugggugcugccucuggcaaucuccacguuaaagugccaguuaucaguugcugucccccaggcacauucugacuggcuauuggacucugugugugugugcacacgcgugugcacacacacuugcgcuugcccaagcauguucuuggucuuggucagggaagaugagcccagagccuguaccuuuccgaugaggugggugaaguacuggcaauuuucugacuggacuuuggggagggaggaccuguucuguccaguagccccucagccauuauggcuaugagguuuccgaggcuaccucagaguuugagagagagggauaggaggggggcgagggaaagugcagugaaguucaccacgcacgcucgccgagacccagacaccgaucuucaauaaaugcugcuuggaguuuugccaaacguuuauguaguucucagaaacccgaaaauguugauuuuugagaguguuuuuuuuuuuuucuuuuagggauggaguuuuagagcucuuuaccuugucauucuggaaauguuuuuaauuaauaguaacuucguaaacuuuauugugguccuuuuccaaucuauacagaagaacaguuuauauugauguaaagucuucaucacccucgucuguccucagcauuucuuacagaugccagccccacuagcugucugccuuuccauuauuuaaccuauuuuccuuaggauaguuuuucacuucuuaaaaauuauauauuuguauuaacuucauacauauauacaauguauuuugauaauauucuuucccugcuccucccucuaacuuuuucuggaucuccccacaccuccacauuccuuauaacuucaucuccuuuguuauuuguuuuguuucaacuuauucucugaguccaauuugcacugcccugggugccggaccaucuccuggaacauggcugaccuaccagggaccacauucuaagagaaaaucgacucucucucccagaagccaucacaccaacagcuccucugcugcagguagaggcucaugagugccucgcccccgcucuggaauguccacuggcuugacacggugcuuggcugguguaggcagucauagcuaugcgaguucaugaauucuuuguucuugucauguccagaaggcauuguuuugcccagguccucuuggcuacuggcucuuagaaucuuucugccuccuuucugcaacguucccugaacgucagggaggauggaugugguauagacauccuguuuauggcugaugcuccucugaugcuuauccucugcauuuugagcaauugugagcuucuguguuaaccacuguccuuggugcaaaaccacuucucugauaaagacugacggcggcacuaaucuaugggugcagaaguaucuauuuggaagauacuuuuaauauuauguccauuuagcaacauaauaguaauagguuugcccuugugccugugagcuuuccagcuaugaguucuuggucagguuuacaguuucaggcaagugcuuccuauauggugcaggucucuuaagucuaaauggaaagccauugguuacugcuauaacauucauuccacuauugcaccuguagguguuucuugccauguugaccauuuucuggaucacagagaucagagccagaugggacuguuggugacuuuuucuccuuagcagcuuucauccuuccucugggacuauggaagcuagucguaguuuaccuaugcuuuauuuauuuauuuauuuauuuauuuauuuauuuauuuauuuauuuuuccuuacgugagaucuugcuauguuaccuaggcuggucucuaacuccuaggcucaagugauuuucuucccccagccucccgaguaccugggaugugccaaucugauuaguguuguuacugggacgaaagacuguagggaaagaauuuaaaagagaaagguugguuuugacacaggacuucggagcuuucgguguguaaccguggggaggguggggcggggcgggguagcucacuucacuucaugaugcucuggaaaagagaagccuacacucauggcuugcuccucucccucuuuuuauuccaucugggucccuagccagccuggggacagugccuccguguguguucagaguaggucaucucccuuuuguuaauugucuuuggaaaugccccagagacacagccagagaggcgcuuucuugaucccuuagauguuucuuagugcaaucaaguugaaagagaugggucauugggugggaggagaggccugggccacugugcuggguuucuguguuuuaugucugauguccccugcugggaacaucuguggugauuggcuagaagcuuugucauugauccagaggagacugcaccacugccagcucuuagcuacuguccaggucaccccacacccugggagggcuccugcuguccaccccuucuagcugagccacuaugagacuugaaauugaagagcuuaucacugcauucuuggccuuuguaauuaagaauauaccaauucucacuucccccuuggugacucaugacuuuuuuuuugcuuuacuaucaucucagauauacacugaaaucuacaucauuugcuuaucagaaccgaaaaugcaaaacuuaaaaaaaauuaaccuguccauaaaguaucaaauccuguagcauccacccagaugaacacauuuaaacacugcacacguuuguaggucuagucauggacucagccugucaggauuucaaugcagaaugaaagucuugcaagcugaguauggugacuuauaccuggaacccuagcacuuaggagguacagcaggaggaucagugguucaaggcuaucuacccccaaccggacaguguguucaaggccagccugggcuauaugagauucugucucagaaggaagaaauaauuccuuuucuaaaaaccuuaauucucuucuuagaguguagccuagaaaugguauggugcauaugugaaggaggaggcaguguauucccgugcguuuuaugagaaagcgcuucuggaaaucaccagugugaaguggaaagaugucugcaauacaugauucaugaagaaaggcuaaacugcuuuggccagguuugcacucaguauucaugaaggaguugcuuuggccagguuugcaugcaguauucacgaaggaguugcuagguaguuccucucuucugacccaguuugauugcacgcauaaaauugucuuaggccaccgagaaugccacuagaaagugacagccagaaugggcauugugucucuuucuugcgcugccucagguagacaagcaagcuguggcuaugguaauguuugcaucuuuccauuccuggaaauauccuguggaguuauucuuaacaugcccucacuggccuuugagucuccacucagauaggaagacuacggaaacccagcauggccaaaaugauaucaccgccagcugaucugguacgcccaaguagcuuccccccagaccaacaugauaucuuucuugucaucucauuaaccagugcuugacuguaugacuauacaugcugaagagaagauaaagaauggagaucuuuacucuggauggucagggcccuguuguuuagggaugaagggaggcucaguguuaggggaaggcucaguguuguuugucacuguauugggauguuugugugugacugugcaggugcauagagccucugccaguggacacucuggaagguggaauggggacaggguagggcagugggagcagaacucuuuauuuuaucauacacugauuuguacuguuaagucugcuccacagggcuuacuaauaacaguuaaaaaguaaaaaggccaacuaauaaaaccccacuguuuauuaggaaaagcgacagagccugacaguguccugcacaguaacuggugugucaugaucuaaaauauugcuaaaauauuucuugauggccauaaaacaauacaauaacacucucacaauaccucaggguuaaccugaauuauuuuagguaaggaauaauucucucagaagcagggaaaguaugccuuuugagacuuugaagaaagauugauauauaguggucuauaaauuuguauuuaugggauaagaguggcaugcauauauauguauauguauacacacacacacagaugugguauuucucuuucugagugaggcuuaucuccaguuguauacauucuccuacaaaugucaugauuuaauuguucugucggacugaauaaaauuuauuauuuaaauauauugcauuuucuucaucugauccuuugccuauggaaaccuggacugguucccuuucuuagcuauugugguauagacuuggaugugcaaggaccucugcugggucagagcagguuugaugucuaguuucgaggaaccuccaagcugacagcaguaguuggcugcuccguucacacuucuccgucaggugggcucuuucuccaccacugggcgucaucuauuuucucuaugagagccauuuugacuagugugaaaugaaaucucaaagcaguuuuaauucucaugucucugauggcuaacgauacaggaacgcuuuucaauuuauuuacugacuguuguauuucuguugaaacuuccagcugacguugggccuuugguguuacuggaaauugucuuguuuuggggaacagaguuuaaaguagugaaaaaaacauaacaugcaauauguguauuucgugggcauguguauucauugguagucaugaagaucuuuguaugcacaggacaccuuaacaucuuuaugacccagugauaucuuaaaauaucuaaugcaacguuagauacuuagcauuguugauugcucuguucuaucagacucucucucuacacacacacacauacacacauacacauacauauauccuacuugaugggaaauguuuagagauuggaucauggaauuaccaagcauuuugcagagucuugcaaauugaagccuuuuugggcuuuguauaguguauggcugagcucaccugugcagacuuaaagcugcaggcucugcucuguuugaacuccauggccuucucccuccccaccgcucuuuuucacacucugguggccuccaccacccucccuguguccaaguuccucugucauaccauugucucucuuccuuugauacccucagacugucuguaggaauuguagaucgaguguccuguacuaaacagcucagcucugagcagauauuguaaaaagagaagagggaccgagucacagacugcuuuguguuuucagcagaaucagaggguuugaccuguuuucuuuuccucauguuuugagggacugucaucuggcacaguuaauuuuccucuucucuuccuuggcagcaucuuccgggcagccagcagcagucaucuguccagcucugggucuccuuuggccggaagccuaugagagcagcccaguuugucacaaagcauccuauuaaugugagugaggucugcuggaagccgggaaggggaggaugcuugucuccaagccucaugggaauguccugcuggugugagcauuuuacauucucccugugggcacccucuagagaggccucugaagagaccuguuauacucugggccuguuggucugcugcugugcacuucacuguuggaaggggagcugaaugggaaucguuuuucugcuuuaagugcaguaagauuggcagaagggucagugcccgucacuggccucguaugccaguccucgggcaaggggagauuugugcauggcauuugcuuauuaaccacaugcuguauuccuugcagaugacuaagguuccagaaggggauguauuuggguucuguuuuuguagaaacagacagguuagaaagaccaagaacagaguggagaaagcauaacauagccaguauucaaaugaauucaauauuaguacauaccucaaaugaauucagcauuaguacauacugacugcuaagaaggcacaguuguggaucaccaggguagagccugcagccaggagguugccuuggaaggcuuuggcaucagccagcggguauguaacaggaaugaugaucaggucuguuuaguuucuauggguucuuucagucucccaagggaaaagaagagaaaaugaaaugcgugcuaaucuauauugugccuugugcuauaaaaggucuguugggggagaagaggagacaucauuaccaaaaagagguuucuaggucauuuauggaggucagaggcccauucuucucuggugcuguaccagcaagcucuauggguagaccagucauggauacuuggaagggaaaaucauuucagcuaugucaguuugcagggggaggggggggcuaucugugacuuuauacccacuuuuaucacugggacacgugaggucauugccugcauguguguauaaaaacccccagggauaauuggguuuuuaacuguuuguuuucugacuuugucuucugaaggaauauuacaucgcugaugccgccgaggaccagguguucguguguguuagccacaguaacaacagcacuaacuuauacaucucagaggcagaggggcugaaguucucccucuccuuggagaaugugcuguauuacagcccaggaggggccggcagugacacucuggugagguaaggaaaacccccagccuccagccuugagccaaucaggccaccagacucuucuuaccuuagugcuuuucaagauuaguuguccauggggccuugcuugaggugcuuucgaaguguguacccccuccaccccuggauuggguguccucagauuacaauugaauuggucuaggguuauggcucagguugucccccucagggauuuuguguguggccaaggcugagcacugcuguucuaggugacacuuaggaccucagcuacuuaguuaaccauuccuuuggguuuugugguaucugagccaaugggaaaaaacaguugaaagauaccaucacuucaggggacacaggggcccugcuuccaagugacugacagacagccucugguggugugugauaacaaaguccccagggucauugucccuuuaacuggugaucacaaauguagggcuguuugaugcucauaggacaggugcucuuugagugcuaccuucucugagggcuggggagcgguugagcacucuggauuuaguuuucugcaugcuuggcauacguggaaucaugggaugguaugcagcccucuggaucuggcuucuggcaugugugcaagguccaaccucaucgggugaguauuagcaucucacuucuuucuguggaugaauaauagaguuugcauguuuuaauaaguaagauucaugagccauugucccucagguguuucagugacuuuaauuuucauucucccaccccaccccaccaccucggagacucccaugucuauggagugacugaugaggcucaaugaugacuucaucauuuuacucauuugucauauauucagauaaguuucucaugguaggaaagagugggaucccccacccccuagagaggaccucuaaggaagggguccucuguuaugugaccauacagcuuugucacaccuggaaacugcccuuuacaugugacagguuccuuccguggugccugagacugcagugcgucauccgguugagauauugaaaagagauucguguugacagugguaggccagcauccugucgagcuuucuucauauagccaggcuuuaucucagggcgacaaggguucagauguguucaguccaaugagcuguuaucauucguggguuugucucagccaaaugagaugggguaagggagaauucucagaugcaucagcaggcugguuuagaauagauggcucuggacggagaagggcagugugaugcugacaaauuggcucuuguuuccuuaaagaagaggagugagaacucuuaacagggacucacucucacuuuuguggguugugcuugaaggaaucucaugggacgccauagcgaguuguaugacucauguaggaacuaaugugcuaacuagguggcagacccguagggacagcuuuggagggaacacuuggcucagucagugguggggauaauugccaguguguagaugcacaggguauggcugaaggggaagccaggugaacuuucuggcaaguuuuagcccauagcgccugggaaaggaggggagaaaugcuuuggagugggcugguagagaugaugagagaaaacaaacucucaggagagagugcaggcgugaagucuguuguuuuaguacaagccaaagagggaaaugaagguguggcuggacaucagagcagagccuggcaaaagcuggcaggcaguaaaugcuaaagcccccagaagauaacagggaaaagaaccaggucuugagagaaagccaggccucccacaugggcauaauaagcagggagccucaggaugguagcuuccgaagggaagagagcugaggugagcguacagaaggccagagcccauuaacccauucuccaacagagacccaaggaauuccacccacaucagaggguuuagucuacgcaccuggguuugcgagguguggggggaggggcuuuucucauccugccaaccaagaacagcuucauugguacuacguauuucuucccuuuccugcgguagagguugugugugucucccuaucugaggugguccaaccaucacccaguucaggggauuccuacagcauaugauggggacuugggagcuuuacuguacagcccauggcucagaaaccccgaccuaaagggcacauguccagcuuaaaaagccacacaugaaccauggugaccguucgucauacauguuguauuucuaaugagcaugcgaugugaaugaaaaauuucuuuccagugggcuuugaggguagcaaguaagaccugggcggucuuuacuguccuguuagccagagcugccucaggcuuuauagagcuguccucucgcugcccgcacugcuucacugcagaccagcaagagaugcugugaggauuccugacagggagccccgugcucagugcuuaugaauuguauuucuagagaucagaugagacugugagccucagcacuguuaccugugucuuacauaccuggcucaaggcuucccacuuguccaggcuucuugaaggauuuggaccaauagucaaagugaggagauggaucucgcucugucaacuucuuuaagaugucuuuuacauucuaaguguccucugaggaguuguuggcugacugagcauccuggcccuuuaaaaacaaucucucucucuuucucucucucucucucucucucucucucucucucucucucucucucucucucucucucucugcaaguuauuuaacucuaaaaaaugauguauggugaaccuuguaaacauauaagcgaaaguaacaagauauaaaaggguauugcaugauucaguucauacagaagagccagaucaggcaaaucuguagagacagaaagcagaucugugguuaccaaggcuugggaacugaaagaaaagcagacagagacagugccugccaauaaugaaaauguccuggaacucucacauugcauaacaaugugaguguacuuagugccgugauauugugugcuuuaagaugguucaauauuaugcugcacacaaugcaaaaaugccaaguaaaugccgaucccgggcuugcacgauuguuauucuuugccugcagguauuuugcaaaugagccguuugccgacuuucaccgcguggaaggcuuacaaggagucuauauugccacccugauuaaugguucuaugaaugaggagaacaugaggucggucaucaccuuugacaaagggggaaccugggaauuucuucaggccccagccuucacaggauauggagagaaaaucaauugugagguacagcugcuuucaucuuguuuggcuuuuuuuuuuuuuucuuuuuuuuuuauacaaaacagagagcuguggucuggugcaguuuucuauauucaauauuuacaggaagcaugcaagaugauagaaugugcuuuuaaugacacauggaacaaaauuccauaugcauaucugcccuuacagguccccagcuccacaccaaggcauggugggggcugggauuaucucagagggguaccaugggauauucaagauguaucuuuuaguuauuggagauugaaccacauacagacccugcuuguuugacucgugagcuagaccuuuagccuaauagcucauguuuguuuuguuaugagauggacucuugcuacguaggccaggcuggcuuagcauuuguuaagcuggucucaaacuugcagucuuucugcauuagccuccuaaguggccagagugccaggauuauguccucuacugucacacucagcuuaauuuaaaaguuuugaaggaagccccgugauacacaacaucuguuagacaucauguuuauugcuugacgaaugagcuugaguuagcucacgacucugacaugaggacauaacgcgugucuuuugaggacaucacgucuucgggaagcuggaguuuugugagccaauuugaugaaaagcccagcgggaaaaucggggagcggggacgacagaaaauaaggguggaagugucaccuaggguuccaaaacuugagagguuguguuuugcguagcaggugcguguguuccauuugcaggacuugggauuauucaaacaugaaauggacagguuuucccaccaguuuuauguauacagcuguuucaaauggauacucuuuuaguggacaccacacacacacacacacacacacacacacacacacacacacacacacacacacuguuuacauguaacucuaaaaugauacaugacgguauucuauuuuuuucucgucuggaacugcuauaaaaaaaugacaccaccaauuuuaucuuaaaccuacaguguugacgaaugagcauaguguuccccauuuaugugccuaaaaagcagagcauuuuaaacuguguugcuuggucccgcuaaguguucucaugaguugauuguuguacucccugguugucuuguguuucuauuucaccugagugggcagaaagaaaccagaagaaauuagugcuaauuuggggugcauccauaauuagucaaucaccuaaucuuuuggacuuuugaauuguuuguccaugguaagcuauguugucuccccugcauuucauagcuguauuucuccucuugggaaaauucuauuggagagucuugcccuagagcacacuucccuauguuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuuuucucucuucuccucuucuccucuucuccucuucuccucuucuccucuucuccucuucuccucuucuccucuucuccucuucuccucuucuccucuucuccucuccuccucuccuccucuccuccucuccucuucucuucucuucucuucucuucucuucucuucucuucucuucucuucucuucucuucucuuucuuuuuucuuggcccauaggucuugauuuaccacaugaaaucuaacuuuggaaagaagcaggcuauaaacagacaugcauaaacaccuagacauuccaauuccucaguauguaggcccucagaagcuuggcccaucuugaucuggauguggcuaggcaguguugagcaugccauggggcaggggacaaacuugguggaagagagccagcagcagugcuauuucucccacugaugagcuugucauuguugucacuguaggcucccaaucggcuuucaguuucuaccucuuagcuuagguggugcaaugguugggucccucucccuuuugcugggaccaaauagcuaauaagaaucaucuuuaggaagaaaggauuuauucauugguuccagacuuugaggguacagucugucacagcaggagaggcucaagguggaugcuuagucuuguuuucccuuucuccuuuucauucagguagggaucccagaccuuaggauggugcugccacagucaggguagcucuuccuucucagcuuagccccuccggaagcucccucacagaccuacccugagguguaucuuccaggcgauucuggauccaaucaaauugaccgugaacauuaaccaucauaggugguauguuagcuuucugucaucauuacaaagugcccgagaaaaucaguuugugagguagaaagacugaauuugguccacuguuuuagagguaucaguaguuuuugucugagcuugcuugacucuguugcuuugggccaguggcaaggcugaacaucauaguagaacaagcuugauugaucauggcagacagaaaauagauaaaaggaauccagagaggaagaggccaggguuuccauguccccuucaaaggcacaccuaaugacaacuuccuuguaccaaccuccuuaagauucugccacuucccagagguaccaaaaucuugugacuaaaucuuuagaauaggacccuuggggaauauuucaaucuaaaucaugaggugaaaaagacuacauaguaauauauaugguugaaacaugauggccuaagaaugcagaaacacuugauagucuaaggauccagaaacacuucuaaggauugauuuccucguaggcgaaauaaaaggaaagaggaaguaggggagguuccuugagccaaccugauuuccuguuguucuuaauugaucaaacccuggaugcuagcaagauugguuuguuagaaggaucuuggauuuuuguuguuguuuuuguuuuguuucuuuuggugauaaaaaagaaguagauuggacaaaccuugucaucauuuuuuccugugccgugaacacagaguccccuguuuugauuacuaauaggcaugaaauacuuuagacaucacuuuucuggccaggagaaugaggcagaggcauuuaugguggucuacggaaugguaggcaucugaauuuagagaggaagccaguuucaacaccacgaaagccugcaucuuuguacgaaugugggauaagccuuuaaggcuuccucaagaccccugugacauucagaacaugcgucuuacacaucuggccauuuuccaaggagacucuuggacuucugauucguuuucuucugacagaacuuguagcauuguauuucagacacaucugcacugacuuauaaagucaacagggcauuucaguucucugucuuucuggguuccuggguggcaccggcaauggacugccuuucuucucuguuugaguugacacugguuuguaauuguuauuucugggagucuccagacuuuaaguuaucuuugucuuuucuucggugguagagauuuauguugggucagaagauaugcucugucuagggagauuuggagaccacuggguucuaagucuggauuccucugggccagacccucuucugggucuugcugugggguccucagacagacucuuggguuugagggagucccaggcauguguuguguuauaugcugauccuauuugguaauuuccuucugaagcuuucucaggguuguucccuccaccuggcccagcgccucagucaacugcucaaccuccaacuucggaggaugccuauccuauccaaggagucagcccccggucucaucauugcuaccgguaagugugccuugccugcuaucccagggacuugggugggcugguuaaugcagccagagagauauacagugaucaucuacaccccuagcaguuuccccuccucauggcuuuacgacauuauccuagugacuagcuacuagcugggaugucugucugggccagauaucuuucuagcauauucuuccuuuuguguuucaggcucugugggaaagaacuuggccagcaagaccaauguguacaucucuagcagugcuggagccagguggagagaggucaguuccuggucccggagcuuuuguuagugugagcacgugagcugugagccaacauuucagggacccaaugaucucuggugggggucugugaugcucuguaugauccacauguguauacagaaacccaggcccccccaggagacugacccacacuccugugucuucacacccuauaacauacuugugauuuuugccagaauaucacuuuaaauaaaaagcagaccguuucaguuuuuauuagaaacaacugugaauuugaccacguuuuucaggauaauacauuccaugaggggaagaauacagugucuguuuggcuuacuucuuucagcccuggacuguaacagugucuggcauagagaaaaugcccaguaaaauuuggcguaugugucagcgaaugacaaugcaguuguggugggucugacacugcucauuuccccuguuuuuuuuuuccugagccuugcuggcugguccuuuucaucuucuccaugcuaugggaggggauuguuuuaacauuguuuaacccacuggccacacccauucucaagggucaacuagugcugcagaauaaguuggggucuuauucugcagagacucggucugugcugacccugggauggguccugacaucccagcagaccacuguuccggccgacuugaaaagucagcaucuguagcuucuauccccaaagugcuucuucuggacaauauagugugcaccuugccacauuuaaucugcaauacgcauagcaaucaugucaccauuuggcucuggguaauuuguaaacauuccucuuauauuuuaucucauaugugacccaagcuucuuaucauccuucuacaugagagaagacaguguguguguguguguguauguguguguguguguuugugugcauauguccauguccauguauucagaugaaagaagcgaucaggacaccauggccaaacgggaguugaagguuuagaauuuucaggucgcccucauccugucccgggggaaggauggaauagcugcaucuccauccguagagcuguugcuuccuuuggagugcggcauccucucaccagcggagagggaggccugcgggcuuuuaguaccuucugcugcuggagacaacagggacgggaacauccgcaaguuauuuccuuuggguagagagcugugucuugcuccuccuccacuggagcagcguugccuggcuguugccagggcagcuguuggagacucucuccaggcauacguaauaccugccaggaaguguucagcacccaagggaccuuguuuugggaacuagcagagaaguagcugggggugagaguuggagacucccugugagggagcuucccaguccccguagguugucuucaccacagaggccccauggaggaagggcaccagccauugcaugugcugggggaugaaggauacaggugacagauuacugcagggaauaguggugauuaagauucugguugcccuccaacuagcuaguuauguaaacucucugauccccaccauuucuucuugcucuuucuuccauaacaaccucacggagagcugugaacuauggccaaucuaugcugcaguguuccauuugauaagagccaccccucccugguuucuacagauucaaagucucaagcaugcccccaaggaucucuguaccuucuuguuguauacauccccccuccacugucugcauccaccucuacguacagucagcaugucgagaauucuguauaaggacugcucggcauggauagauuguuuauuccacuuuccaagauucugccacucgugugaguuugaagcccaucucagaggcuucguugccugaggcuuuucuguuuuacugcugcuguucccaccacagggacaaugguggcuuugcuuauccaaucaaaucuuaauuguucuaccuacuuggaauaguugagcuguuuuaaugucugauaccuuauuuuuacauuuguguguguguguuugugcaugcuugaguauguguucuauuguuuuaaguuguguuuacacgugugauucauuuugaguuaauuucuaaaugugucugucauaagagaaugaucaccacccuacuguuuucauauucuaaucugcucagaccaauuuuugauaucuauuuuuauccaucuguugagaagacuuuucuuuccccuguugagucgcccuuggccccucuuuggagaucggucugucauguguauguggguauguuuagagggguuucuguuguguuccauugagcuaugugucugucuuuuucaccacuaccauauugucuugauuaccaaaaaccuuauagccaguguuggaaucaauuagggugagaucuuugcuuauuuucaaaauugcucccauuauucaaaguccuuugugugucugcauacccugccaguuuugcuaggacuuucacugggaacacauuaaaugcguaaaucgauuucaggguaaauugacaucuuaauaacaccgagucuuuugauccacaguuguagucuaucccuccaugccuucuuuaauuucucuugguaucuuuacauuucuaauguagaagucuuguaugucauuuccuucaguuguucaggcuggagcucauggucuuacugucucugccuucuaaguauggggauuacacgcauaugccaccaugccugacuucauuuuuuuuuuccuuuucuuuaaucuuaaugcuggggaaugaauccagggucuuaaacauacuaggcaagcacuccacugagcuacaaccagaaauaccaauguuuauguauauuauucuuuaauauuuaaacuugcuauuacugcaaaugaaauuuucuuuuaaguuuaucccuaacauuuuguuguugguaacuuuuuuguuuuguuuguuuguuuguuuguuuuuuuguuuuuguuuuuugagauaggaucuguuuggguagcucugguuuacccggaacuugcuauacagaacaagcuggcuuugaacucagagaucuacuugucuccaacuccugagugcugcgauuaaagacaugugcccccaugccuggauuuuuaugcuaauaaauaacaaugcuuucugcauucuccgacuuugucaaaguccuggauucuuucuuaguuacuguguaugugcauuuauuauaaacaaucauaccaaacgcaaaaggaggcaguuccuuccuggucuuuuaugaaaccauuucuucuucuucuugcuguuccuccccccugcauugcacugcucuccuaguccucuccuuccucuuacuguggugacuuugaucuccagacacuguugaguagaugcaggaggagugagcauuccaauuuguucuuugucuggaggauaaacauuuuagucuccuuauuuuauuuuauuuuuuuaaagacagagucucucuuuguaauuuaggaaagcuagucguguucucagccucaugaauuaaacaauaugcuuuugguuguaugugguguauaugcauacauauauguauauguauuccaucagccuggagaaaaaucccguuggucuuagguuauugauaacucuuaaaaaaucacauccagguauugauuuuuguuaaaugaaacuucuauaucaauguaaugauauagauuuucuuuauucaguuacuaugauggguuguauuacuuggcucuugaauauuaagcuaacuuucaguuacagaauaagucccacuuggucaugguaugcuguucuauuuauauauaacuagguuugaugugcuaaaaaugauaggguucucuuugugagaaauacuaguauaugauagccuauuuucaaugucuuugguaaguuucaguauugggaucuggguagucucagaaaguaagacuagacuguugugcaucucccuuccuuugcuucugacugucuaugcuaaaguuggugcuaugucuacuguaauucaccacugggcugggaauuuucuccuuagaauauuuuuuuuuuuggcaagaaauucaauuuuuccaguugguguauaauuaagauuuucaaauuuagugaauuuuucuugcuaucuucuuaauaucuguagaagcuuuagagauaauuucauuccugguaggaaugacuugauuguuuucucuacuauauuauuaaaauuuuccuuauuugugugcucuuucuguguuucgauagcuauuuuauuuuagaugcuuccuaagucuauacauguaaggcuuuaaaauuucuuuuggauacaucuguuacuguccauuuacuuacuauuuaucugugucuuuguuuaaaggauuuuagguaugagacauuuacauccuugcucuuuuguaaauuauuacuauuauuuuacuuuuggggggagcuggguaggugcauguggaggucagaauacaugugggaacugucccucuccuuccaccaucugaguccugggagcagacccagguuguuaggccuggaggcaagcggccugaccacuggaccaucucacugaccccgggcuuugcuugggcacuguuauuuauuggaauuaagccuugucuuagucaggguuucuauuccugcacaaacaucaugaccaagaagcaguuggggaggaaaggguuuauucagauuacacuuccacacugcuguucaucaccaaggaagucaggacuggaacuuaagcaggccaggaagcaggagcugaugcagaggccauggagggauguucuuuacuggcuugcuuccccuagcuugcucagccugcucucuuauagaacccaagauugccagcccagagauggucccacccacaaggggccuuucccccuugaucacuaauugagaaaauaccccacagcuggaucucauggaggcacuuccccaacugaaacuccuuucucugugauaaccccagccugugucaaguugacacauaaaaccagccaguacaaggcuuuaauguaauacuuuuuaaaauuuauuuccucuguguccauucuucucuaucucuuuuugcaucuccuuuugcguuauuuagauuuuuguuuuuugacaguacugagcguugaacccaaugccuuguacauucuuguugggugcucuacccuuaagcucccuccuuagccaccagauauauuagacucugucuuuguguauuucucuccucuuuucuuuucuuucauuggguucucugaggauuagagcaugcauaucuagucuuucauagucuucacuuguauauaaaauacagaacauuuguaucauaugggucuguguucucucccugaccuuucugcucuuguuguaucuugucuacauacuuagaaaacacucauuuauuuuugcuuaaauucuaauacugauuuuaaauaauaguaaauaaacaguuuugaaucccccccaccccagguuugccauuucuccuguuugucucugguuccugaugaucccuggguagaugaccuuaagcauuuccugcagagccacugccugugagggcccucuggccacuuggcucccuuggcuuuccuuuguuugagaacccuccauuucuccuugauucccaggcauugugcuucuucuguugcugaaaucucgguguguggucaucuggguuaaaaggacuuuggauaaguuuuuuuggggcucuguuuccccagguucacgugaacaaccugugguggcuacuucaguuaugucaucugcacacguaguggcccauuuuuauagaagcaaauuuguucacguguguguauuacaucaauucucuuuagguucuaucaagaucccucauucaaaugcagcuuggggcuuagguagagagguacauuccauuuaagggauuuaagggauacaugcucugggauuccucccauacuuccccagccugcaagggcucauuugccaguuccuuuuguagaaagaguuucuguggaaguuugagcucccuggcuggagcugaggcgcuccaucaaggccuucccuugaggcaccucuguaucagaaaacugugugggucgcuucucgaggcaccaaguccccucguacagcccucagagagcugacuuuguuguaguagaacagcagcucugguugcuugguuuuuuauuuugcggcaugcggaugaagccuaagacuucaggcauguuaggcaagugaagagugcucuccggcugagguagccuauacucuggagugugagaacuuagcuuucuccaacuccaggauugugaaagagaggauggacaagaaccuguucugagaacuggaagcuguccuuggggugguguguguugggggagggggagggcaccauuccuacguuuaucucuacagcagcucaucaccucuggcuuguuuuccuuaaucaggcucuucccggaccucauuacuauacuuggggugaccauggaggcaucaucauggcgauugcccagggcauggagaccaacgagcugaaguaagugcuucugguuaccuccccucuuccuccuccuucucuucuucuuaaaagagaucuuuucuacccuucucucucuacuucuuccuuuaaaaaaacaaaaacaaaaacaaaaacccaaggucucucacuguguagcccaugcugucuugaaacuuaacaguguagcuccaauugguguagaauuugccaaucccgccgggcaguguuggcgcgugccuuuaaucccagcacuugggaggcagaggcaggcagauuucugaguucgaggccagccuggucuauggagugaguuccaggacagccagggcuacacagagaaacccugucucgaaaaacaaagaaaaaacaacaaaagaauuugccaaucccccugccucagccucccaaguacuaagauuacaggcaucaguugcugugccuggcuuauuucucuucuuuggacaucaaccuguccucucacacuggugucgucuguggugaccuuuggaugcuucuggagcgcuacguucaggucagagagcugagaccucuggaaaucacuuaagcuuguuaugucugugacauaacuauuuccuucuguuuuagagggcauugggagaaacaaacaagugaacuaauauuuauuucuuugaauaaaaacuaucaucuuucuuuuaauuacucguucaagguuaacauauaaagaaacucauuaugguaauuuuauuuacuuuuuagcauauaugacauuauuauuauuauuauuacucagcuauccacguccuacugcccugccugcuguccccuucuccauccuuccugcuucucuuccuuccccaagacaauuccuccugcuuccuuaucacauguaacuagagaguuuugaacaugucuuugcuuuuaaaaguguuguuuccaaagguuugugcauaagacaacuaauaguuaaaaugacaaaaauuaacgacaggcaaauagugguuguagaaugcacaccacuugccaggugacuucugcugugcuaaauuuagucuuagggguuguccuagauggaacuggaagagaugcuaggguuaaaugcuucaucuuacaaacggagaagcugaggcucaggaagaaguaaccaucagcuuguagagucauuuuugagaguuagucuuggauuaugucuaagaaaaaacaaacaaacaaacaaacaaaaccaaaguguugggaguuuguagauuuucuccccucgagguuugauuuuauccagcauaauuucuuggcuucccuucacgaagcuaucgaaccagaguuaccgauggaaaagacagacugacccucaucucuguucguguuaggcuugaacccuuuagcugggugaucgcgggaggcagagagggcuucuguaaucacacuguguggugggaagaagcaggcuuccccuacuuuugcucccauuagaacuggccgggggcaagacgugggugcuuugaaaaggggauuuuaacagcugguuucccacuuugcuuaacugggcauguacugagccuugaagagguagagaggcaaaggucuggucuuggcuuuccacuuggcugcucuuggccuuggguggcauggggcagcugcuuccccagagccuagaggcaggggagguugugucuguagaugacacccgcaucccuguucagauuagcuuuugcucagaggauaauauucacagagccugcuucccccggaucugcugguguuugcuugucuagucauuuaacuuacaccacacacacugagcaagugguacuuaugccagguacugugggucuaaagaugaauaggaugcucuggucgccuccuacccccacgagagcuucacccucuggcuguaagguaggugaggagguaauuguggugguuaguaaacugcuaugugaggaaagcauauaggauccggggcuugguguccugggcauagauuucauucuuuggauaguuuuaguuuucagauuugggagucgguucucaauuuuccuuguuuaacgucuccacagauuacauuagcauuccaagcuggcuccucugaaggagcgcgugugauuuuaguccucuuacaccaucugucggugcauaugugcccagggaacucagcaucauucuucgcuagcuguagcaaaacacggccaggaaaauaaaccugcugacggaaaaccauaaugccuucccugggcauuucauaauggcuuuggggggucugcgguggaccucgugggcaugguggugcucuucuaugggcacgggcuauuuggaagugucugcaacacauaguucaaguaaauacagacuggccuccuuuugacagguacauguguccuaggaaccagcucagacuuggcaggguuccauacagccaccuggcguuuaccaaguguguuguucucagagguguuugcuccuccuuccgcuguucuaaaaggcagaggaggagaguggagguaguccacagucuccaaagacaaacagccauucccugugccuuguagacuccagugaggccaugugcuaggcuuuuugaugguugugagaaauacaccaaagaaacagggcaaagcugggagaguccguuuugaguucacagugucgcaggauucagucccgcuuggcugcuccauggccuucgggaagcugggcggcauuagcuugucagggagcacguggcugagcagagcuacucagcaggguaggccugcugacuagguguagccuuucagggcgugcccucuacaaccucuuuccuguaacuaagcccuacccacuacucuccaacaccuccccauaaugucaccaugguaugagccuaucaggggauuaaagucagagcccucaugauauggccaccucucagagacgggcuccaccaugagagcacaaagccuuuccagccauguugacaaaacuggcuucaggcucugggccucugaccucccugaccauagcaaccucucuguccuuugagccucagaauuuugggggguauccuauucauuuagauugauuguguucagacuucauguuuuaacuccauuucauucuaugccuggauucuucaacucauuagcaaggcuuuuguagacccgcauuccuguucuauacaaguuagcaggcacuuagcaaauauuugaucuaucaauaaauaggucacgcauacuugggcaucugagauugcuuuuuucuuucuuucauuuuuuuuuaaacauccauuuaaaaagggggaagggaucuggguagggugcuauuuacacagcuccaagggagaccgcugcuguuguguucuguguaaaugacaaccccugagcagugggggcuuccugaaugugugcagccaggcagccagagagaagaucugauccacccuccguaucuuccauacgaggacguaauauaauuugugggaguuagcgcccacacuggaacaugagcagauuucugcuaggaaucauuucaggucaauugcacaaacauuuguugaacaacuacagugaaccagauguugugcuagacaccagugauggagaggcgaguggggccugguucaggaucugccugugcccaugggaacgcuagggcgucggagccaguuggagagagagugggagaaggaaggacaggagguucugcguaucugaagaugaauagaauguggucccucaccuuuaagcauuuugcuuuuuauuuguaauguaggcaaagagagccaaauagagcagagucuuuuguuuuaaucagaggccugagguugggguauuuguuucccccacuccuuggcgguuuauuuacuauuucauggcauucauucucugauuaguacagcagcuaagaucccucuguuugccuucuccauugagacuuuaucaucgguguuaaguaaaacagagcaggaaggguaaagcuuugcuuugcuuugguuugccuuugcguccacuugucugaagugugcaaacaagagcccaaggggcuagggauuugcuuuugcauccauucagcaugcuugaccaggaaccugccuggaggauaccaaggggugguguucauucuuacggguacacagcgugcugcagagaaggggccugaccagcaaggaaggauccaagccgguuugugagcuggaucccgagggccgagaucaauuuccgucucuucuuggcaguucgccugucagugugaugaaauguugauaguuacuaacacuuuggacuugccccaaagcaucauuucugugaggagaucuccaauuucacagggcuucccucugggaaucccucaaacuccuucagaggccacacaccgcagcauagcuguaguuaucuuuucuaggcgcagccucgugguuccagaguauaggaaacugcaguggauccuuccauagcuucuacacucguggcuacagcaucacagugaggcagcugcagagagccauccccaacccagucucacccuggguggcuuccucugcuccuggaggcagaagcaacagauguccuuaucaccuuuuaacuguuacagagacagugcaggguuuuuucuuuuucuuuccuccuccuccuccuccuccuccuucuuuuuuuaagagaaacucaguguggguuguuuaauuuccugcagcaaauguugauuauucugcuuucaggugguagaagaggugugaggugcugggacagggaaauggguggagauuuuauuauggaugagcugcaguguagaagacacucauggaucuggucuuguaaauacagcagaguagggugugaggucuaguacagggccuagucugagcuggucuaaggcagugccaacugcaggguugggaaaggcuuuucaaaggaggugaaacaugaggugaaauuaaaaaguugauguacagugccaggguuagaaagagcucauggggcuagagagaugacucuguacagugccaggguuaggaagagcucauggggcuagagagaugacucaguacuucagagagcuuuuugugcuuccggaagaccugaguuuaguuaacagcauugccaccaggcgcucaccacugccuguaaccgcagcuccaggguauccgaugccuucuucuagcuuuggcuggagauaugggguuggggggguuggaggauagagggguggguggaggagugguacccuugcaugcuuggcauacacucucacauacaccuacaaaaagagacagagcuugagcuaagguggcagugugacucuguggucccugaggccuucacacaugaauaaaauaugaauggaauugagagaagcaguggugagaaaugaggcuugagguggcauuagacaagcaccaugggccuuuuccugacucucacuggagagauuugguuguuguuguuuuguuguuguuuguguuuaaauaaaguuauuuuuuguucuuugacaauuucauauaugugugucaugaaguuuggccauucuuaccacccuuacacucacacuccaccucccauucacauuaagcucuucuucaacagauaguucuccuauugauagcuaguuugcuugcuugcuugcuugcuugcuugcuugcuugcuugcuuuuuuucuuucuuucuuucuuucuuucuuucuuucuuucuuucuuucuuucuuucuuucuuucuuucuuucuuucuuucuuucuuucuuucuuucuuucuuucuuccuuccuuccuuccuuccuuccuuccuuccuuccuuccuuucuuuccuuuuuuuuuuuuccugaguucaauuaagguugauauaugaccacgguugugggacuauuucuugcagcaugggcaacuuacuaguggugcuaucacugaagacaaaaucaacacucccuucuucaagcuaccaauuagcugccaauagcuauuuucagaggggcggggucccucuagucccacccucacuugugauugagacauugacuggcccagucuuaugaauguaaccacagcagcugggaguucauaagagaaauggccguguauauccagaagauagcauugcacagcagucaccgccaccucuagcuccuacccucugucacucacuucuuugcuauuguucccugggccuuagagcagugauguagaucuuggggaguuggacacucucagcacuuggcaacuuguuagucauuguauugauuguugcaaagagaaguuuucuggccaaggcugagagcagcucucacuuauggauauagacaucgauauuuauaaagcacggugacaucauggccauuuagcaagacagcagcaggcuucccccuauggccuuugguauuugagcagguuugccguagcaggcaggaaucaccucccgaggucagggccucaaaucuaaucagagagcaauugguuaccuucauaauaguccugccauuauugcaccagugggcgcuuccugcccugcagguuggaacuguagcuugaaggguucaugguuggguaagacugaaacuuugcuuuugaggucuuuaaguagagggaugacauggcuuccuuuggaagaaugagggggauagauguauuccagagaagacuggaagugaaggcguguggguucuugcuaacuggauggugauucuaccacucacagaaaacagaggcauaggauacaugggguggagccaguccaugaaggcagauucgguuaaggugaaccagguggcgguuucagguuccaagguugaguacaacagcaauguuugugcuuccaccuucugccaccuaugauggagaaccuucuugucuuugaguaacuaugccaauggggaacuugccauuuucuucugggcaguuugauuuauucuuuuggucauucaugcauuuauucauucacuuggucauguauucauuuguucauuggugagcauaggucucugguaagagagacucccaaguucucugcagcccagguuccauuccacagcuuugaguucugcucccuggaucacgcagcagauacuuccuuccauuggaaagccauucagacauugauggccccaugcuuguaauagugaguaucugucauucugugggaaauaccccaauuuccuuugcuuuucugcugcugaaucuugacauagauuuuucucuaggucucccuuguaauauaauugcacuaagacgugggucucauaucugaccuccauagugugaauugggcagaaggauuaaaaccuacugauucuggacacuauuucuacaaauaaaaauguuaagaccaaauuucuaccuuuuuccccaccuggauucgguuucuugauguguuacccaggcuacccuccaacgugagauucuccugccucagugcuaagaugacagauguguaccaccauaccuggcauuuucaaaauggugacucauuaauauuuuuauuuauuuagaaaccauuuacauagcuuggggucuuuauaucugaaucacuuuuaggaaguuguaccaaguugcuuuuccaccgccacaaaaaugccccugcaggcagcacccccccaggcacccccccgcaguaccucgccccugucuucuauuuucuucuucuguuuuugguuuauuuuuguagaauguguguguguguguucacauuuguggaguguguucaagugcacaugugugugagccugugugucugugcauguggaggcuccaggucaguaguagaaacauuccuccacugugugucucucuaguucuuugaggcaaugucucucaguucaacccagagcuuggcagucagucccucuccuuagccaguuugcuccagggcucccaucucucugccuucggagguugggauuaugggaaagacacuguaccaacauggcauuuccauggaugcuggggauccaaacucugguucucuugcuuugaugggugagcuuuaacuacugccuuauuccccuggcccagccugucagguuucuucaccauauacuuuugucaguggcuaaguucagcucacuauuuuauaggucuuauuaaaggacacauguccagcuaucuccuauucuaaauuccagcagguuaagucuugggaauaucauaugaauguuaauauucucauuuuugcuuagucuuuggaugcaugaaaacauuugaauuuaauuuuaccacauuugucuacaucugcauauauuuacaccugcauauguguguauaaaacuggccuggugcccuuugcaaaugggguuggguugugucacauucaaguucauugucucgauugcugacuggagugcauagcucacugagagacugaaguuuuauuuugguucauaauauuuuggugaucaaaucagcucacuucauauuauuucaccagcaaugaaugaaugauuauauaugugugguccaggaggaucucuguuuuuuugguuuuuuguuuuuucuuuuuuuaaaugcucucacaucauuauccuucuuaugguugauuuugguuaucaacuugaugggauuuggaaucaccauggaaacaaaucucugagagagcauguaagagggauuagcucaauuaggguaauugauguggguaggaccaguuuuugccuggagucuugagcugaaucaaaaggagaaagugauucgacauaagcaaauauagcucccuguggaugcaaugugaccaggagccccaaaguucuaccagcauggcuuuccugacaccaugggcuguaccuucaaaauucgaggcuaaacaacccacccacagaaguugcuucuguguuuuguguuucugugcuuugccauagcaacaagauaaguaaguacuccaagucucuuguucaaaucaagaauaaucaggaggaaaggaaaugggucucggguggugacaagagacgauuggguucucagcucuggcuucuguuugccugagugcuuauuauccauucucaaaagcaccuuuucuccugaaggcaaacgaagugacugcuccucuucugucuuuaggaucuguuccacccgacucuuggaggaauuaccaaaaaggacucugauaauuuucucuucaucccuucuuguucccuaguagguguacacacacacacacacagaggaaaagaaaagagauccauauuuguuuugcuccugccucuugucauuuuaauuucacuaguaaguccucuuuugggcuucagaagguugaagucagaccaacacggauguucccuccgcuguugcuauuguuagacgagcaccuuuucuucagugucccugcaaaccuccaugugcuaaaugagcagaguguacucaggcacggggcugugcuuggccgcaccccugcugguuugucucauuaauggcuuuacugucugcaccuucugggcaucuauagagaaaugauucauuuccugggguuaucuuugguuggaugaucucuuaaaugaaauuagcuugcccauguaaaaauagauggacuuccuguaucauaauugaacagcuggaccauuccaagcuugucugauuaauggaccgacucuaaagguaucuuuaggagugguauugagccuucagcuucuuaacauugguaaaaagcaagggacugaauggguuaaucguauuugauuuaacccccccuuaaacuccaagcaugagagcugguugagaauuugcccccacaaaugaccuguccuggguaggguguagguacuuugucauccaguggucuggguggcuguaguauccaucacuugguuuagcuucuggguauagagaagucacuucacaaaucucagggugagaacuguugagauugaauguggucaaaagauucaugucuaguaucuugucugucuguauguaucuagguauguguguguguguguguguguguguguguauauacauacacacacacacacacacacacacaccccuacacuguuccauaucccacauucuagauuuguucaguugcaucaaaugguacugagaggcugggcugaauccagacgcauguuguaucuaucaguggugcuaaguguggguaagggugugucucguccugcaugaaauugcauucccccagcaaugaaugguugguuuguggguucauauccuuagaccacauggacauccuagucccuagaauuuuacauggugauuuuagcagucaaugcugauccuugucugauuugauuacugcaguggggaugauagagugguaacccuucacauucuguuaucacuucuuaauggugcuuggagauguaccaauauaagaauagaugacuuucuucucccucucuucuuccuucucucccucucaucguugguagcaguccauuuuuuauccacuauguaauauuaccaucaucuuucucuucuguggcaauuguuuucuaaauuuggcuguucagaguccuaucagcuaguuccuaccuguuauuuuucagcagggaagguuggagauugaaccuaacaaugagugacaacccaguuuuuguauccuuuuuacaugacacaaucauaaacuuaccuguugcgaggucaccauuuuccagagcacuggucauggccgagagcaauguauguagaaacugaggcugccuucuaggacuguaaccucaagucuccuuuugcuuguaucgggcagguacagcaccaaugaaggggagaccuggaagacguucgucuucucggagaagccuguguuuguguaugggcuucucacagaaccuggugagaagagcaccgucuucaccaucuucggcucgaacaaggagaguguccacagcuggcucauccugcaggucaaugccacugaugccuuggguaagccccugccucccgggcccuggcuacagacagaaggacucauugucuggggugggcagaguggcagcuuagauaacaguguccuguugugacucacuauggcagauggcccaaacgaguaugugaaagacccacggcacaggugcuuagggguuuauuuacucaguucuucuugaguggacuacuuacgauucuuugcgucuccauuuucuuguguaguaccugguaguaagucuaaauauauauaugcugaaagugugaguggauggguggauagauggauggaagugaguuuuccaaauuagagguuucucgagcgccuauucaaaugggaaugucuguauuggcucuccacuagggaaaaggaggaaaacuuugcucuggcucaugguuuugguccauuguuccuuggcaucuucacuauaguuguacuaggagaugugauaggagaagugugcuuaucacauacugucuaggaaucaaagcaggagaggaggaggggcugggaccccaacacauuccuuaaagucacgcuccugcugaccuuacgucucuuccaaagcucacuuucuauaagcuccaccauugacccauagugccauaggccaggaucuagcaccugggucuuugggaucguuaacuauucaaagacuagcacagcuuuaaugcgggguccuuggaaggcugucuggagucuaguuacuaucuguuggugggugcacauaugcauggaggacugauggacucuggaguacucuuucagacugccucauugacuucugcccuuucuccuucgccgauauacuccagcugcccagaaagcuuccuaugucuucuuaccugagccauucaacgucagccucaggaucuagcaucucagacugugcgcuuggcaucucagucagaaggugucucgccucuguccaucauaccuugaauuauauaucugugccugcaauuagguaucaugucccacccccuaauuauaaggcucucacauuucuuuauugcacccacugaguaucuuuauugccucauagacgguaagguuuuaauaauucuuugcucauuugaguggcauugugucgacagguguaagucagcuuuggguaguauuuaaucugacacacauauuaaaaaaagguacaaggcaccaauuagacguaagcauagaauccccauaaggcacacugcugacaucuuaaguggcugugggcugguggcagaagugugaaguuaucuugucauuuccagucucucuacauaaagauccuguaccaucaaguagggcaaacacuucagugcucucagccuacacuaccagauuugcuuuucuuccuaaggaagcgggaugggucagcaguaccccugcaucaccuaccaaaguaucccaggagagaccccagucccagcccagcccuaccuaccuccccacccccugucaccuaucugugaaaggagcuacugacucuccuaagaauuuagagacuuagcugaguugucugguaucuggcagaauuucagcacuagggacauugaggcagggggaucaggaguuuagguucaccucaacucccuagauauauccucucauuuauaaaauaugcacgcuagccagccagccagccagcaagccaccccgaacucugggcugguggcgugacgguucagcagguaaaugugcuugauguucaagcuggagacacauugcaauccugggaacccguauaaagaugggaggagagagcuaacucuacagagcuguccucugaccuccacguguucaccagugcaugcauagagacacauaauaaauaaacacacacgcgcgcacacacacauacauacauacauauaaauaaguaaucaaguuuaaaauaauaguccuaaaccaaacaaaugauaaaaagcacacacaccauacauacuucacaacccacacauauacauauaauaaauaaguaaauaaaugaauaaauuuaaaauacacagccucugaaaccaaacaaauuauaaaaagcacacacacacacacacacacacacacacacacaugcacacacagugcacaaaucaaaaauaaacagucccccucccacccccauccccccaaauggcucaaauuuuaugauucagaaguugaugaugugaaaugugacucgcaccuucacagcuuucccagaggugcuguguuacagggcugcugccuuccuccuuauggcugcugcccacccucggguuacuagagaugggcaguuuugagcucuuguucuugcuggauggcuacagaggcaccggaaguggaggguuauguugaagguggggagacaggaaccccugccccggccuggaucugauacauugcucugcccuuuucuguucacagggguuccuugcacagaaaacgacuacaagcugugguccccaucugaugagcgaggaaaugaguguuugcuaggacacaagacaguuuucaaaaggaggaccccucaugccacgugcuuuaauggggaagacuuugaccggccagugguuguguccaacugcuccugcacccgggaggacuacgaaugguuuguucuucuuucaugcccaggaccuugaacuacaucacaucugcucuguagugugaggcugaaagauggagaacauguucucuuucuccgaggaaggaaauaagcauuccuugagcaugccacaugauccaggacugcgugaggcgcucucugcucaugucaucuucuaggucuagccaugaaguucagcagacagagaugcagccgguucuauaggaaccuccuagcucaggguuuaguucuaggaggacccuuaaagggaucacaccgaaagcuccauuugggggaacuuguuuucuauaguugcacucucccuuuggggagacaggaaacccugcaugggccuggaucugugccucucguucaugugagaggacuuuuaaaaaaaaaaaucugaaaugagguuaugcucauauguacaauauuuguaucauuuauuauuccaugagaaaacuauccaaggugugucugggaauuaaguggaaguaacaccugcacagauccccgugacaggagaugagaagucaccugagaggaagauuggcugccuuuaguguggagcuugaaaggauggagaaggcugcgaucagcaguaggaaaauuaggauuucuggagauguuugcgaugguucuuggggaagcauccagcuguguggacagggcaacaucaggcagugcagcagcgccgugcugacgucagugcaggagagugacggacaacauggcaggcgcgggaaggagguggagguccuucgggagcgggauuucauucuggagguggaggagccuccuaggccuuuggggagaguugagcugaccagaccuuagcuguagaugguuccuguuguucagcacacaguauuauuaggcuuuccacagucccgucuguucggugcggcgaagagcgugguccugcagcccacacccaacaugugucucagugguugcugagacaccagcuacucuuuaucucagugucauuauucuuggccagcuaaagccagagucuucugauacaugcuagaccagagguuggaagaggagcccgugguaaaugcuuuuaggcuuuguaagucauaugguaccaguggugcuguucagcuaugcccaugguagugcccuuggguaaaggaaagacauccuguggaucugguugcaggucaggaaauccugguuuuacaaaagcagucagcuagauuuggccaaacagugcacgggucuuguuaaaauacaaaugcugccccaggaguucugcuggacuccaggcacuagacccccacccccuuccuuugcauucacuccuauuaugggucccaacaggggugccaccugcgucuggguucagcaggugucuuggaguuagucuuauccagacaugaaaggugucuguaaucaagaaauaaaaugaagacuaaaugaaaagcuaugcgagggaauuaaaugaagguguugauuucuuaccugcugauuguuguuuugucuuuuaaaaaaagaaaaauaaaaguccuccaccuccagcaacaagcaaaagcucuaucuuccaggcacacuggcuggacucuuacugguuugcuagaacuugcuugguacuuauuuuugcuagauacugaguguuuuuauuagagaccagggaagcccccucugugugcaggagcuuuuaccagccaucgcccugacccccauuuuauuaauuaauuaacuaaugaauugacuuaucuauuuauuugaaauagagguuuguaucccagguuggcuucaaaacuacuguauaguggggggugacuuuggaguucuauuuucuugucucuaucuccuaagagcuaggauuacagauucguaccaccacaucuagugcugagauugaacccaaggccuugugcaugcuggccaagcauucuaccaauggaauugcagccucagccccgcucuccccuuuuauccaagagucuggauaggcagcugaauggagaugagguuuugcuuuggcaugauggcuuacaucccuuucguuugcuuaggggaacgacuuagcuuuccacauguggcucugacacauggcuucuuuguaaauguagcuuaguauaccaaauagcgguccuguggaguagcccacaggauguaaacaguagguguguguggaggauucuggauugguucugagguggaagguacauacucugugcucuaaauggacucccauugccuuuucagugacuuuggcuucaagaugagcgaagaucucuccuuagagguuuguguuccagacccugaguuuucugggaagcccuacagcccuccugugccuuguccuguggguucuucauacaggagaacgagaggguaugcaucugcaucauacaguugucugggucaggcucacuagggccuguguggggaaggagggaacugugagaaccacucaacucugcccacaccuuaaauucucaaaccccaaguuacagagggcaggugguuggacagcuuuuuaaguuaauggcaucugcaaucuccuaguccccaugagagaacagagccuacaagcuuuucugcaaggcugaggacaucugaagaagccucggcuggggaacaucuucagaggaguuuauaggagagagagauuuuuaagugcuucccugagcagugcauuaaaacaccugggucugccugcucuaaauaaccucgugcaaaaccgacucagagcaacuaaacaccauccuuccaacucuguuguccguggccaggaauaugugcucaacuggggcuccuccaugacccagauauccucuccuuguuucugacgucuugcuuuggugggggguuaacagcuaucggaagauuucuggggauacgugcaguggaggagacguugaagcgcggcuggaaggggagcugguccccuguccccuugcagguaagagagguggucucuuccuucugccuucuugaaaccugguugggucauucuggucucauccaguuaaacacguagcucuucuuacuuagugggggugaagucaccgagguuagguaucaugaaggcuccuccuucccuaacaggagaagcuuaacaagcaggugaagccauucugagggaaugcaaauuuuuuggugguagggcaggcuuugcagggcagucuguuugguaccuauugagugcugagcacuggggguugaagagcagucacagaccuuggugugucucuugguuugacauaguugaaucuacacacaugcacauaaacauauacauauacaaacauaugcauauaucacacacauacacaugcacacacauacucacccacuugcacacaugugcacacguacaugcacacauguacacauacaccacacacaugcacacauguacacauacaccacacacaugcacacauguacacauacaccacacacaugcacacauguacacauacaccacacacaugcacacauguacacauacaccacacacaugcacacauguauacauacaugcauauaccacacauaauacacacaaauaugcauacaagugcauauucccacaauacaccacacauaccccacaccccuaccacuacacacacaccacaccauacauacauaccacaccacacauauacuauacacauacaugugcauaaaucuacacauacgugcacauucaugcacacauacacauaccacacauuaccacacauauaccgcacacacauacauauacauaaauaugcaaacacaugcacaaucauacacacacacacacacacacacacacacacuacaaaaagugguugcuuggccuuuuuucuucuuucaugguuuccaggacuuaucagucaggucaauauguggcccuggcauccaucagcagugcuguuuugguggaagugucaugagcuccuagaaaaucaggacccagccacaccaaucaugacccaggcaugcugccuucaucuuccacaggcaggcagagcagagcuuccugucccucacugcucgccagcgugcccugaugcuacuaagcucauuagucccuuaauuuaaucuuccaucauuaccagaguaauuaccauaccucacaguggagacguaaagagaaccacuaauucagcagauuccuacaaaugagcagauaauauuccagugcucccuucacgagggccgcugacgagggcuugggcgaggaggguuugagugagugcucuugagggccuggaguacgugcuuucucauaaauacuucagggauaauucagcaagggacaugauuguuuguuuaaagccaccaggacagacaagaaagcuauuuucucuucugacagaagaggagggagcaggggaugaaauagaaaagucucauuuaggauaagucauccccuaaaugcaagcaaggaaguacucagagaaagcggcguuuucuaggccuaaugggaaccauaccguaaucuuugcagagaugagguaaugugggcaucuggaaggaguuuuaaaaugcagcgauuuuucuucuuuaugauuacugcaacaauguaucuucuuuaugauuacuguaacaauguaucuuccuaggcugagcuuuugcaggacugcaccagcccagccugcuguuccuugucuaggguagagcccacacgugaaagccugcaaugcuauuccaccuccaucuccuacccuagcuucacuuguacgaugcuggaagggcacucccuagcuucuuagaagcaacaaaggcgcagggaggguucugggugcugccaagggaugugggucagaaaucucaccgcccagcauguggcuugcauccugugugugaccuacaucuuccugcccucugccucggaauuagugccagcacuaaggcugcauuuaguugccauguggcgguaccuugaguauuuuugaagcaaggugaaaaaacaaagaaaaaggaacaaacuuuucccucuuuaagauuuuuacagauuuauuauuuaaagcuuucaaggagccaugcuagggacgagguccagaacaucccacacaguaaauaaguguuuugccuacccugacuuagaggguuuguuuucaauguguugucaguauuggagacuuuuuaaaaaaaaucacauuuauuuguguguaugugucagagugggggaagggaacugcauuuguauagcagaguggagauggagaagucagaggacaacuucugggaguugauucucuucuuccacugaguagguuccuagagauugaacacaguucugcagacuuggcagcaaguaccuuuaccugcugagucaucuugccagcccaguauugagguucuuauaaagcagguuauaugcauaugugaauuaagugaauuaacaggaugagggaaagauaggggaaaacaaacauaacaagcaaacaaaccaaaaaaaaaaaaaucaaaaucgcagcaaccaauucaagcaugaagcaaaggauuuguguuugcaucuugaucccacauguagcauagcaucaguagaugcuuuacauuuuuauaaagaguuuuucuuaugguuagucuauuuggagaaaugacacaagucacaaacaucuggacaggcccacacucaagaagcagcaucugaaaccacuguggguuuuguucuccccagcaucuagauuggcuccuuuuaaaaccugcuggcuacacaagguaucgcaaaugaugcagacuaacagccaguagacggugaugcguaagugaugcugaagggcgugcagcuugcacauccuuccgagucucgccacccucaggcaucucuguguguuccacuacccagagguuccaugggugcuauagcuagagaugcucacugcuccucugcccuccugaggaagagccgugaugacuucugcgcuauuuucuaaguacaaagagaggguguuaggccuuaaaucacuggcuguccaccauuagguaaaauucuaaagcacuuugauccucuaugugccuugaagaguggcaucgugagcauccacaccguuaaaggcagcgugguauaaaggcuaaagcccgggcucugcaucugggcuacuugcuuccuagcuguguguccuuaagcaaauuaauauucauucuucuaucucagggguguuuugaggauuaaaccaugccuggugcauaggaaguaaacauuuguucagcagaaacggaacaguaauugcucugucggacguucuguaaucgcucaacaacauauguuguugcuuuggaaacuuaucaggccgaccgaaagcaucacaggucauuggggauaguaauguaugagugagcauccugcguggggaacuugguuggaaggcuuuaguaguccccaaguagucaccaagguaauggcgcgauggagcagucacaugauaggauguggagugacuggccugucacuuacguugacaggugugacugaaggcagaacucagaaauauagauguugaaauguuguuaguugcuguuuuuacaguguaacaaaacauaaagaaauacaauugcuggguuagacaugugauuuucuucuguguccuaagucuagauuccuagucucugacacuugaucuacccuugugacaauauggguugggguuugugugugagaaggauggaggccaggccugcuuggccauccucagcaucccuggcaauccugcuugcuuuaugucugcagaagagaaugaguucauccuauacgccaugcgcaaguccaucuaccgcuacgacuuggccucgggagccacagagcagcuuccucucucggggcugcgggcggcuguggcccuggacuuugacuaugaacgcaacugcuuguauuggucugaccuggcgcuggacaccauccaggugaguccuuaagcccuugguuaagucuggaggcugugguuuuugacugcccaguccugacaggcuucaagcaaggugagcaggcagagguuugcacaugguaacccaucucugggcuguuacacgaaacugcaguuuucuguuguugcaguuuuuucccugccuaucucugcuccuuaugagaaagauaaagaaugucccaaaucugaaucuuugacugcaucuaaggucuuaguuuccugcuagaaagaugcuggggaugguaaugugauugucaguugccaccuuccuuguuagccucuucccuucccugucaaaguguagugacauuccaguuaucuucaguccacauaauuacccacucuagcucuccuggacucugaaaagaaccaugaagugccugggcauggcgggaggcuaggacgggagaauuuauucagcccagauacucagggcagauaaagcuguguggaucaacauuugccuaguguacauaaagccccaggcucaaugaucaggacacaaaaauagaacaaucacacaacaaugacagccacacacacauauacauaauugcauacacacagccguacauaaacauacacauaacagguuaaggcuauaguuuuuaaagaccucuagauaggcuagauacuaacuguauaguccuguguucaaauauaugcauuuuaaagguuuauuuuuuuuuauuuuacuuuauuaugaugggugcuuugucagcaugucugucugucugugugccauguacaugcguggugccaggggaggccaagagaaguguccuuuggaacugugcgacacaugcuuggcuggcugccaugugggugcugagaacugaacuuucuucugcaagagcaggaaguacuuuaaacugcugagccgucucuccauccccaagugaaccugggagugcagcucggugguagaucauuuaucuagugagcaggcgucccuagggucacagaaagcaaaagagcucuaucacauuuacucauuguauccuuaauuccaaauccauauguaaguuuuacauugugaggguugggcuuaggggagaccacuggguguaacugccccaacagugacccgauggccaagagcugugcaagggauaaagacuauaugagacagaagaaguaaaaggagcugcaaccugucuucucauuuaucauaaacacagcagacucccaugucuuaguaaaaagagcauucuuuugagaggggccguaguuuaguaauccauguuuauaauaauagcacacagucauagaaagggaucagguucuguuugucauucuguuaacacaucuucuuguaucugcacauuuacuccuaugaaacccugugaccuuggcaaaccggcuagcugaaggacuacuaaugaagagcagggcuacugcugagggacggacuagccuugagucagcugcugauuacaucuuucucuuccuagcgucucugcuugaacgggagcacagggcaggaggugaucaucaauuccggccuggagaccguggaggcuuuggccuucgaaccccucagccaauuacuuuacuggguggaugccggcuuuaaaaagaucgagguaugguuauuccugugcucuucauuaagcaagcagguggagccacugggcucugagccagcuuugacacaaaaauaggaagcagugugucauauaacucuggaaaucuccccaggguuuucagggccuaaacuggccaaaccucugaaggggugaaggggggucaucucgggauguacgcagucuugaggaauccaugugaggaccauuuaauggaacccgaggugccauuuaagauacaugaauguuuguacuuuggcuagcagaagcaucauauagcaacaauaaugcugaugauuucacaccguuguaaucaucauaacaauaacaguccguuauuaucgaaaacaacaaugucucuguuauuauccguauugaucucuaccuaucuauuagcuucccaggaaccuguuccaccuauagccacgguuacacgagggggauggaugaggggccuguaaacuggccagaguaguguacugaagaaucaucagugcccccuaccucgcaggcuacugccgaggcccugcaauacugagccccguaguucuugcuacuggcacugcauggggaugugacaugcagguuaaugggaaaacacaaagucgggagacacagggagcugcgugacauguagugagauggagacagaggcucgggaggcugcccuggauccaugcaucauccugcuagcugagacacaugcagcagggggcuuccuggaacuucuuuuuccucaagugugaggacgagucucauuuacuuagucauuaaacgagugccauuuggugcaggauacaugucaguccuggucuuguguuuaaugacacagugagcaaggaaaggacacacgcauucucuuucugauuagcuuuuaguuuaaaggagccagguauggugguguauuccugcaaucccagcacuuagcugaggcaggaggaucaagauuuugagggcagccugggcuacauaguaaguuaaaagaccagcuggagauacacagagaucuugucuuaaagcaaacagaaaccacacaaaggaagcagcucaguggaaaggagacaaagaaaccuguccuucugcuaagaacaggaagcaagucucucgaucgaucgugugcuuggggaguggauaacguggagagggaagagaguggggaagcuucuggggacucccgaguugagccugaugccggaggggaauccucucaggacccuggcagaagugguuggcauauagagucguucugucagcccuccaaaucugugguuucauauccacgaaucgaaaauaguaaaaaacaaaacaaaacaaaaccaagacaguacugagugugcagacaucuuuuccuguuguuccauuccugagcaacucaccuacuacuuagcaccagcacugucgugggaauuacaggugaucuagggguggcuuagaacaggcaggaagcugugugaggguuguaugcaagcacugaagcguucuuggacuccaagggaccacaacagucaccuuugcgcaaguugucaugcuccgggguuggcgucagagagcacacagcucuagcugcuccuucggcccacgugggaauuaucucagccagggacacgaugagugccuucugauugggaaucaaggcgggcuccccagugguucuagaaugagacccgggaguagagggcagguguggagagugugccagaggcagggccccuggagggcuuugguuuugugggcuuuguaaggaauuuagaucucucuccuucccccacccccuuuguuuugucagguagcuaauccagauggugacuuccgacugacaaucgucaauuccucugugcuugaucgacccagggcuuuaguccuuguaccccaagaaggguaaguguuccuuacggggagucagcgucacgcccacugcuguaagagaugcucaugaaagugaaaaugugaggccagguuucugcuucuggugaucaugggggagauaaccuguugacugaggcucuugaagccauagcuugcuugucgugguccgauaacucuguguguuucauuagaaagcauccgacucucuuauggucuccagaugucucacaucugugggguguuucaauagaaaagguaacaugaaagagagucuuuguaaaccagucaggccacugauaaauuguaaggauuuuuuuuuuuuuuaaucucgaguuccgugaaucucacaaacauuuaauucgaccagucacucucacacacagaacucccagcgugugcaaguuuucuuacuuaaaauuacugugcacuugggguacgcacgacugcuuuucacuaacuccuucaucacagcaaaaauuacuaagaaggaaaugcugugcuagcuuuucuuucuguguguauuuaugauugagaauuaacacuauucuuaaaaggacacucuaaaagaaaucuaugggcuugguugcagauauuaaaagagaagaccuugaaaggaugcuuaagucugcccuguucucauucgucacccuucauccuccuacauccucgggaugcaaucacaucacuguuacguaauagucagcauuacucaugcauaauagccacaauuaauuuuuugcuugcauuauucagagucuuuuuacugguguucaaucaugaucauuaaauacagcgccccuuagugacacacacgacuugucagauagaaucagucuguuugugauuuccugccagucagcggacaugcacauugagugacagcggcuuaucagagcacacacagcgguuuaguugcuucgguaagaacauggaugaaaaccgagguggcaggaaggaguuuauuuugcucgcagguuauacucccucccugaggcagucugagguaagaacugaaacagagaccacacuuacuggauugcucccaguggcuugcucagccggcuuccugcccagggugguacugcccacagagguuuggacccuccuguaucaaucaugaauccaacaacaacaacaacaacaacaacaacaacaacaacaacaacaacaacuggcccacagauuuucuccaggccagucugauaaaggcaguuccuuaauugaaguuucuccuucugaggugacucuaguuugugucauugucaaaaacuaaguagcacauacaauagauagauuucaaacuauuuuggauacaauauucugggggcauugcaguagguauauucuauuguauaauacuacauaucacuuccucugccaauuagcauuuagauuagcaugcauauauguggaucucuuuguauaguauuggaauaaugugauuauaggcagacuucaguaggugaauuuuugagucaaguucaacuacauuucugaaugaaucucaaauauagaugguaguaauaaugagugacugcaugucaaauauagacaggcaguagugauaaugauggcuuugagagguuacuuaccucugagacguagaaucaaggcuggccugugucguucugaugagauuguguggucccuguauugaccagggugauguucuggacugacuggggggaccugaagccugggauuuaccggagcuacauggacggcucugcugccuaccgccuugugucagaggacgugaaguggcccaauggcaucucuguggacagccaguggaucuacuggacggaugcuuaccuggacuguaucgagcgcaucacuuucaguggccagcagcguucagucauccuugacagccucccacaccccuaugccaucgcugucuuuaaggcgaguccucacgcgcagucugccagagacggggaagcacguggcuaggcggagagcugaggccuguugggcuguugcaguuggccagaggccuuaaaaacgccgugccuucaaaucugcacagacuuguuugcauccuucauggagagauguaggcuucuaccacugcuuacguuucaaaagguuggagguugaggucuccuccucugagugaaucucuuuccuuuucagggccuguggccuuguuucaguuucgcaucuucaucccuugcuucucucccugcugacugaugcugugugccaucuauauaaccuuccagucguucucacccuagggagcaaaugcaucuaccuagaauggagaaacauauuucaaaacuaagucacccucccucucccccccaucccccacacacaccaugguccaacuaaaugaguacuagauagccuuuucuaggucauuucuuccugagggccguuggugagguuucaauaaaaccacugacauuugcacuuaagugaaacuuugacucggccuguuauucaguaauuaucuguugucccugcguaguggugggauggagugccccuugucuucaugaagugucccgaaagcaggaccauugaacuagauuaaacauuucucuuuagaaugagaucuacugggaugacuggucacagcucagcaucuucagagcuucgaagcacagcagaucccagguggagauucuagcaagccagcucacgggccucauggacaugaagguuuucuacaagggaaagaaugcugguaaggccguguccccuucucucucucucuccccagacuuggucucuagaaaggggcugcaaaugggcaauccccgcucagagcaggaucuggcagugugccucucuguugucacaacaacaugcacauuauuuaauuucuuccuaauggcaucuuaauuucuuuucuaaugauacacaaacagcuggaagacagggaguccugccugccuggagugcgggugcuuagugagugauuaccagucuuccugcccuuggcuccucagugaugggugggaugggcuuuuggguccagccgcaaagagaggaccauaaugugcuuaaucuuuggcacguucacaaggaauggcgcaugcuggguucucagaugcuugcuugcccagcugcuucgguguccauugaacauaccuacuucuguggccacacugugugcaggcuuuuuucauucaugauccacgcugaaugugugaaccucaggaaaugaaugucuuguuuucucuucucaauguuuuaccagugccuagcacuuaguaggugucuaguuuuucuucguggaaagaagggaugagcagaguuuauuuuuauguagaaaggaauucucaccuugcagcucagacuagccugaaacucacuguggagcccaggccagccccccacccccccugccucagccuuccaagugcuggaauuacaggugugagccaucaugucugauuguuucugucguuucuuuuugagacagaguuucugauuguuucugucguuucuuuuugagacagaguuuugugguguuaccucgguuguccuagaacucucagucuuccugccucagcucacuuagcaccaggccuucaggugugcaccaucacuccugccuuagucuucgucuaaaacuaugagcucaggauucugggaccuaccaccagccuguccugcaagcugagauugcgguucugggaggcuuccuuuuuuuccuuggcugcuuguuugcuucucuugaaggagacucccagagaaagacaaggcuuggcugggaagaauagucccuuuaagcccaccuuccuuaucucuacgggauguaauagcuuccuggguccgcugacuuaccucuguugacacacugcuggguugccuguuuugaacuauaggguugagaggcaccguucuuggcucaccaccugaggagaaaacugacaaggaaaauaauacaguuauagauaaccacuguuaucccuuuggaacgaaggaagauagcaugagaacucccucaaaggucuccugaguggugugcaaaacuaagucagcguugagcaugagaacucccucaaaggucuccugaguggugugcaaaccuaagucagcguuguuugcauggcuucucagccgguagggaauugguauuaggaucugugguuugcagaucaaagaaugaaauccuagauguuaauuaguguucccaaaggcucugccagugugggaguugucacuaaauggagaagccacuuuaaaaaaaaaaggaagaagagacacccauuuuuuuuaaugguuuugugguuuuggguuauuuuuuguucuuuugagcuguuuuuuguauagcucuauuuaaaguaggacaggaugauacgucucagccucagcaccauucuguccaggccugggaugaaggaugccaccccugcugcuccucuucccaggcugcagaauguucucuaagguguuaccuuguccagaagagcauggcuccauuuuuaugggugcacauagcaugcuggguguguacccagcagucucuauagcacuguuucggugagucuggucuggucgucucaggcuccccacuuccugucuuggcugccucuuaggccagcagcucaagcacagcugagaggcagucacacccagucccuggggagcagugagguacaguuuguggccgaaccccuguacucuguacacuugguagauucucagcauaggggucauuuccccuucacgcuccaaagagugauugucacuuaaacuagcuagagaagaguaauucaggggguugggguagugucuggaccugaggcagggcuggcuugaggggcaagugcugguggaaggaaugguggaaggacaggggugcuggaucaucugugaaugucacuuuggccuggggaggggggcacuuaguguaucccccugccccacauuugggauucucuugcauccuucaggaccaagcaagacuuuuccaugguuacaaaagcaagcuuccagucucuuagacaggccuguuugagcuaaugcuuugguggugaggcuaccagugauguucaggccccuuuauccguaagcuuguugacuuuaaccucccuggcuccguagcacccugagaggguaccccagugcaggaugcauacagggaucccugagugccaggguguccaccuuuguuauuuuuguuauucacuccuaacacgcguaggacuuucuaucagcuaagcauaaaacgaugguaggugcauuuaucaggggauagcucugucauccgcaccacagugaguuucacaggcuuguguaggcaucacuggccuuucccuaguccaugagccuucccauccugccauugucuucgcugucuacaugagagcuagguucaauggcuugucuggcgauacacuuacugcuaagaagugcuuugagcugcacugaaguugccuuugaaacuucaacuucaguauagucaucgggcuuuguccccucugccaugccuucaugaaaugacagcaauucagaguucugcaauuugaugggugcugaccugggauaaaaaaauugguuuguagggaacagucaagguguugggauacuugaaagugaaggcuuuucuggucuugcuaucuggcugguuuuauuucuccgggcaggaagauucucuuucguccguuauagagguuguuuugcaagauuuaugagucucuucauuuggugcugccauggcuugaaacauuuggugcugccauggcuugaaacauuuuugaguucuuuuaauucuccuucagacccuaccauaaugacagguuucccagcaccugugaacguggguguggauaucuguuacuugaggcaacaugaauuuguugauugccaaauauuuagaaauuuaagugagaugguggcaguuuucgguuccuaaacagauucuggaagaauuuuccaaagagaaaaaucugaacauguccugagggugccucgugaggauguccuaggcuaagucuucuaaaggggcauuugucucuucuucacaugggauaauggucacacuguuggcauacuguuggcguccuguguaaagggucugugguggauucucccuccaucuccauugggcuuucucacguagcacagccaucuucucuucugugucuuuguggcagcugggaugcucuguccugcccgguucuucucaggccuggcggcuuacuuggucuuacucugccugagcucucguaaucgcagugccauacagcuuugccuggaucagcuucuuuaaauaggacccacacuuucccuuguuugccuagggacauucauucugcacgcgauaacgccgauccugccauuuuauggacacaguucuugugcaaaucauccaguaacugaguggguuuaagggccuuagucugucagcccuccuuuccucggaacauugagugguuugaacacacagcacaauuugaguugcuugucauuaggaguggcccugugucgauuccuauagggagugaagugggaauucaagguaauagaacaccugauucccacagggguugggguaaacugaugucuaaaguuucugcucuggcaggcuggcagugaggcuccuaugguaggcugagucauuugcuggagucuuuucaaauguuuuaucaugugaauuucucucugugggugagcacacauguguuuacguguguguguguguguguauacauauauaugcauauuuguauaugcauauaugugaugcauauauacaugcacauauauguauauauguacagugccucuuguucuuuuuuucuuagcaucaaaaugauaucaucaccgaaucauuuuacuuucauuugcaauaccaccuuaagcaauaccuccaaagcccccaucaauaguaauggucaucuagugugaugguuaguguucauuguuaaccugacagaaugggggucugggcauaucugucaggaguuaucuugaucacauuaguugagaugggagaaccugcauaugauaccugucaccauggacuggcugggguccuggaccauauaaacaaacaaauggaagugcauaucaauacugccuccauccuucucugcucuuugugaacacaaaggcccagcucccugaaguucucuuguucaccaguucccuucccugauagacuacguccuggaacuguggaugagcacaaagaggccccuucuccuuuaagaugcuuuugucagcaccaggaaaagaaacuaaacucuaugaaucuuguuucccagccuagcuuaaaucuuggauaccuggaaacacauuuccuggauuucugggaggugugggaggggaugugucuaugaaaugguccaaccaaagauauugaguuuuauagaaauguuuccccauauuaugauuaagacccauaagcaaaagaaaacaaugcauacacuuuacaauuucagugccucaugccucugcauagcugugucaugcuucuaguuagaaaauaaguguggugggcaggaaaacaauuugaccauguuuuucuaucugugagagcccaagaguauauguguggggugguguuuuagacaugucuggcauuccuuuugcuaagcugacccaagggaaagaucagcauaguaguuagaucaguauaguaccuggcccuucuguggauuuauugcaggauaguggcuagucaaauuuauaugugguuucucauucagccuguuagcugugcuguggcacaaaggacuugagaaggggaaacuauuaucuagguauauaucucaauggaagggcauuuggguucugaagagcaaaaacccauucaagcuggagcagguaaaauauguuaucaaaagacaaggaagguaguaagugauggagaagagaaauaaaaggaacggagcaugacugccccuagguaugguggaggaaaaggcuacuguagcuaugugggagagcauagccagaggcagggaaaucugggcgaguacagaguugccaagaccagauugaacuguuccaggagaggagaggaggaggggaaagaaggggagggaccggauguagcagccaggagacccaaacuuacaaagagggcugguaaccaaaaugguuggauuauauaggaagaguagcccagcaccugggcugcagaguucaggauugggagcagggugugccagccaggaggacccugugacaggaagggacaggggagggaugcagggagaacccgaguccaguguccacuuugauauguaaaauaggagccucagcaguuuguccaaguuuagaaccuaacaguaagaaugucuaaguugggagaucugccuaaacccucaguugaccacagagggguuugccaagccacuuuuccugaaggggaggaauauccauaucucccugggcauccugagucugcagacuguaggggcagaugcaccacagcugcaguuuacacaagcuaggcuuccguguaccaccauaggucaccaugcucugucacuccaauugaacaggugauugcuaagcagauggugacuuaguucugcagcugcagccccguguguuugucuguguuuaagaaugugugccacagccgggcgugguggcgcacaccuuuaaucccagcacucgggaggcagaggcagguggaucucugaguucgaggccagccuggucuacaaagugaguuccaggacagccagggcgacacagagaaacccugucuugaaaaaccaaaaaaacaaaaaaaagaaugugugccacaugcuugccggguacccacagaggucagaagaagguaucaaaaccguagagcuggaguuacaggugguugugaaccaugugggugcugguaauggaaccugggucuucuacaagaacaagaaaugcccuuaaucaugaagccaucuucuccagucccauaggcccacgcagucuuauagacacgucacugagaagcccucacagugaggaccuuacuuaggccucccaacagagguuuaucaauguggcugaugcuucagagguuuucuaagcuccccacugccucaucuguaagacgacuuucaguggcucacgucucucuggcugccucgccgcaugcacguauuaaccuaagugcgacuucuguguuuucuccccaggaagcaacgcuugugucccucagcccugcagucuacugugccucccuaaggccaacaacagcaaaagcugcagguguccagaagguguggccagcaguguccuccccucuggggaccugaugugugacugcccucagggcuaucaaaggaagaacaacaccugugucaaagaaggugcgacccugguuuucccuaggcuccuccccucgccccugccccuucugaccucagugcucccucaguuuuggauauuagaaaaugucccagguggaaaugaucccuguuagguaccgagagguacucuggucccgguuguaaggccucuggcucugcacagcagaccugagcucuucaugcaaggguccuaguuguggcccucccuuugauggcaaaugauacagcuucccucagguccagcuuccuuuuguucuguguguuccucuauacaaccagggagcagcuugccuuccagacguaacugacuaaauucugucagagcaaacgguucucugucugccaccacagagcuuggaauggcccagauguucugaaucaggguuggcagaggucuaaaaagucuugacuuccaagcugugaccaagucaaugacaguaggagccuucucuuuagccaguuugaauuugaauaauuuuuuaaaaagagaaccugacuugacacccccuaguucccccacaucucccaaccuucaucuuguugccaccaccccccuccaguuucuagcuucauauuccugucagccagcauccaggaaaggcggucuggcaugaaguuaguggauugauggcugaauuccuguguuuuccuuauucucuaggucauauuuacuuugcacuccuaaccacacuugucugaggccagggcaggcaguguacaauggaagcuuuaucagccagcuucccuaagaaguacaaauggagaaaagaugacucucucucccucagaaacaggaggcuuccuuucaugcuccgaauggcgucuuaaagcuauuuggaaagaaagucaacaguaaauucuaagaagagggggaaaggguuucuccagucaccauuggaaugcuuuaaauucucuacacagaccacugguguccuugacccagugugcugaacaaugcuuuuauguccccuauaaguccuuguuucaaagaagccaugggacuaaauuaauuaauuaauuaauuaauuaauuaauaaacaagcagcuuacuaagauuuuaugauuuuuuuauauuuauuuaauuaguguauacauggauauauaauuauugucuaacuacauaaagucaucccuuccuaaccccagauccaugacuucucuggauaauagauuccauggauccucaaguccuucguauaagagcauaggauuugcauauaaccuauauccaaccugcugaaucuauccagucaccuucagacugcugagaacaccuucugcaguucaaggagcggcaucaggagaacagaguuuauucaugcgcaguacagaugcaguucccacccuccccaucccccgccuauuucugguguuugguuagcugaaccuugaacguggaaucccugaguauucagaaccaacgaggugucuauuaaagcugugauguauggccuggaugugucugagacucuguggacacagccucuugagggcuuguuuguguguaguuuauauuuuauuucggcuaacagugagauuuguuucccaguagacccaauuggugucagccuuuuuuucauaguacucaccuccacacacuugaagccugccucaccuucaguuuucaucuaaagagggaagaaagaggcucugcucgugaggugugcaugcacgcgugugugcauccugccuccugugcaugagugagcacuuggcccuucccuuccccgcuccaucccaucuacagcagaauguagcugggggaagagaaaaggaaacugagaagagaaaguuuuguggucuggugguaagaauaacgcuggcuccccuucuuccccuacuuuagagaacaccugucuccgaaaccaguaucgcugcagcaacggcaacuguaucaacagcauuugguggugugauuucgacaaugacuguggagacaugagugacgagagaaauugccgugagucuccaggcguagacgugcacauucauuggucagaggccagggugguccuucuggcuugaggccuuguaguuugugguucuggcuagacacaacugugauguuuaucuaaauggaugggaugugggcaaaaccccacauauaaauauauguuaugguaucaguguauuacauguguaaauuuaagccaccucuauacuuauauuuccacauucgagggugaaacugagcugacuggacaguguggcccaugagcuuggugugugcacuguaauacuggguaucgucacuggaagcgcaggggugcaugacaucauuugauuuguuaauucaacaccgggacauuucaaagucaggcaacaggugucaccuccugugccacuucuguuaggugaugcaggugcaugccaagcugaagagagauuguuguaacuggucaguggcacccucgggccugacauguggaggaauguugguagguaugucauguccaagugacuucugcauugaguagguucuaggguccaacuccaguuugcaggcauagagacagacgucuacuuaaccucagcccuccuuucccagcuuugguuuuaaugguuuuugaaucucuuuauaaagacauacacuuacugauauuucuuuagccccucuaucucaggcucuuugcugggcuuccgauagguagggaaguuugugucugagaagccaguggccaguacaguagagucagcagaguacuguguagcaggauaaguaacuauauugucuggggaaggcaccccaaccagcucccauaugcaccgacgagggcgccuggggagcucugaucagagguagagugaggagcauggggagcacugagcagagguagggugaggagcauggggagcauugagcagagguagagugaggagcaucgggagcacugagcagagguagggugaggagcauggggagcacugagcagagguagggugaggagcauggggagcacuaagcagagguagagugaggagcauggggagcacugagcagagguagggugaggagcauggggaacauugagcagagguagagugaggagcauggggagcacugagcagagguagagugaggagcauggggagcacugagcagagguugagugaugacaauggagguucgugcucccacuccuguggacgauagggcagguaggauacgauguauaacccagaucagcaguuuuuggauguuacuggaauagcagacaggaaccacccaugugccgugguaaggacuugccuuuggaaggauaaacagugaguggaauugaacuggaugagagagagccugacugcaagcagggaacccagacauggcagaucugucuuucauaucaauuacucugggcuacccagagacucucucaccauuugaacuauagaacagguugaugagggaagccugugggcccugacagauguguguaggccuuccauggagcacaugcugaggcccugcgugccuuaacauggguaauagcuuuaucacaggcuuaucuagcuugcaucuaacguaacucaucagguucacaugggccuugcaaugcccuucucugcccuccuuggcuuguuggaaguuuuguaugagcccuuauacacucccauucuuccuugaacucagugcaugcuuuucccauccagggaaaugacuguauuaguucuucucuccuauauuccaucccagcaccacuuuccucucccuccuguccucucagucccucccaccaccccucuccuccagauccacuccucuauuuuccuucggaaaagagcaggucucccagggauaucaaccgaacauggcauaacaaguuauaaaaugaccaggcacacaccacauacccucauaucaaggcugacggaggcaaccugguaggaggaaaagguuucccaaagcaggaacaagagucagagauagcuccugcucccauuguuaggagucccacaaaacacccagcucuaaaaccacaacacaugugcagaggacccacacagacucccugauagucaccguggucucugugagcccuuaugagcccuggcuaauugaugcugugggccguguugucauggugcaaagggguaucuuaaguggcagauugggaaaggcuugugccucugguugucuuuauuuuuuuuuaauauaccuuuuuccauuuaucuauguugcaggaaggcgugauguuugugaggggaugggcaaaucucuuuuaaaacauuaauaaauauuauuaaguaauagaagagauaauggaagggaaauauuccauguauggcuaugggaaauagcucaggcauuaggcauagcagaaauaaagaaaacuuagcugucuuuccugugcccugggcucagggucuccuaaaagcuccguuugugcacagaagccaugaccucuguguuugugcagguggcuacuggccacaagacuggccucccacagcuggagcccguugacucagauuucugaacagugugaaccccugcagugggugaaauauggggcuggcucuguccuccugguuuggugucugucagcugagguugagagcaccccucacucccaucuugcccuuagacaaacuuuucucuccucucucucacauaucugaaccuacguggcuuaggucuucacaugugggaugugacaggggugaggugauaaagaauggcgggcauuugaaagcucuccccugggaaccaaacugaggggucagauccgucucucauggccucuccuuaucuaggagugacaugccugucugccuauccagauggugagcaaagcucuguccucaggccugguugcaggacagaguagguguggcagggugccguggcauggggugacugcucagccacccugucagcugcuggagaagagcagaggggacuugcaggcgacuugggagggauguugucagucauuuuccucccuuaaacagacuccugcagcuggauggguaccaggcacucagguuuucacacgaauccccuguagucuugucauuuuguauucauucccugccuccuaccacgagcucaauuacagagaagaaauggaaccucaaguaagagcugccggggacaucuagcaacaauguugccauuugggguuuuauuguacugggaaccuccacccucuguuagugugcuuugugucagcuccuuaguagcuuggagaacagccuuccuuuccucauuucuccucagggucuuuucccugggccucuggguuucuggaucgagugaauagggaacgagugaaucggguuucagaccgauccuuaugauguugaggcaugcugagggagaagagagacacuguuaggaguccauuaccucuacagucugcuugauagccuguggcccuagcccuggacucuccuguauccacaguaaugcaccagguggcaguuaucucugucaaucucagagagaaguggggugcaaaggauaaggacccauaaacuguagauggcagagcgaguccuggcugaccaugacacaguugcuucaccuucgccuuacagcagaggaaaugguagcuuagggagaguuagugcgaggauuuaguccccagcccuuacugagugcagauauaacauucgcuucugcuguaagauucuggguaugcguuccuuucaccuguucgaugugugccagcugcugguaggggaugggacaucucucacagacaacagaguuuauguugcuugcuuggaaagagcgcuugacaugcuggaaggauuuuaggggcuacuucagccccgcacuuccucucccagccagacagcagugucucacgcucugggccccauuucuguguacauacagcccugagaaacacaugcccuuaccuagcuugggugggaguuucagguuccugugcguuuuuguuucugccgugagcucggguguaguucuuguuauaauugaagucugccuuccuuuagcuuuaacugcuagucugguggggagguuuguagcaggaagggaugaacugggcauaacaaaugugucaauaugucgcuucuuucucaccguagccacgacggucugugaugcagacacucaguuccggugccaggagucggggacuugcauuccacucuccuauaagugugaccuugaagaugacuguggagauaacagugaugagagucacugugguaaggggguauuccugggaggguccucacacugcucacagggcugugcucguggaugggguggacuggagucgggaauuucugauggacaguuuggaacuuaucaucucccaccuccaugcccaccucuacccucauaucaggggccugucaugucucuccucugcccaguuuuuguagagccacuucgaugucuuucauguacauucaauuacucugaaaacacugaucucuggcuaguggucaucuagaccccaccuccaucacuuauucuugaucagccuuuguuuuccaaucugaaaaauagguccaguuuucucuuuuagacaaucuauacaagacgugaaagcaaggaugcauguuuacugagugaagucaauuagcccuuuuguuuuugucauuuuauuuauuguuauuauguguggccaugauguauaugugagugugugcgccaugguuugucugggguguguguggucgucuguguguguguguguguguguguguguguguguguagggggaacaaauuuggaaccaguucucaccuucccaccuuuacaaggguuguggggaucgaacucaugcuguugggcuugcacuuuauccacugagccaucuuuaugcuuuccccccacacccauuggauucuuaauaacaauagcuaucccucaccucugagccagugggaugcuggccccaggaucuucaacuguggccuuuaauuuccauuuuucuuuuuuuuagacaaguuuucuauauagccuaggguggcuuggcacuccagagcuuccugucucaguuuccugcaugcuggcacugcagacacaugccucugcgcccagcugcacagauuuaucguuguucucuuuaaaccaagcuacugucauaaccucuguuaggagcuggcggauagcacugauguagcaccggcucucuaaaaggaugguuuuguagauuuggaguucuaauagguugccaucaccgggacuagcagggccuccugucuacucuucgacugggauccuccuuaaugaucuccuuagugggauuuuccaauauggcaggaucucuucaugucagaguggggagcugaggcucaugucuccucuucuguauagccuuucucuggcaggccacuguccugccaauguuuugagcaggcacuucucugaagcuguuacuuacaguagaaggagauuugaugcagugugaguagugcaggagcccggagcaccuaucagucuagaaggagagugagaauggagggcagaugccaacacagacauggugaugaguugcugaggugcucuugguccucccuucuguccacaaggccagggccaggcaagcugggcaugugcacacggauggccagggccggcuuuguuugcuacgagcaggugguuugacucacaggggcuagaccuaguggaacaggggcuguucgcaaaucauuuuagcacaaauuauugaacauauuuaaggccacuuuuguguaaaguguuccuuguccuggcuagagaggggauggggauuuauguuuuaauuuuuuuguuucauaauauccuuuuaucaaaugccauccaaaaauggccuugggaugacaacucuuuccaucagucuuuccuuccugccccagaacucagagggugaaauguguggauacaguagaaguguacuuuccccuagaagaaaugugaccccacaugguuccaagucucugugcuugucuagcucccugucuggguaccagucaggcacucgauagcucagcaucccugugcuccauccccauucuggguucauggcucauuccugcucauuggcccugaaaccuucacaagauccuacuuggugcaguucuccgaugcuggucugcugcauaagccugacucuucaugaccucaugacuucauaaccucauucaccaccuuugcuaucacccggucuuugagaaaagcaacuuggacagcuguccugagucccaugauuggcuauucuuauuugcuuucaucuuucaaauuauucuaauaguuauuauauaucagagguguguguguguguguguguguguguguguacacguacaugcacugugccacacauguggagguaagaggacaacuuuaugaguucucuccuuccacauuuacauggugucuuaggauuucuacugcuguuaccaauaaaagcucuuauaaaggacaauguuuaauuggggcuaguuuacaggaucagagcuucagaccauuauuaucuaggugggaagcauggcauugugcaggcagacauggggcuggaggagccagaaguucuacaucuuuauccaaaggcagcuaggaugaggaucacaaagcccacacccucguaacacacuuccuuuaacacggccauaucuccuaauagugccacucccugggccaagcauagucaacccaucacacggguucugaggauaaaaugaaggcuaucaggcuaacauggcaagaaccuucaucugcugcacugagccagucaccuacuccacuucuccuggcuuuuugaggcuuaaggcaauuccacuuggaaauucugugucuccauccuuuuaggcuucugugaaaaaauaaaauuuagaccauaugacuuaaaagcaguagagauuaauuuuuccuugucuuggagucugggaguuuccagaucaagguaccaguagauucagucuugugaagugcuggccuaucauaugcuauguucucugugucccugggaggcagaaguggugaagagagccugccuucucccucagagaagucauagaucccacucuuaaucaccuuuuaaaggcccugucucuugaucugcugcaucaaugaugaauuccuuguaggggguuggagguagggguauguucaggccucagugggauuuuugugauuccccaggaccuaaaagagauauggggaaaccuugcuucuuugggccaagugcacugcaucauuggcuccaggaaccauucccucuggagagcaaagccauuggcgccccagaggggaccccagagggaagaccugaguucuauccccuuccccagcagucucaacacuagagccacuuuccuugaggcgagcaucuuccagugagcagcccacagcucucccucaacaacaagcugugucucuagcaucucgggcucucuggccucccucaucaguauauacuaacuucggucucauugccauagcaggugcagaaauguuuguggaguacauagagaaugucaugauaaaugggagaggccguuuguuuucucagacucucugggugucgguaucguagcacaucuagaagccauuugcaacaugcauggcuucuguccaccaugucugcaugguccauccgugauggacggcuccuggugaaggucucugugucucuacugucugaacaauugguggcauguguccguuucugacuucuuagaugucuaaccuuggaggcagaguucggagcaugccccgccucccaucuccaaccccugcugugcuuucuucucacagagaugcaccagugucguagcgacgaguucaacugcagcucugggaugugcauccgguccuccugggugugcgauggagacaacgacuguagggacuggucugaugaagccaacuguacugguuaguacuuccuagauccaguuaauaaagcuuauuuaguuguaggcuaguuagcauuuaggccucaagugagcauagaaauuagauaccgagaauucgugucagaaacauguuagccuuccucggagcuuguguguaaugaggugggagcuaugaucauaacuccaguguucugggggaaucuauauucuggauucauuuucuuagucccuaguuaguuaggauugcaaguaagaaacgauuuacauagacugauguuggucuaagaaugaugucuuuuuuaauauuuauuuuuaauccuauguguauuugguguuuugccugcauguauguauuugugccaugugcaugcagcacccuuagagaaugucagagaagggcaucccauccucuagaacugcuugcagaugggugagagcugucaaguccaugguuugagcugcacuaaacuauuaaguguucucuaaaaggguuaaaaugcaaacggggcuuguauuucuuugagguaagauuuuauccuuggcaacaucaucauguguggggaaggaguguugggugguauaagauaggggcuguguuccacuuccucucuugguuucacgcaugccuacguuauuuuugugaaugacugaauggcaguguuugugggaauggugaacccuggggaguucauugaguugggaauuuugugagaaacgaacacaaguccaucuuacuauccuuccuggugagccuauguuuuuauaugacuauaacuuuucaagaacuaaaauuagaauuaaaaaaauucccuaauuccuggauuccucuagaagcuggaauucaguuugguucuaagcacuguaaaacaauggcccuguguauuauugggaugcuaaauaauaucccccaaucucagcccugagaaggccacauguuuuuuuggguguggucuccccuagaagggugaaggaccauucuugugugcaguguguguggccuauugaggagggaaaccuagacugucaugggaacuaccaugagcccagaagcacguggauacugucugcaggcuugauuuggaaagauaauuaguuaacuuguuagaagggugcauccaggcauucgguauguaaauugcagcaugguugaauaccuugucaguacugccauguuagacaaacccagcuugcagcagcuuguuccagauuucuggaaugaauuaacacuucagaaauaugggugggcguguuauaaacaacaggucuuaucugugcuuuccuguagacaggguugcaacuuuguuuugccauuuagcuacaaccuugagccaaugguucuucaaacccuuuuaagauagauucuccuucuugccauuucagaauaguuggaggguggauuugagcucauucugcugaugggugugacacaucauuuccugaucuaugauuuaagacaaagagaauggcucaaggugggcuguccugguggacgcagcucacugugcucugaguugacaguguucucauucuaacccacuacuuugcuauccaggguccguuugaggucuuuauuucuuuaaaaacauccuaauuguuucgauguucacuccaggaagaauuucuuuguacuuguaacauccuucuucucucauagguguaucagcacuuuaaauccuugcccaccauuccaaaauuaaaacgcuuaguaaacuauuuaaaagcacuggacagguaauauuuugguuuugucuuuuaaaaccuugaacaugaggacugggaguguagucagugauacaauauuugcccagcaugauucagacccuagguuugauucccaucacuucuaaauaaauuaauuaauaaauaaaaaauaaauaucuaaaauuagucaguuauuacuuguuucuaucuauccaccuaccuaucaucugucugucugucuaccuaccaucuaucuaucaucuauuugucuauuaucuaucaucuaucuaucaaucaccuaucugucuaucuaucuauuaucuauuuaucuaucaucuaucaaucgucuaucuaucugucugucugucugucugccugucugccugucugucuaucugucuaucugucuaucuagugugugugcggcauggguacacacaccugugaagauguauggaagucacaggacagcuuucaggagucagucuuuucuucuaccacauagaucccagggacuuaacucagguugucaggacuggcagcaagugccucccuccagcugcuaaacccgcucccaucugcuaagucucccugcugccaucuuacuacuuuuaguggccggacuuauuugucagugugucacuuuaccagcuguugccuugugcccguguaugaaccuucaaugguucuuacaacagaagacugagguugcuaaaccaucucagggcuuugugaguauugaugugucgcuagccccuagucucagguucaaaugagucuggauuuccucauuuaucguauuuuccuguaauuuuauggaugggguuauuccaguucuuauagacuccugugcucauuuuaauucucuucucagagaagcuguaauaaugacauccuuguuucuauacuuuuuauugugauagaaguucacguauuuucuuucgauacuuguuuucuuuucaagaucugagaauuuaugcuuucuaucuguucuuggaucucgcagucaaguaguucaugauggucccugguccucagcagcuucucucagcccuucacugggcagcaccauccuguugcuccuucuuccuguguuuauauugauuccuuuggacucuuagcuggaugcugaguuacuucuuuagagcugccuuccacuucuucaguucucuuuucagcuaaaucuaauccuuauuucuauggcuguagauauuuuuuuuaaaaaaaauauaaaacaucuauguuuuuaaaaugaauacauuuucaaauaaauaaauauuaugucuaaaacaucuaguuauuuuucagugauaaccuguaauucuuccuaguucucuuucugcuuuuuuuuauaucacuaauuauucaaguuuagcucuauucauacaucuuucuccgggugcacuccgcagcaauccagugcuuuauaagaagugagacagagcuuuuccuccuuagauuuuaguauccaucuguuuaggcccgauuaugugguaaugacuuuaaucacguguuccaacugauguugauaaguuggggaaaaucaaagucagagaggaagugguaggaugccucugauacucaccccacuguaccccccccccgacacacacacacacacacacacacacacacacacacacacacacacacacacacaguuacagugaaucucaucauccugagucuccaaauggcacagccuggaccugucauucucuccauguggguaacugaaguguuauuuuugagcauauauuauuucucacacacuuaaaaucagaggacuagucaauuacucagaagauuuuagugguuaacccagaaaaggagaaggcgauccauuccaggcaugccgggucaguugaguaaacuugaaagcugauuaauccuucugaucucugccucugggcuacaaucuggagaucucggacacaccuccuagacugucauuuggaaacccgacuggcacucugcaauuguuaucaguuagaaacaaagugcacaagccgaauaacaagaagacccuccagguaaaagccuuaagugaguuuaugcucugugaaaacgagccaaggcugagguuggucagaggacgucgacucucagcaucgauaaaucagaguguagguaauggcuguugcuagacagauacucauguaacacgcaccgcucauagauuccgcuuuucagcaugaguguauuuuaaaagauguuuaauggauucuaagugcccucgcuuguaaacauugagaggucccuguggacuuaaauacgugcuucuuuggucuucaaagagaugaaaagacagauaauggauuguauguguuucaaaauaguuugaagaaauggguucuggguauuucugaguauugucaaagaacagccuucaauuccguagaaauucugguagacacgacccauuuuucuaacccuccaacagucaucugaacuggauaaaacuguagcuugcucccaacagaccucucugguuggauuuucuccuccuuuugggaggucgucuuacagcaggggccacaaggaacuugucuagguuacaauaucuccuugcccguguucucacucucuacuguuuggcucacuaucaauggccuaccccuauccaaacauguuaaauagaaaauuccagaaauaaauaaucuuuacauuguaaaugaguuuuauuagccauguuuuaauuguccuauuuuauuauuaacuuguuugguuuuuuuaauuuuuauuuuuuauuucaaauauuuuuauuuaauuuuaauuuuuaauuauuauuauuauuaacuaacuuauagauucuauuucuuugauugaaacaucauaggaauauauguuagaauauacauaugcaguguucaguaguaucuaaaguucuagauauccauacagugucuugaagugugcucccuguaaaucaggggacaacugugugcuuccuuguguuacuugugaacaacacaaauucuggcuuuucuucagcagugaauagauaaaaacagcuucuuguuuauuuuucaugagagaaccauuauacuguugguuuggguugaugcaaagcauuauauauuugagauuuggagauauguuuaaugauauuuuauauacaaaugaagccguuaguuuaugacagcaccucuagggcuggguguggugguauagccuuuaaucccagcauugggaggcagagaaagguugauuuuuauaaguucaaagccagccuggucuaccgugaguuccucgagcagccaaggauacauagagagaaccuaacucagaauaaacaaacaaauaaauaaaugaggaaaccaaaauaaagcgaaaaccugcaucucuuuguuaaacugauuucuuguuaacuccgcaguucucaacccgugggcugcuaccccuuagaugccugaaugacccuuuucgcaggggucccaugucagauaugcugcauauucaguaucuacauuauaauuuauaacaguaacaagauuacaguuaugaaguagcaaucaaagaaguuuaugguuguggggccaucacaugaccuguauuaagaggucacaguguuaggaugguugagaaucacuguuuuaggugaugguacuggacacucgauguguccgcuguugcucucgccuuuauagaagauuuacgucauuccugguccccagcuugcuuucuuuuagaaucuggacaaaucccuuguguucugugacccuggaagugucauuuagaauugcauagaaucaugucacuucauaacuuagaagaacucucaagacgcuaggccucccuccagaccaguugcugaagaaggucuagaagcuucuguuagaacacauggcaucucucaucuuguggcaucuguagggaggaaccuuccgugagagcauucaguagcagcacacugaagaggaagggcccgcuguagagccacacugccugcugcuguuaccccacugucugcuuccuagucuugccagccagcuccuuuguauaacauuccauuguugugagaaucuuuccuguaggugccuaggccuguccacugacucaugccacacugugaugccuguugagacauuucugaauuaauucuuggugaccuuggcccuugugcacaggagccauuuauaucgcagugauguuuucucuagcgcugccuucucuuuucucuuucuaagugauugugguugauaugaagcucuaucacuggcuggugcauaguaauggagaguuagugcuccccaaucuccgagugcuccccacucuccgagugcucccuacucuuaguggcucccuggucuucugucucucacccucaugugucucuuuagcagcaaagauauuaccaagagaaaaagacuuguaccuccgcugcucccaaagucuccaccuugauaucuagcuuagaacuuucuccgggugggaagaaugacucucguccucuuuuuguuggcagccaucuaucauaccugugaggccuccaacuuccagugccacaauggccacugcaucccccagcgaugggcaugugacggugaugcggauugccaggauggcucugacgaagaucccgucagcugugguaaaggcagauccccggcccucuuccccaggguccgucauuaaggggaggggcagccaaugagcagggaggugaaacauuguucuuuuguguuaacagucacacacacauacacacacacacacacacacacacacacacaguaauagaaccacauauacaguacuuuuucuacuagauaguuaacauuccuuugccugacauucuaaauuuucacaguagagucgcuggggucaauauccuuauguaagcccuacacacucuucuccuuucagaguccuucuuccauauuccugcauucccuguagcgagcauuuuuaugaaagaggcauauuuccuuuauauuaguugcgauccccugguuuauccaguugaucuuugcugggccuuugagagcauccccucucacuguuaaaacagcacaauguuccauguccuuagaaggccuguucugccuuugugcuauuucgggggacgauuugcacagcauggacucaugguggcagagguucccaugccuucccaugguucccuucuggcuagauuaucuuaagugcuaucugcccauccugagcugcacauuccuccucaccuccccugaugugagacuucaucgucccacuaauuuucaggaauuuaugacugugccucucuucuguucuacccucuuuccaaaauguuuuuuuuuuuuuuucaaagcagcauuaaguauuuucccaagucauagacucgugggccuuuuuuuuuuuuuucuaucugaaugaugcucuuugacuaauuuucuaggaauaccauuugcaacgcauuuccuugccuuagaaucuagucucuguagagugaaccgaccgcaggguauuaggcucucaaagacugugccugcccugguaacugccuucacuucuagcagugccccgcagcuuagggcagagagacuuaggguaacagaucgggcaucgggaugcuuuaguucugguuucagucucaucagagaugucugugaaaccccaggcucucaacaucgcuaagcaaacacacuccaaaagggcuuugccuuccgauuccuuaagaauaagaauuaaggugcuaaguguuuuguagagcauacaaaauccugaauuuaauaacguggaucucauguccuuuucugucccuacuugcugaagcuuuucccuuucuuauaaaaauaaauagaaagaacguaagagggucuagagucaaaguugucccccccagccccccacccacaccugcucccacucuccugucugcauacuuuaugccccucuuguagaaaaccauacuuuaaugguuuuauauauuggucaguguuuuuaaauguuuaagaauauuucugugcauauauagcuaugugcuguauaaggaugucucagucaaugaugggcucuguuuacggugguccucuagaugacacuggagauguaaaguuucuaucagguagcgacuccaagccuccuaccaucacggugagauguguuauuugugggcauguggcaguguugggauaauuaagccuuuaaugcugccagccacauacacauguggcacacacaacugcauguuguguguggugccacagugauaaggcuuaugugcacugcuguuuauguguuaacuacgugauccuucuuaucauucuugugggccagcuaguagggccagccacuuuaccugguccacugccacaccucuccuguuuaccucaucucucgagagcaugugaagugacugacccgcaucuuggucugucuagcugcagucuugggauguucacacagcagcaaaacuaaaugaaguaugauuauaaauuugaaagcacauguguucuuuauaccucucauauacacauaacaugccacgaaugguauuuuguaccuuguuuuuguuuuuguuuuuuacauaguuguauauccuagaugauuuuuuuaaaaaagucuccuucagccucaugucaccuuuuguugagcagccccuccauacaacaugcuacaacaugucacaauguagcauuugugcuuccgcuaagcuccaggugccauuuuguuccugcauuauuuuuugaguuguguaaacagaaugcacaucuccuuuuggagcugcaggaucaaauauauacgucaguuuguaccuuugcuagccaguaacaaacuacccuggaggugguguggugccuugcccucugccaacaagugugagugccugccugauucuucacucuuguuccucuguaauugacuuaaauuucagagaaaaagugcaauggauuccacugcccaaacggcacgugcaucccguccagcaagcauugugaugggcugagggacugccccgacggcuccgaugagcagcacugugguaaguccaauccuugcccuggugguugcaccaaucucuucuuuacuaccuggccucagaguucuugaccuagggaaugggucagacaaggagacagggcccggggagaaaggaugcauuaugaugaacagggugauuagggcgcuugagcacgcuuagguaaacauugccauuugguugccauguguaccaucagcugcaugguucuuuuugccugggcacuuuccucuuccacuugccugcuuucguuaaaguuugucacucaguauuacuugaggaguaucuuaggccccauuuccauccuaaaaagauugucagugguccacgucuguggagaaugcuggaaauagcuggggacuuuuaaaagccacugugucugggagcgacuccagauguucugaauuacugagaguauggcucggguguuaaggucgaaagagguguucugguuuuguuuuuacaguguuccacgugauucuaaugugcgguacagguugagaauaaauguguuaguacaggugucugaucuggccucuaggcaggauccgacccaucacucaaaagcauguguguuaguguaggcacggcugacuggccuguggccagauucaucccaguucuucugaaugaagucacauugaacacacugugugauucauguggcugcucuugugcugucaugguaaaacuaaguuaacaaaaguuacuauauucuaggcuucuauaaaacaaaggccacuaucucucucuaaugguguggggcucucaugagaacaaccucuuagguuagacauguuuguguacucgcgugcgcgcgcgcgcgcgcgcacacacacacacacacacacacacacaauuuuggagagaaggcauauaauaaagaauugguacccaagcauaugaaagcuuuuaaaaggcaguuauuucucacauccagacuccuucuugcuauggguucucaugaucucuucuucacaugcauuucuuuucuugauuuauuuauuuaauguauaugagcauccugucuucagacacaccagaggcauuggauucaauuauagauugcugugagccaccaugugguugcugggaauugaacucaggaccucuggaagagcaagcagugcucuuaaccacugagccaucucuccagcccccucacaugcauuuccagugucuguucucacagggacaccuauccuauugugauuucucucauccuggugaccuuuuuaacaucaguggcuuuuggccugccucccaauagaguuaccuuggucucaggguuuccacagaggaguuagagacaggggugcgugugauucagccuguaauucuggcuucuuguagaaaaugaucgcugaccuccauaucagagaaucgguguccuauuaaucauaguuaaggugugggcuuugugccaggcagcucuggggugugguuugggcuucucucucauuagccuuguguccuuggcagaaagaggacuugguguugauacccuuauuuccuuguuccgugucuaugcagagacaauaaaaucucuuauacauugucuuggagguuuagcaguguagauauagcaagugcuuucacucagccuagccuuagccuguccuugagcauuuguucaggucugcagagcacccugccagccuuagcugcccacggcccuuccucucuuucagagcccuucugcacgcgcuucauggacuucguguguaagaaccgucagcagugucuguuccacuccauggugugugacgggaucguccagugccgagauggcucugaugaggaugcggccuucgcuggaugcugugaguggaugcaugcgugaaugcaugcggaagccggccacucuguggggcaccuaagacuuggaugcaggucaugucucagugccugggccugcauuuguuguuccuuuucccacagaagcacugaugcguugucuauuuuaguuauaaauggaugugaugaggcuggggagugaccaggaccuugucacgugucaccuucugggagagacuggcuuuccgaugauauuuacaggcuaaucucucuguaacacagcuuugcuccagcagucuuccuggcacggauccucgcuuuguauacuuucucuuacagccaaccucuccugcugcagaauauccuuaggugucccuuuugugaccgaauagccggcagaaacagcuuaaagaggaaggcuuuacuuuggcucauggugccauaggguuuggucccugguugcuuggcaucauaugcuuggacagaauauuggggugguggcaguguggacagggagagcauuuuacugcaugacacaugggaggcagagugaaaaggucccugaggacccagugcgaccuucaaaggcccagccccagagacuuacuuucccuacugauauuccacgucccagccagaguucccagagccucccaaaauaguggcacugaguagggaccaaguguucaaacauaaaccuguuggguacauuucauauucaaagcauagcacuagggcugugcaugccuuaagcuaucauagcaaagcccaguagacugacugugugcuucaaccaacagaaacuguuguccacucuugagguguugggagcacuauccggggccucccuccccaccuagugggugcugucuuuaccuaugucgucacgugaucguucuccuguaugcaucugugucucaauuuccacuguuguauauuuuaauuuaaagaaacaggguccugccauguugcccagguuggcaucaaaaaccugggcuucaggggcaaucuuuuccuaaggacacuagucaauacuagacuagagcccaccuugaugacucuauuugaauguaaauuuccucauugaaaguguuaucucuaaagcaggcacaguauuggagcucagggauuuggcccuguccaugccccaugugagugugcggaauggauuaguuauugugugcucugcugagacccggucccgccuugauuucucagggcucccuuagcucucagcguaggaccuuagcuaccaaggagcccugcugcucugaacucuccagcguggaaguaaccugggcuugaccgacaguucucgcccucuagcgcaagaccccgaguuccacaaggagugcgaugaguucggcuuccagugucagaacggagugugcaucagcuugauuuggaaaugcgaugggauggaugacugcggggacuacucugacgaggccaacugugguaagaugccggaagucccgccucccgcagccagccuuccuguuacaggcgauggaggaugcucaagugccuucugcugccucagcagcacagggugccggcuuucaaguccucacggaaggaacagacagggaagcuggcauccaguaggugcuaggggaaagcucauuccacucccuuuuuucacggggccacaacccauguucggaagauaguggguaagggagaaugguaucuugguuccuuuucuuguggcaggaugcacaagagagccacguuuaggaagaaacguuuauuuuggcacacaguguaagggugcagucuggcacaggcaaggggauuaugacaacagugaccccagacaaccacacgcagagucaggaagccgagagaagugagugcggacccucgauucaguuucuccuuuguacccaguccauggcugcagccgguggaacacgccacccugacucagcaugggccuuuccugcucugcuaaacauuuuuggaaggaccauaaucggcacacccagggguguguuuccaugacgauucugaguccagcuguauauugacugagaucagccgucaugauguucagugcugaggaguguaccucccucugccaguuacagaccauaccaucauccuugggcugucuucacacuuaaacuaugucuuuggugaagugucaugguuagaacucagagugaccauucucaggguagcagaauaggucagagaagugggacuuggggccuaagaagauggggugcuguugaguuuucauguguuccuuaccccuccuuggacccacgaagaugccauauguucuuccagggagucggacaggugcccuaggacuuggcccuuggggagauaaacauagaugaauccucuaguucacaccggugcaguggaaaugacugguguguuugaucucuacagaaaaccccacggaagccccaaacuguucccguuacuuucaguuccacugugagaauggccacugcauccccaacagguggaaaugugacagagagaacgacuguggggacuggucugaugagaaggauuguggaggugagaaccccagguacuggggucagcccgagccccacccagccugggcagcaggacagcccugccuggcugcagacccccacucucucuagagugccuggcuuaauccuuacucuuuggcuuuuugugaugcugaguucuucugugaucuuucuuucucauuuugcaugucuguacagaugcucauggaggccacgggucaaccuccgcugucggcuuucagucucuuuucaccuugguuuaugagacagugucuuacuggggacccggggcucaccaauuagacuuagcuggcuggccaacagacuccagagaugccugucugccugucuuacccuccccccccacccccacuguggacacaaaagcaugcuccacuaugcuuagcauuuuguauagguucuggggauugaacucaggcccuuggccccgauccccacucucuguuuuccaaucuaugugaucaguuuucaccgucuccaaggcuacccauuccugcuucugaagggcugacugagggagcccagagccuugauucuaacguuugcugugcagcccccgcccccacauuucucuggacuaucuuugaaaugucagaggaccccauaccagugcacuucaauauagucaggggccccggguuagaacaugugcugcuguugcccuuugcuuucucaccuugggccauugaugcuuuaucuacagccaugcuaggccugggugagaaugguccagccaccugggccuuccuuauugccuguccacccgcuuccucuagcagcagucaggagcccuugcaagagcaaauguauacgacuguuacauuauugcaaguguuguagcuuauuaacuccccuaagcaguguggaaaggcugccaucucuucagaaaccccuuccauaccccauauaaaugcuauuuacaugagcugauguucaaggcugugucugacacuggucuccuugggcuggugcaacagggaugucaacauaggcuugggacacguuuuuuaauuggugaucaaucuucuacuaacacuucuacuaacacuccuugcuuguucuuccucagauucacauguucuacccuccccgacccccgggcccuccacgugucugcccaauuacuuccacugcagcagcggggccugugugaugggcaccugggugugcgacggcuacagggacugugcagauggcucugaugaggaggccugccccucucuaggugaguccuggccuugaugugcccaguuggcauuuucuuuccuggaggggacucugggaguauuguguaccaagacuguguggcaacccaagagaagcaucccagcuuuuaaacugcucuguguguuucuggccagaaaagucccacuccccugccugccaccccugcuucccuuacaguggggaauuacagaugggguaauaaggcaguguuuuguguguguacaaaacuuaggggaaagaaucauuuuuaugcuuguuggcuggcuggcauucccucuaaaagaagggugaccacugccaucuaguggcugaucacagaaacagcggaaaggucuguacaaccugaucuuugagguccaccuuugagaagucaccuguccuguaggcagaacuggggugagggggccgugucuuucccugaacugcaagcagucccaagcuugcuuuuugaaaggagaauugacacuugguuggacugcuuugcacaguccuuuucagagcccaaucuuaggucugcagagauccucuuccucugugcacaccccagcacuucccuuuuuaaaagucaccaguggcuucuugcuuggaaaaucagaggaggccuuacggucuagugguggaagaugcugugacugcuaaacaaauaucuuaacuuaggcagucauuuuuaacugguggguugcuaauucguuuuuuaaauuuugguuuuuaaaaaucguaaguguauauucauuguacaagauaguggguuuuauuaugauauucccauauauguuuaccaugugucuuggucacagccaccuacauuauuucucaacuugucaccuugccccuucucccuguggucuuguagaagaucaauuuuuuuaaaaaucccccuuauguguaugucagcguguguguguguauguguguguguguguguguguguguguguguguguguguguguguguguacucauaccuguucacauguguggaggucagaagaccaccacaucuuugguccuugcaucccaucuuguuugggacagccagggucuauugcuguguauagaugcauaugccaaucuagccgacacuuggggacuggggacucucugucuucaucucauccuaggaacccugggauuacugcaaggcaagcacuuuauccacugagcuauccucccaggccaggagagcaguucccaacacccagccuuuccucuuuccuuccucuucauucuucuuuucucccccuaccucuccccagcccucuccucugcucuccaccgccccuucucuucucuuugcucuucugccucucccauugcucuguuccuaucaccucucuuccuuaguuacuuuuuagagugaggcucucacuguguauccaggcuagccucggagcguguuguagcacagccugcagagaccguguuggguggcuccuaugcugcgguggcugagaacgccguaggagcaucucggcgugcuuuguucaggccguguuccugugcuucuuacccguugcuccugaugcuccuguacgguugucuuugugaggcugaccaccacuaugucuccauguuucuccuuucucuucuucucucucgugguuaauauagaaaguuccugggagagaauacguggagagagaucuggggacugacacguuugaaacuguuuuugcccugucuucagguuugauugaucugagcuggauuuaggagacuagcuugucaauugcuuugcuuuagaauuggaaggccucugcgguuguccuuugaguagcuuuuaggaaagccauggccaacgugagccauuucauuuuaaguuuucugcucgcuuaucauaucucccgcuuggcuccuguguucugacuuuuuacuaggcugugcuucgauguacauccuuuucccaucuaguguggagauccacgugucgggguuugagggaucuuuccuggaacuguuuaguuaauggagcaagccucucucuucuccuggugaccuuguugucugucacugucuguugauuggaucuccucaugcucuuuuuguuuuguuuguuuguuuguuuuguuuuguuuuguuuuguuugaacaaaaucccucuguguagcccugcaauuggcuguguagagcagaccgggcucacacuugugguaauccuccuaccucugucuccugagugucugggauuucaggcacgagucaccacaucugcaucugcgauccuuacucuugccuuuuugguuuguuucuuuguuuguuuguuuuuuguguuuuuuuaaaaucuuuuuuagcuauaaagauuuguaucuuuucuaacugcuuucugugacauuugccucacgucaccagcucuuccuccgagugucuucguuucuguuauucuggauucacuuguuuuucauguuuauuauuguuccuuucaguacuguccccauuugcauggagaauauguguaugcccacgagcauacuaaagacauuuggcgucgaaguuugcgucuguguguguuugguggcgagguguguauguguaggaugccugcacaauuugugugccugugggugcgcacacaggggccacagcaggacauuggcauugggugucuucucuaucgcuuucagcuucaugcucugaaacagcccuucacugaaucugcucugcuuugugacaggggugcuggguauucagaaucaaguccucaggguagugggucuuagucacugagccaucuccucagccuccugacauuuguuuccuauaaagcuguuuuuccuccaaacaaucuuucuuagagcuaugugugugugugugucugugucugugugugugugugugucugugugugugugucugugugugugugugucugugugugugugucuaugugugugugucugugugcauacuuguaugugugucuaugugucugugcaugagugugcaucuguguguagguguguaugcauacuuguguauguaugaguguguguguaagugugugugugcacacuuguacguguguaugaguguguguucauguauguacacacuccugugucuguguaugagugugugugcacacuugugugucugugugcaugaguguguaugcaugugugugacugugugugcacacuugugugucuguauaugcaugugugugacuguguacgcacucguguaugugcacauuugugugcgcgcacaugcacaugcaugcauacaugcacacguugcauuuuauuuuguuuuugaggcuaaaggcuuuccuuagauaacucuuuauagcuacauguguuuuagaacaggaacuaaaaugcugagcacuaauagguuccaagcacacuacugagcaugucggcuuugugcuuuguggcuagccuuuagcuaggaaaccccaggccuuggcaaguuccuuguuuauccaugaagcugucaguguacuuaggccuccugccuauacuguaaggucucaugucagagcucucgggaagugucuuggcuucucauugacugacuguaagucaguaccucuguuaccaguagcuucuucuuucucagguaaggcugcucagacagcccacuuugauucuuuacaaaccacagucagccgggcuucuggccuacucagauaugggcagucgucuccuggggcuggguccagagggagaugguagcaaggaggcugcucugaaacuucugacccuuuuccggucgucucucucacaugauaguuguugagccucugggggacccugugauguugagcuggcuggcucagagcguucucuuccaauagcuuccggugggaugcagccccucuucccuccacacucucagcacauugaaaaguugaacaguugcucuuauaggcaagcuuccuccuuaccaaaaaguaauuuuaaaaauggcauuuuccuagcaaacuccacugccgccuccacucccacccaguucgggcagugcgaccgauuugaguucgagugucaccaaccaaagaaauguauccccaacuggaagcgcugugacggccaccaagauugccaagacggccaggaugaagccaacugccgugaguauccucucguggccauugaguccugaguccccuucuucagcuucgucuuugggcagcugguuccugucugccuuggguaacuuuguuuacugaauugucuaugagggccuuagcgcaugggcacacgucacaguauaugguagugacaccagauuuaacaggcuggcuaaauguuaaauaccuggagcaugcgucccuagcagaaagauucugaauggaagaaaaauaucuugaaugagguuuuuuuguguguguuuuguuuuauugcggaacauauuuaauuccuaaaagccccuguugguaaagccauggccuuuuggaaguauucagugagcaucuuaggcauuuagaauauucuauuggacagauccccacugcacuguuagaaccucaccccucaccccucaccccucaccccucaccccucaucccaccccuggucacuggcacugggacuuuccucuguggccuugcucucauuccacguugaauguccuuaucaagggagaauacaccaagcccaacacagagaaauuaaaugccgguuaguggaaaauccuacauuugcaugggaagacugaagaaagcgaaccccuggggcaguccgauagcagggccgguuuaccucaugcucacgcucaccaaagccacggugggaacagcuuagccaagagcgagcuguggcgucaggugaauguuaaaaaauaauuaacaggaaagaaaagaagcaggccucccuccuggcugaucagaacucgcuaauuggcauucuuuuaaauaacuguuuucaacuuguuccaaaucuaucucacucacagggguguugcuuaguuaaggcucuuaaaaaaaaaaucaaauguacuauuacccauaauucccuuguuucacucuugugaucgccuuaucaaagagaagacauguuuccagcaccccacguucugugcucagugcucuucagucacgggccuguuaaucaguuuaagaauuaauggcggucuuacuuuuggguuuuaaaacuacuacuuguuccuaagguuuuaagacacauuucacaaagcugccucagaucccccgucgcacuguucacugucacuucuguggcugcuucgaguugccauccaaugggagauuucgguggcaggaaucuuagguuuuccaagacaauucccuucagaacagcugggcaccuuucugugucacaagccuaccauucagcaucccacccccaaaagaacuuuuaggauguccucugccuugucuccugcacuccccagaguggcacgcguuugcaguuccucucauuggagcucacacugugcgggcagguccucugcagucguguggcacgucacugucauagacaguugucccuguaucaugccaugcucacugaaugggugcaugggguccaucuggggcuggugaggugacggcagccaugguucucaaaccucuuuuuaauacaccuucaugggacccauagcccuugcccuucugcugcccaaggcaaaaggauuucugcccagcauauaauaaacagcuguaauaucgugcucuuccuguagaagggggguucuagcuguaaaaaucuucauaaggguuucaagagacauggcuuccuggagaaagcacuuaccaugcaagugugaggaucauaauuuggauccuccgcccccacaugaaagcugagcagguguggaagccucgccuggaauuucagcaguuagaagguagcgacuggggucuggaggcucccugucuagcuagucuccaccaagcagugagcucuggguucaaccgagagaucucacuguaaugaauaaagugaagaaugaucggggaagauacccaaggccaaccuagcagccccacacccaugcacacacacagacacaaacacguaggcccacacauaugcgaacauauauacacaccacacacauacacuacacacacacacacacacacacacacacacacacacacacacacacacacaaucucaucauaaaggguuuuggcccuuccuguucccuuguguggcuauggauucuguaccugugcauuccagugggccggaagcuuuccaaacugaccuugaacugcucaugcagggacucuucgcuuguauuauuuccaacacagaacagugccacaccuauuuacacacauuauccccugcuggggacuguaaaucaccuagaaauaacuuaaaggaugugccaagaggcgcagaggcuaugcuucuuugccuucacuauuuaaguugacuguuuugugugagagagcuugguaccuacagggaaaccggaaccugucgagagagagagagagagagagagagagagagagagagagagagagagagagagagagagagagagagagagagagagagagagagacuggaaccagccguucauguuuucuaaguaccaaacaauuuugcuccucuauccuagacacucuuguaaagaugucuagaaccuucccugugaaaagccagucauugaacagaguccuuagccucgcccuuccucacuggcccauccuguaugcuuuacaaucuggaaauaucuccaggaauucuccaugucuucccuuugagcaucuugagugcuccuacgaacaccauccacuuucuucccgggucucacacuauguacagugugaaucagagggaagcuguagaggucgguguuucucaaccugugggucgugaccccuuuaggguugcauaucagauaucuaccuuaugauuaauagcagcagcuaugauguagcaaggagauaaucuuauaguuggggucaccacaaccucaggagccguauuaaaggacggaagcaauaggaagguugagaaccacuguucuagguagaagacaggauuacagggcucauucuaagguggagacgcuugcccuucgaugucacauggagacugaaaacugugcacaccccauugcaguacauuuggaacaaguccugggaaucuaguuuuuaagacuguccucagauaacugcgaggaaacaaaguuguaaauguucuguuuuuagauuguucuccuagcuaaucucuuuagagagcccuggggaagcuggguccuuacuuucuccagcgucugggcggaugucccuuaggagcucauggauccucugccuucugauccagcagcagcuuugcaucugucuguccuucugcccuuggucaucucuuucuggcagcagcaggcaaggucucucugcuuugcagggcccauggaauuagcuggggcacagcugccuaacagaugauauagguuggacauucucuaucacgauccuuccaguugacacagaacuagccaggacgccucauaugcaaaaagccccaggcuugaucccagcacccaggagauggagauaggaggaucagaaauucaaagacauucuucgggacauagaauuggaagcaaggcugaaauacuugagacucugucucaaaaccaagcauaagcaaaacccucaucuggucuauuugacucugaaacucucaaucuuccugaagggaaaugcuagucaauucauuacacugcuacuacauggccaguaccuuucugcuucuccucccagagaaucuuggagaucaguuguuccaaggagccagccuacuuuccguaaauguggugacccugggcccagccagcauauccuuuccccccggguuuaaggagacucucuguauuucagccacucacagcaccuugaccuguacgagcagggaguucaagugugaggacggcgaggcaugcaucgugcucucggagcgcugugauggcuuccuggauugcucugaugagagcgaugagaaggccugcagcgguaagucauggacccugcucuacacgucccgugggggcuucuagcugggacccuuggaacucuggcugcacuugaaacuguacuaaaccaggguggguggguguggggugugguucgacucugauggaacucacagccagcucuucccuggcagcaaagccuugguguguguuucccacgaucuguaccccugcagacauacacgccgccauugcucccucagagccccgugcugcaggugggguuaacucagaccuguuauguagaaugcauggcaucccucacccugcagugucuucuauugagaacagagcuuaaaacugaucaggcacaggggagguaaaaugccuaaggaaauaccgugggaaauuuaggacagcccuggaaagggacuauggagagauagauacugucacauuuucugggguaucuuuucagguaaugauuguguccucuuaacaauuuagucuguagugguucuaccucagaggagaucuuugaaccucaaggauuuguaacguaagccuuucuuggaccccccccccugugucucuguagaugaguuaacuguauacaaagugcagaaucuccaguggacagcugauuucuccggagaugugacuuugaccuggaugcggccaaagaaaaugccaucugcuucuuguguauacaaugucuacuacaggugggucccuuuagccucggacacggacgccccguggguucuccugugaugugccuggagaacucuucagugggcucaugccucucuugucaccccacauggccccucugugacagcguccuacuuguuuuggucagggugguuggagagagcauauggaagacccuggaaacccacagcaauaaaacaagcacugugcucaagguccugaagccagacaccacguaccagguuaagguccaggugcacugccucaacaaggugcacaacaccaaugacuuugugacccucaggacuccagaaggguguaaguacuacagcugaucuguucuuagguaugaaugugugauccuggaaguugagcccagggcccugcacauuuccgaaggcacucuaccaccgagcuacacccugaguccuuuauaaauuuuauuuugagacagggucucacuaauuugcaccuggccuggaauuugcacucuuccugucuuuccaucccagguagcuaggaggagagcugugcacagucauacccacuuacaaugcauuaaguucaugguguuuuggguguguguggaggcaugggugugcaugcucacacguguacauauauaccgaaugugcuugugcggggguccagaggccagcucugggucucucuguccugcucucucccucauaguuuuugagauuggauugcucaccaaguguggaaugcacuguuugggcugggccagcuggcuauggacacucgccacccuguccaaccucuccaugggucccagggaucugaacgcgggucccucaggcuugugcagggagcacuuuacccagugacccauuuccccagcccccaggauaugaucauuagagcauguagcagcccuuuuccugaggaugcuaucgaccgagcaugugcguauccgcacaccgcaugugugaggaugcacacccacuccuugcuuggguggaagugcuacagggcccagaauguucuuacccuuuagacgugaguuucagaugcuuccuucccaccccccaccccccaccuuugguaugucuugccuaguuucugcuuccauuuuccuuuucuggguacuuccugguacccgauaguuacgauggccuugucccuuaaauaugaggcaugucagcauuuuguugccaaguuuuuaaaaacuuaacagguucuaagaagguuucccaccugcuccuuccuucagaguagacagcgcuuugugcaaacuccucucugcuaucucuucuaauacuugaguauuaauugaauaagaguuguccagcugugcuguuucacaccaggccgucuuccaucuguccacccacacccauuuucucuccaacccucucgucguuccacucucgcaggcuuggggaucacuagucucuguacugcugugagaucgcucugcagccucuccacauaagugagaaagagcagcagagauucaccuucugggacuuggcuuauuucacuugacauaauguccuccagguuuauccaugaugacccaaauggcaggguguccuucuuuaugaucacauauuauuacacuguauauacguaccacauuuucucuuugucuacuguggggugucuguguugauuuugcaucuuggcuacugugaguuacugcagaaauacggaauauagguauacagcuuucuuuggauguaugaacccaguaguggggaugcugagucauagcacaauacuaauacuagaguuugagaaaccaagauguagugagugauaaucucaccaguaguagguuccucuaucucugccacuguguaagguucuguuggcuucuuguccuuccugaucauugcuagccacgauuauuggguuaaaagguaucucaucaucuggauuugcaucucuucaugauuauugauguuaaacuauucuuuucauaacuuaccuguugauuccuaagccauuuaauuuuuccuaaauucauguaucaguccuaacugcuugcugguagagucucucucucucccucccucucccucucccucucucucucucucucucucucucucucucucucucucucucucucucucucucucucucuccacaugagcaaguaauuugaacauggcuucuggcuuggcugucuucuagugccagaugccccucggaaucuccagcucucccugaacagugaagaggaaggugugauucucgggcacugggcuccucccguccacacccauggccucauccgugaguacauuguaaguacugucuggacauuggugugggugucagagagccucaggucacuagggugugauuugacgcuguggagaaugaccccaucugccagguugcugcccaucguucuugccuccuuuuccuaucgcugugaugacauauccugacaaagcaacuuaaguggcaaagguuuacucacuguucaagaauauaguccacaguggcagggaguucagggaccuaagagcugaaauagcugggcccucugcaucuguaguugggaagcagcagugggugccugugcucaguucacuuucuccauauguacaguccggcauccaguccaagaaaaggaugcgcuagcuacaccccacuuauucuaaucaagauaaacaccugcagggauguucacaguguccucucccaggggagucuagauccucucaaguugccaauuaacacuagcagcgcccuaccuuccccuuccccgugugagccuuuacaaggcauuagcaggccggaucucugauuaccucuucccuaugcugauacuucucccuguagguggaauacagcaggaguggguccaagaugugggccucccagagagcugcuagcaacucuacagaaauaaagaacuuacugcucaaugcccucuacacugucagagugaguguccacguucccuccagccacuggccagucccaaagcacagggagguggcucccuuugucaggucucugcuuacggucaagagaugagucuugguguucuucacaauaccuaguucguccagcuucccucugagagaacgaggagcuugugguaauguagcccucccugcuucuaaccagacacuguugccucuggggucuguacuuuuguauacacccuguuuuuccuuaucauuagcuaugggcaauacggugcugaguggcaguuauaaaccaauuuugugagguuccuaugacacccaguauaaguauauuuagcaggaaggagauagguuuuauguaaaggguauuuacucaagccauuaagacacccuccacgcccucucccggagauuccucguacugagucucucuaggacuccuuucauauggguguacauaugccuuaaagaucucacucacacaugcacauacacacaaacacacucacacauacacacacacacauacagacauacacacucauacacauacacacacucacauauacucauacauacacacacacacucacacacauauacacacucacauacacacucacauacacacacucacacauacacacacucacauacucacacucacacauacacacacucacauacucacacucauacauacacacacucacauacucacacucacacauacacacacucacauacucacacucacacauacacacacguacucacacuuauacacacacacacucacauacucacacucacauacucacacauacacacacacucacauauucacacucacauacucacacucacacauacacacacucacauacucacacacacacauacacacacacacauaccugcccuuuagaagaaucuggauaucaauaggauauauuacauauaaaauagaaauuuuauauccuuaggacuacuauaauucuuuuugucuuguggcccucuuauuucauuugcuagggccucuguauaucccaggucacacugucuauauuuuuauuuucugccccucacugcuaaagucuuagccauuuagcuuguucagaauucucgcuguaugguguguuacuuuuauuuccuauuaacucacucugauuugaaaagguggcugcggugacuagucgugggauaggaaacuggagcgauucuaaguccaucaccaccauaaaaggaaaagguaagugauuccagcgccugcagguucauacaagagagaaggaagccuugguaagggaccugcacugagguggaaaggagccacauagguuagaaagcuccucagagccuccucuuccccagcacagacauccuucggggccacaaaaaugugaagucuucuugggcagccauuggguguauuuuuccacgcacugauugacagaagucauuaugccaggucccuugugugagcuugugcaacuucuaacauaggagucccuuuucacuaaggcuggacacaguuugcacacucauuugugaguuguuaaggcaccucacugaugcuuguucccccuccuuagguuacacugacaagcuaugucagggcuaggggugacacauagccucggggcugacccucacugcucggcacccaugaguuuaaucuaacuguugugugucacuggcccugggacauacuuaaauggcaacgcuggggcuagagcuguacaugccugacuccaaagccuguguucugacccuuccugcugcacaccuccccagggcugagcuccccugggccugcugggcugcuccccauccuguauguggaccuccuggggcugagacuuuugcccuucgcgucacuccauccuugguaccucgugggaagcagacacucaguuggagggugaggggguugaagcaucugggugaagggccccagcccccucugagcccgggaggggagcccauccucccgagugguuuucucagcauagcuguggcgccgaggacuucuaccccauggccuggcggauauuaaaaccaaaugaucucuguggcaugggaugcuuuugggugauucugcuuucucccgagucugagaaguucugagacucccuuugguuacucuaaaucccaugggacugugaugaucaggguaggaagcagccagaauuaaugaugcuggcuaaucuguaggcagaaugcuggcagguuauaaagaggccaugcccaauccacuguguuugagagccuauugucucuguggaaaucugggccaaggucuacagacuauccaaaucuaaaagaagggaguuuggaagaccacccuauuccugaauucaguaaacacaaucaaaucugcaucugaaaaucaucccgagcuguggcuuccuuuauucucuccccgugguuuggccaagucucagcuccucgugugcucugcuaggcuguguguagagaggguagaucugcacugcaccaaagagcaucgccaugaaauaccugugaccuggggucuuaugacuuuggaagaaagaugaaggacaaagagcauugaugucagccaggcucauucccaaugggugccacagguuaccaugggcaccagggagcaggcugccauguguggugugcuucuggagaguugugaccauggucaccaugauuauaguccaagccaacuuuuccauagcaccacacgcuguccuucagaaaggacccaagggggcuggaacauuguuguuccacauagagguaucacucacagggauccugccucuuuaagagccaggcugaagcuggacauugguacagugacauuuaucugcucacccuaauugccaggccagcugacugagucaaguuuguugugcguucaccaagcaacaguggagccugccucagucagggacguggugguaaaagagauggaugguuaaaggcagcuggggugcccuuuauuccccuccugaaaggucacuuugucuguugagaugaaagcugugaagucccgccuuccacggugugguuucucucugacucuucucucuuuucagugauccaagcaccaaauauccacauugacagcuacgaugaaaauucucugagcuuuacccugaccauggauggugacaucaagguaauucagaguucccagacucugggugggucguuccuuugugcaggaacacauaugucuuaguucagggagauuagggaacaugaaggaccuaaucuggcggugcugaaauaccagaccacgguuguuuucuuuccccccucgaaaaacaacucgagucuccacauguaauuauucugccucagccuggugccuuucuucuuuaaccauauaauuaaaugguucacggcuccagugcauagagagacuugguguuaagagaauauguguacccuguaauuuucagcuuuauuggauuuccggguccucgcucuaaugcuggaguucccauugugguagggcaagcuuguggggacaaugagaugccuuggaaacccauaugcuuugugucucucauaaccaugcagucuccccuccucugccaccacuggucccuugcagcacccgucugcauaacccgcuccaccaugguuuccugucccugugaucuugcgaacugaaacccacuucaauaauaucauuucccaucugcuguuccucucuccaucccucccuaugauguugugacaggauggucuucagagucccugugccacucacuuaaguacauuuacaauccugucuguucuugguuuucaaagaggacuaauagaacagaaagaugccuuugaauggaccuuugucacuaguguuuggucaucaagacuugucuuuucuuguuuucccacauguaaugauuuuuaguucagaaucgucucuaauggagaauuuggggaagguagucuuuccugauuuuguggguccuuauguugaccucuugaccuugccuaagagcacaaccugaacugagauagcccauuaacgcccacuuacuauaaauaacugcagcuuauuaaaaaucagaagaaacaccuguccacugaaagaggccaggcaucugaagaggccagcugugccggguguagucuguguccucugacugcguuaggagaucaugucucacacuuucugguucuuggcaggucaauggcuacguggugaaccuuuucuggucauuugaugcccacaaacaagaaaagaaaacccugagcuuccgcggagggagugcacugucacacagagguaacaaacaccccgagcuacggugugugccagcaggaaggcgcaagcuagaccagugcuuuccugggaguggagcuuggcaggguggggccggguaugcgaggggguuuucucuagagaugaugucauauagacaguccuugcccauugaggacaccaucugcauccuccucagccagguagagagucuuuacuugcuggcuccuugaaccugucuucuaaaccuaaugguccucaguggaaacuggaacaaaagaggaagcagcucuaaggagccagacugacccuugcugggugauuauacacuguaagaauccauccggaguccauugccugcuuccugucuaguuugacagccccucagcuagucagagguagcacaagcccuacugagugauuguccuucaguaaagacuugucaacuacacagaagaacaaacuuacccugugcaaagugcaagcucuauuaagauuccuuagccuggagaugaucucacugggagauucuaauguauuucuaagagaaaaccuucaauaccaaaggcugcuugugggugcugugaguggcuugggagcuuucuccuguccucuucuuccagaccguuugcaaggacugucacucacagguuuauccccuccuccuuauaugaaagagaucacaagugcugccaacaucacugucaucaucaucguuauuuauuauuauuacauuuugucuguccuggggauuaaacccaggaccuugugcaugcuaggcaaauccucgaccaccgaauuugcucacagcccuugguuuuucauauaccauauuagcucagguuggccuggcacucacuuuguagcucagacugaccucauauugacaguucuccugucuuaaccaguugagugcuuggguugcagcucugacuuuaacugggacugcacucaugaacauggcuugguugaucauuuacuggggcaagggcaauugcucaguggcuaaacugaagaaaaggacuccccacuccccugccagggcuuuacuguagcagaccauggauguccuuguucacagauauugagaccuucucugguuuccugggauaguuggguugaugggugugagucucaagucuccugcuccgcaaggccaaauaacugcaggaguauuauaccaauuguaugcccacagucagcuuuaaacauuacccagucuuuaggacauacauugcuaaauacuaauaaauaguaaaugaauuugcaaacuauugaaaaaugggguguguguaaacccaaccaaauccuugacugucaccccaugucagcccuccagccauggcaucccccuuccuucuuuucacaguuagcaaccugacagcucauacauccuaugagauuucugccugggccaagacagacuugggagauagcccacuggccuuugagcacaucuugaccagaggcagcaguccaccagcuccuagucucaaagccaaggccaucaaucagacugcaguggagugcaucuggacuggccccaagaaugugguaaguggacaagaaugaccauccccagguagucugaauccuccccgagccuaagcccccagacagccauggggcccucuucccugcugcucuugcuucuuuuccuuaccuggcacaagucacuggccaggccagcacgggauugcccccuggagggaccugacaucccagcucuuccccccauaucccuggccucacucugcuguccucagaugcucucggauauuugucacuggcuaggccacaugugauggagugcugcauuuaugcccuaaggagcccauccugagcggugggcuuggucacaucuuuuaguuuacuagccucugcucuuuuauacggcccaccaugugaugcugagcagaagacggugacaaagauccccauccccgcucugcacaccaccccugccugcagcaugaggagagucuacccacaggcagucacuauucucuauuaagaggcucagcguggugcuggcccacgugucccacugagcagcccuccagaaggaacaagguguagccuucaaaacaguggagcagcccacagggcuagggccucucuuuaugugcccuaugugcugccauagccuggcuugugcauucacuggucacacacagccaccuuucauaggggaggaaugaaaugaggccugcugugggcagccauauccugcucccucccgucucaucacugagcauucuggcagcgcucgcgguugucuucuuuaccaucugugagggacuuuucuugucucccaacuccucccacgcucuggggacucauccuagccaccccaccuccugcuccaugggucugauuauaaugagagcauccuccuucugagcaccgggccccccacguaagccccgagccucacuucucccuuuuuccgcuauccugugugcaucugcuuuccguccuccggauacccucaguucuucucuucccggcuccuuucaguuaaccaaucccugggaggccaccuuuccucucucauuaccuaagaucccccuucuccaaacuuccagcugcugagcagaguuacaggaaguggacgcccccugucaguccccucucugugcccaggacagcugcagacacgcauucucuuucuucaggcaccuggccuccugcgcauauacucaggggaggaaguauucugauccuacuuucucuccuucccguguaaacacacuccgcugucauuccuugccuguacacuuagcccaguuccaacuuccccaguuuaagauucccucauucuacguggacccguagaaugugcuuuaagccugcccuuccuuggucaagugaaguucaaagccucuauugaagcaagacacguucacccuggaagggacauaggccuggccaucuccagccaauggugugcaucuucaaggucuucucaaggguagacagccugcuaugcaucuucaagggcagacagacugcuggggcugcaguucauuuucuacauuccaggcagcaggagugggaagggggcagggggggggagauaggcaguccugcuauuaaaagagccuuuuggaccacccuacagggcacuucuacuuacaucucauugguugagaccuuauuauccgcucuuccagcuuuccgggugguagagaaagcagggcucuucuaaagggaaaugggggugcugggaaggcuggcugugucuguccuccuguguccuguccucaugcugcugagauucccaugcugagcugacaacuuccacagcuucccaccccacaguguagccacucagcuccccugucucugcugugugauuguaugaugucacugccccuugacgagccccucucugcccugacaccucauacaggccucgggacaacacccagcgcuccucauuugcucuuguagaggaacaggugauuuuugccuugucugccccucccuccucaagcagaggcucucugugagcaggggcugccccagggucacuuuugcaggugcgcacugggcgugcccauuccuaaguaugcucagcauucuaaaggcagagggaguauuucucuggguacuuuacaagcacuuccaagguuuuaaggcagcaauuucaaaccauggggacacagacccaucagcugauggccuuuccccuucucugccuuuuucuagguguaugguauuuucuaugccacauccuuccuugaccucuaccgaaacccuaagagcguaacuacuucgcuccacaauaagacagucaucgucagcaaggaugagcaguaucuguuucugguaagcuuucuccaccagaggaacaggaguuccaguauuuuaaggggauuuauuaagccucagggcucuugagcucaacccuagaaugagagggaccuggggaccuggauucgucuucuguguaaguucccacagccaguuuccuaagugcagcuuagugguggagcauuggucacuaggcaaaugaaucacaaguucagauaaauaaaaugccugugucaaauccaccccuagugucuaacgucuauaguguuacacguauguuugccaaaauguggagaaaggugugugggcuguccugcuuugcuuucuacugcugagacgaagaacgccaugaccaaaagcaucuuacagguuagaguccaucacugagggcacucggggcuggaagccagaggcaggagcugaugcagaggccacagaggagggcugcuucaauggcuugccuccugagacuugcugagucugcuuucauauagaauccaggaccaccugcccaggguggcacugccccacaguggacuggucacaucaauucucaaucaagaaaacgcccuacagacugucacaggcuaaaugauggagauaauuucucaccugacguucccucuuuccagaugacucuaacaugugcaagguuaacuaaacaaaugaagcuagcgcauuggccaguauuacuuauugaguacaaaagauccgauacaaccuaaaucuuucaaggaaagauuguuaaaauaaauuauggcuuaauccauggaguagaauauagaucaacuguccaaaagaaggcagugaugaauguacccauaugggaaaaaaaaucagaauccauaguauuaacuuuuaggagggaaagcaugguugugugaaaaagauuuuuacagauaggcugcacacacacaucucuguguguguguguguguguguaugugugugugugugugugugugugugugugugugugugugugugcuuacauacguuuagggcauuucuggucagagaacuauuuuauauugugcuaaccaaauuuuaauugugaucaugugucuuuagcguauugaaaagcaguugaagagagguuguaugagccuguguguuauuguuuuccugugugugcucgggcccuagguccggguguugaucccuuaccaagggccgucuucugacuacguuguagugaagaugaucccagacagcaggcucccgccucggcaucugcacgcgguccacauaggcaaaaccucagcacucaucaaaugggaaucgcccuaugacucuccugaccaggacuuggugagucagugaggcaugcgugcgcgcgcgcgcguguguguguguguguguguguguguguguguguguguguguguguaugugugugcgugcauccgcgagggcuacugugcccauucuuggcuuguuucagggacagggaaagggucugcuacuauaacagguaacagaggcauaguagcucagcucaacaggccuuguccccaugucuguguggucaaagacagaccuucacagggaccccuucugaguuggcccuccuccaucauuuccugccaccauauuucuugguccucucucaccuacccauguccccuucauuagcuggagcucagcauaugaagaccugcaggccaaauccaaccuauggaugauuuuuuuuuaauuaauguuuaauuggaacuaggccacauccaucugccuacguaagaccugugucuguuuuuaugucacuagcaauaggauuauuugugguugaaguccuaagaucuucaacaccuaaaauaccuaccaucuagauuuuuccagagagcuugcuaacccuugcuaaaaauaaaaguucaaggcaccgaucaacaccugcacuguuccuuacucuggacugccgugaccucugugccucacccacuacaguacccaagcagugugguucccucuuggcugcugagucucauauacuuccuagugaucgaguuuccuggccauacuauguccuucccucugcacucccuguaugaggaguggccugggaaagagcagcacuuugugcuuuagugcugggguugaacaucuaucucauccagcgcuuccggcuucccucugacaguguccagaagcuguugacaggaugaagagacagaagccuagcuccugacgccaggauaaauguggcuuucacuacaguauuuugcuuuccucccagcuuuucacucccuccucuuccuuuugcacaauccugcuucucugccucucucuucuuuccuuuuuuucuuaucucccuuucuccuuucuuuuucuuucucauuuuuuucccuuucccuucucaccccucaucuaguugauacuuaugcguacuuguuauaagacagauccuggcugucccaaggggcguuaaguuuuuccaaaaggcauuaaaacuuugagguucagaauagucaaccccaugccugaguuccauauccaacuaaguguuggaaggauaugaacaaaaaaagugucuguauggaacacacacagacauugucucuuauuauuucccgaacaaggugguaaguuagcugucccauggcuguggugguuugaauaagaauggcucccauagggucguauuugaauauucagucaccugggaguggaacuguuugaaaggauuagaagguuuaggggguguggccucguuggaagaagugugucccuacaagugagcuuugaggauucaggagguuuggggaucaggaaguaaagcucucagcuauggccucagcaccaguuguacagccaugcuccccaccauggcgaucaugggcuaaccucugaaacuggaaaugcuuucuuuuauaagaguggccuuggccaugauguugcucuacagcgauacaaccgugacuaaaacaaugguauuuaccucguguuaaguaguguuaacaaucaguagcugauuuaaaguaaaagggccuuacuucuggcugcuacuuagagccucccucugccugucuuuaguucuacgccauugcagugaaagaucugaucaggaagacggacagaagcuacaaagucagaucccgcaacaguacuguggaguacagccuaagcaagcuggaaccuggagggaaauaccacaucauuguccagcugggaaacaugagcaaggauuccagcauaaaaaucaccacagguaagcgcugcuacacgguaagcgaccgcaucgcugcagccugggcauagaggagggucauggcaucuuaagacacgcaagcgcucuccuucucugcccgugcuacagcagacccaggcagggauguagguuuuccugggcugugggacuauggcucagugggcagagaaagacucuguauauaaauauauguauuuauauacaauauaacauauaugauaaauauauaauauaucuuuacaaaagacuucgagaaaacagaaaauaagagaacacauacaucauaaguucaugugugcgugugugcgcaugcaauuugaggacuuaaacucaagagugucuagaguacuaacugggcaagcacucucccacugagcugcauccaaccucugagucuuuuucacacuacccucccuuagugugucuuacgagaggcaugcucaagagaguuaaggaaccugacagcauuucccagcugacagugguccucuuguugaucaggcagcuaggauggaggguaacaaagcuaugggcuagacggucaguuagggucccgucugaugagugagucaugaacucaguugcccccauagcggcaaacaguaucagcgguugucucguggguccaggccuggugauggugugguggacugggaccaaucuccuuguccaccucaggguccuguguccagacauaacucguucuccuuguuccuugcugccucugccugucaucuguuucugucuggccuccauucccaggggcuauaauuuuagauacuguccaagaucucaugguuaaaggacuaauaacagugacagcugaggccacacagagcagcauccauguuuuaucuuuguucucccagcccuuggaugcugggagcgauuuuagccauuuuucuagacgaggagacaaaggaucugguaccugccuacuaacggcaacuugcuuaaucuugcacucucaguuucguuaucagcaccugaugccuuaaaaaucauaacggaaaacgaccacguucuccucuuuuggaaaagccuagcacugaaggaaaagcaguucaaugaaaccaggguaaguuccucacgcggccucggucacucggagcccuggcuaccgucacucugcuuuagagauggguucauggcaggcagcgugaagaaggaaggaaggaaccaggcagagcaggcgugagaauguaaggaccacaugcugaugagugagauguuuauauuaagcucaagaaugccugcgcucagcacucaccagccacacacuuguccucagaagagagcagugagugggggacccuuggugcuuccugaagccggacuguccucagcguuagaaccgagugcgccucccuuucccggcccuuugacagcugggcuaagguuccagcaccaggaaacugagccacacucucaaccuagcaccuaccuugucacggucuccccggaguaauuagaaggaacaagaaguacaagaaguacgugaagauacuuuguuggcuugugggaaaaaacaaaaaacaaaaacacuuuguuuugcuauuggcaggccaguacucuguccaccaugggaaggaaggaguugugagacccaagugauuuacccaggagaguagacucauuauuagugaguccccuugaaagaaaaguaugagcacaguagggcugugagcgcaguaaggcugugaggaucagcuaccaucaccuggaggaacagugugggugaagagcccaaggguuuaaugcaguguaacgugagagccaggcucucacccuggaaguccuccccaucugugagaguccucacagcucccauaucugggauaucuacgugguaaauuuccauaagaguaacaaauccacccagaaauacuccaguauugaaaaguguaaugaacaguaagguauuccggcaaccaugagcaggaaacaaaaaaaacagccccgagcaagccagugacagagacauggagcccuagugugaggggcagcuggggaguacaaguuaguucaaaguucuggaaggcucuuugguccuacuuaucagaaacauugaaacauucacauuccuugaccucguuauucuaagauuuuacucuugagaaaagcaaugcauuaaaaugugauagagucuacuucaugauaagaggaagaaacauaaaugccuaacaggaaguagagauggcuuguauacauuguaucauuuuucauugcuuccuuguaacauauuuuacaaauguuccacacuggauucacaccagauaguaaauacugacgacuagcuuguaagaagagguacaggugugggaugccaggcagguguugggaagcccaucuuggcauccgguugccauuacgggagccuaucugggcagcagaagcccagcuuugaguugacagugcaggucaggguuccaucucuaauggagggugcuggcacaggcauagugagcucaccucuccuccuccuggcuuaacauuagagacagguccauggaguaggaacagagacugacaauguggugggcuccaauggggacagaguuuggcacuggacgguuuggagggcagcagggaaccuggccaccagccugagcccagcuggcaucuggggccuggccugucacuuuccuagcgcaacggucagggauuuccugaggugacaaggggagagauuacuucauccuauccuccuuagaagcauuuaagcagguugaaauguguuugagaaagaucaucagaaaaaagcuuagugcuucuaagcccgcaaccugcuuaagugcuucugugucuuaagugcaucaggcugucuggcucugggaucaggcuagaaagagcuagaaagcaaggagacaagaagugaaugacagcagucuuccaacacucugucguagggaggcgccugccucccuuucugauugcauguucccugggcuugccugcacccacugccaccacggggugucgcuagucagaucccuuacugcacagcaucacugagaugcccaggcucuuugaggcacaggacacagcagcugccgcccgaacuuugagugugugaugguugagauggcucuccagcugccguaccuugcacuuccucuuaugcacguuauaaguaggguaaguccuguuuucugaguuuaauaucacaaucacaucaucgaaagaacuagcaagaaaacugaaguauauuagcauuacauaaaagccugcagaaagguaccgccucuagcuggagcuaguggcagaagccaucaggucccucauucagugugugcuuguuuacagggcuaugagauccacaugucugacagcgcugugaaucucaccgcuuaccucgggaauacuacggacaauuucuuuaaaguguccaaccugaagaugggucauaacuacacuuucacgguccaagcgcggugucucuuugguagccagaucuguggggagcccgccgugcugcuguacgaugaacugagcucaggugagucucccugugaccguccucucuggguccuggucugaggauggagaggcaugggaugguuuuccugauaaucuuucuaaaacacguuucaaguacugccugugugccagagaaagucacuuaggcgucaauuuaguuggguacugauaugcgucuugagcacccgugguacugggaucgcaagguaccccauugagcgguguuuuaguuacuuucuuuacuuguuacugugacaagauaugauacgagaaguaaguugagaguggaaggauuuggcuggcaguuuggggagauagaguccaucacagagaagaaagcauggcagccggagccugaggcagggcccagggcucauuagcuuuuaggaggcagaaguggacaguuggugcuuagcuuagcuccucccuuuuccuccuccauugcauucaaggcccaagcccauggggacagugccacccacauuaaagguggcucuuuccccucacuuacuuccucugaaagacccucgcagaaacacccagaaacaugucucaagucuuucguaggauggaguuaauccagucgggaugacaaggaagacuggcaucagaccagaugagcaggaguuuuguugguggcuuucgucuccgagccuucaggaugcuaacagaccuguaguucuccaugcccucagcucaccccgucuuguacuguuagcacuuccugagaguggauacuuccuuccucugccucccucuggagagucauggcagagucaaggcccugggaaaguccuacagaaaacaaauggcaaaacuccugaugauagacuuucuccuuuuuuaaaaaaaaaaauuuuaauuagguauuuauuucauuuacauuuccaaugcuaucccaaaagucccccacccgcuuccccacccacccacucccacuucuuggcccuggcguuccccuguacugaggcagauaaaguuugcaugaccaaugggccucucuuuccacugauggcugacuaggcuaucuucugauacauaugcagcuagagacacgagcucugggggaguacuggguaguucauauuguuguuccaucuauaggguugcagauccuuuuagcuccuugguuacuuucucuaccuccuccauuuugggcccugugauccauccaauagcugacugugagcauccacuucuguguuugcuaggcuccggcauagucucacaagagacagcuauaucuggguccuuucagcagaaucuugcuaguguaugcaauggugucagcguuuggaggcugauuaugagauggauccccgaauauggcagucucuagaugguccauccuuucgucucagcuccaaacugugucucuguaacuccuuccaugggaguuuuguucccaauucuaagaaggggcaaaguguccacacuuuggucuucguucuucuugaguuucauguguuuagcaaauuguaucuuauaucuuggguauucuaaguuucugggcuaauauccacuuaucagugaguacauauugugugaguucuuuugugauuggguuaccucacucaggaugaugcccuccagguccauccauuugccuaggaauuucauaaauucauucuuuuuaauagcugaguaguacuccauuguguaaauguaccacauuuucuguauuaauuccucuguugaggggcaucuggguucuuuccagcuucuggcuauuauaaauaaggcugcuaagaacauaguggaguauguguccuucuuaccgguuggaacaucuucuggauauaugcccaggagaaguauugugggauccuccgguaguacuauguccaauuuucuaaggaaccgccagacugauuuccagagugguuguacaagcuugcaaucccaccaacaauggaggaauguuccucuuucuccacauccucuccagcaucugcugucaccugaauuuuuuuaucuuagccauucuaacuagugugagguggaaucucaggguuguuuugauuugcauuucccugaugauuaaggauguugaacauuuuuucaggugcuucucagccauucgguauuccucaggugagaauucuuuguuuagcucugagccccauuuuuaaugggguuauuugauuuucuggaguccaccuucuugaguucuuuauauauauuggauauuaguccccuaucugauuuaggauagguaaagauccuuucccaaucuguugguggccuuuuugucuuauugacggugucuuuugccuugcagaagcuuugcaguuucaugaggucccauuugucaauucucgaucuuaaagcacaagccauugcuauucuauucaggaauuuuuccccuguacccauaucuucaaggcuuuucccuacuuucuccucuauaaguuucagugucucugguuuuauguggaguuccuuaauccacucuaacuaaggaagugaaagaucuguaugauaagaacuucaagucucugaagaaagaaauuaaagaagaucucagaagguggaaagaucuccuauguucauggauuggcaggaucaauauaguaaaaauggcuauguugccaaaagcaaccuacagauucaaugcaauccccaucaaaauuccaacucaauucuucaacgaauuagaaagggcaaucggcagauucaucuggaauaauaaaaacccuaggauagcaaaaacucuucucaaggauaaaagaaccucugguggaaucaccaugccugaccuaaagcuguacuacagagcaauugugauaaaaacugcaugguacugguguagugacagacaaguagacuuucuccuuaaucagcccugguucuaaacaaaacuacuuuuuauuagucugugcaauacacauuggaaaaaugaccaugaguuccgugacagcugggccagccacuccuccaagcucuacccggggcggauuccuuuaauuuaccaccuuaccaucugggauaggcuggacaauauuaauauuaauuuccugguuagaaaaggagagaaauuuagagagcauacauacugaauugcuagauuaagcccacaagaaauggcuauucucugguccauuuuaaugggcauucuaucugccagaaucccugccuucucugggaucuccccccaaacaggaaacaaccccaaggucuauagagacuaugcccaaggaaagucugccuccuuugcuaaaacugauuccagaccuccauaucucugccccaaguuuagacuagcuccaagaucuguaaugagcgguguuuacucacucuuaagaccauggcccuuacuacgacagguauggagcugaagaauggggacuggccuuucuucagagccccagugggaaucggaucugucagcgagccaucuaaagccaaagccagcauuuguguaagaccuugagaaggcagcaucguugucggguuauagacagcugagccgcuuaggagugaugucagcuguauacagaaacauuguuucucuuuucguacuuaagagaaagaggggcgggggagaaccauaaaacuucaugagcuguugaggcacugccgcaguagaggaaucucguuuauaucacuuaacggagcuucagguaauugcaauguagagugacuuuggugccaaguaggggaaauaauugcaaucucguuaauuaguggucugauuucacauccucuuauguaaggcaagcaagcggccuuaaguaauaaugcuaaugaaaucagcguugaugccccaacaaaggucucccuuccaagagauuaucuaaauaaccaacaaggcagugauuaggagucuaauguaauuacuguauuugcaugugcaaggcccacggucuacgggcucaugcuaaguacuugggaaacaucagccuucacgcaugugcuggaacaugccacauaggaaaagcaagcugguuuguuggaaugcuuguaaacacugggcuuuuuuuuuuuuuuuuuuucuauuuuggugggugggcggagcauggggaaguugccugguccauccuucucuggguggcccucggguaggaggcucacugagugggauugguugccuccacaggugcagaugcggcagugauccaggcugcccggucuacugauguugcagcuguggugguucccauccuguuccugauccugcugagccugggugucggcuucgccauccucuacacgaagcaccgucgcuuacaaagcagcuucagcgcuuucgccaacagccacuacagcuccaggcugggcucggccaucuucuccucaggggaugaccuagguaaguaagcagggguaccgggggcaaaugagcaccacgaagugaggaagacucaguacauccuuucaggacaggugucucuccagugcucccgcuccugagaucuuugccuuuucuuguuccuuaaucagaacgccacauucucuguaguuguauaguccuggccccaaacagaggagaagcccuucagucagccacaccugucuccuuggcccaaccuacccaggcuucuuacucugugggguuaugcacaguaaggggaagggaaaucguuggcucccuaugagauggccuugcaugcuaccagcccuaaacugacagagcuaggagccaggucauguaauguagaggaugugggaaagacuucccguaacaucaaggcacugggugugaguuuguggguugacuucuccuauagaccaguuguagcugauuuuuuguuuaucaagcaguaugcuuuccacucucgggauccuaugagaucaccuguauccccuuucucggggccagcgagcaccgggagcccugaaugacuaggguggcuccuuuugguggcucuauuaggaugacauuuaauagucacuaaaggcuaagaccaggagucucaaagggacagccaggaagccugggaagcugcccucgggacucuuaaaccacccccgccgcccccagucuccauuugcucagagcgguucagaugcagaagugcagacagagaucacucaaguaagagaaaccaacacacccacuuagcugcaggaggugagagucaccuuucuacagguuuuacucgaaaugacuauuuaguaaauuagugcggucaccuagggauggggagaggguaaccaguaacuugaacauggcuaguuaguguugguuuagcugggguucggcaggcacgggcaggguggaggcaugugggccauuuagaacucuaccggaacucaccaaggccugacuguuuuaucuucaggagaggacgaugaagaugcucccaugauuacuggauucucagacgauguccccauggugauagcgugaagagcuuuucucauuagaaaccaaaugguguaaauauuuuauuugauaaagauaguugaugguuuauuuuaaaagaugcacuuugaguugcaauauguuauuuuuauaugggccaaaacuacaaaaaaaaaaaagaggaaaagaaggaaugaauaaacuuuguaguaucaacugugaacugaaaccagguugauuuuaguaaccacauucuuugauuugacauugaugucaucuuacagggcugcgcuugcugggcaugcuuuuaagucugugagaucauuuugcuucauuaaguugaccauucuuuuuguuuuucuaagacacagaaauguauuuaauaaaaccuucaagagagaguaauggacggagugcauucuccuugaaaacuguucagaguuuacgucucguuuggguucaguuuacauaagugugugggugucuugugggggaagguucugugcucuuguuuuuguuaauuuauuggaacucuguauaaggccauauuuuaguggcugucugaaaccccaugugugaagggccccuugcccaacaggguugagguggggagcaagagcaaucuguuuuuauuugcucguaugucagggacagguguuuggcagaagagacuucuagguuacugcuagauuccaauucaacugccuuguagccugggaagcccagcaagucauaaccuccugucuucuaggaacccgugggcuuuuacugugcaugucucuguacaaaguguaccucuggaagcugccaagugauaacacugcuuucuuauacacugggaucauugucacuugaaaaaaaaaacauuauugugguugugggagaaagcucuagaucugugccauaauagauaugcauugcaauuguaugccaugucuccauuuuaaauuugaguuucccuuucguuuuuacucaccaccaaagaaucucaaauguaaaauuuuauauuggguuugaaccacugacguguccauucugauauaugcagucauuuugaauuuggucugugccuucucuggaucccucccuagccugugccccgagccguccauagagaguuuguagguauuuccagggauggagaagaucuaagcauuugacuuccccaucaguacauuuguucauuugcuuucucugugaaacgccaugauugucuaaacaagucuccccucugcccugaucccuuuguaccaagucaauggccacuugaaaguucuguggacucccuuguggccucaacccguucguccuucagccugucauccuucaggcaccgacgcccaaccugccgugaccugugcuguaugaacaaccucacugaggauuuccucccggcagaaaagcagcaagcucugcaaauaucccaaaguuaugccucugaacacaugucuucuauaugcaaguuuugugaaaccugccuccuucccgugcaaugugucccuccucacaagugcuuaguuucuguuaacuagaaguaucauucuuggguggaaauaggucuccguuuaccugagcugaggguuguuuggaaaauaagagccaauuuuucuuagaauauauauguauauuaaaugagcauuugaccuguagauacauagugugccguuuggccagagcuccuggugucaaaugcugggaacaggagucuucuuacaaauuauuuuucuccucuuuccucucgcccucucuuucacuauuuuccccccagacuggaauuuccucagcuuuaucuugucuugcuuugaaguuuugcucaauguuccucccuuccgaccacuuccacuuaaauaaagucuuuaaguagcugaaggauuaacagucuggugggaggcaagccauugaacugaaccacgaggaaaguauauuuucuucuuuucuuuuccugccaaguuuucgguggcauuuguagaagcuggugugaaaggcuaggaggcauuguuuucuauuauuccucggugaagccuuuucccagagcauaugucuccggcaggcaguguggguucuugccaagcaucagaaccagucuccagggccucccgacgccgauccauaguacuguacagacccaccgccacccuucuccucggaagaugcacugugcuguuugaaaacauguagccguuuaaggcuagaguauuuuauauaaauagaagagcuuagguccugaagaccaaggcagauagaugcagcuauguguacauuguauauuuuugugaacuucucaagcacgcacucccguuucccucugcuuugcagagguuuugauguaucccugccgucugcaagaguccagaggcuggacugacaguaggaaguagaaauaagcuauguguagucuuggaaaguucccaccucacagggaaugaaaccuagggaacaccagguacucggcgcccuguggacuguguggaaacugauuuuucuuuuuucuauacugaauacccuuugagauuugugugggacauggguccauguggguuuagugacagagaagaguuccuccaaggacucuuggagaggggccacaucugaggagacaggugagaagucuccaucacugcuuggugccuggcaagcuggagaggucagccugcugccaggcaacuggcugucuuugggagggguggcucuuaagacucuaccucugauugcaucacuaggacuaacuacaagcuggcuggggauacucccuuguguguucuguccuauccagauggccugcuagauugaauuauacucaccaacacauagaacaggcccuuuagaaggcacuagguguuuggaggugagcuaggaagaccagugguauguugagccccuuacagauaagcaccggugucucuuuggugcaccuugccuucagaugcuccugguggucagcucaacuagcaagacccuaguccccuguuccaaagccaucucauauguuaguucucugucccaugaagagggccguggugaguucccgagaauugucucucuuucagcagagaggugagggacucagacauauaucuaaguugaauagcauccccaucgcagcuguaagaauugagcugcagaagguacccucugucgggauuguaucucgacaucccugucgcguuuuucuuagcuggagugugugcugccuuucagguacaacuuuuauguaauaaaagccagagcauuaagcuuacacagacuacuuucuaugcaagacagagauauggacuagguuacaggaaacgugcaccguuggcuccacagacaagaagugcauugccagaagagcaucacugaacggagcggagggaggaccaguugcauguguuucugcccacucauuuugagcagccauauuauaaaauggaucaucagagcugagugacaacacgagagugguacugguuucaugugcgaggacuuccauggacugaacauggaugccggagcagagcaucaauuccuucauagauuccaagucacuccucgaugaagacucuuguugagacuuacuaaacacuuuaggcgcagucgggaggaucugcagcaaaauaaaggccuguucugcucuuauuuaacaugaagcacuguguacuuguuucuucucuccaaaguaaaauuagauuauuuauaacuucgaucgccucggcuagguuuccaagucacugauuucugcugaagauuuuacuacguuguugcacaauuuuaagauaauuuuuuuuuuuggucuuggugucaaccuuuuucacugaauaaaaauuuaacuggguuaaaaaagaaaaacaaugaaaaaaaauaaagacaccgccaucaccuauuuaaauauccacugugugugucacaaaguuguucuuuugagugcaauaaagauagcuuaacacagucuccagagcag

SEQ ID NO: 5036 - RNA, 26996 nt, Mus musculus
acuuugauagugguuuuuauuaauacuucuaaagaucaccucugcuuuuucaaauugccugcaaacauugaacugaacccacugccguggucuaucugaauugaguucaccacccaacucgauaccuguaauuauaaguaucccuuucguuuuucguuaagggcuucuaugauugucccuuauauaucagauauaacaagauagccuucauccgucugaccugagaauucuugcuguggugguuugaauaagaauggcuccuacaggcucauguauuugaacgcuuagucaucaggaaguggcacuacuugagaagguuuaggagguguggccuuguuggaggaaguauguuucuaggguuggcuuuugagguuucaaaacucaagcaaggccuagugugugucucucuuccuguuuccugucucucucuuccuguuuuccaucucucucuuccuguuuccuguggguccagaaguaaaauuuucaacugcaucugcagcaccaugucuaccugcaugccuccaugcuccccaucgugacaacaauggacuaaacuucugaaacuguuagccagccuucauuaaaugcuuucuuuuguaagagcugccauggucauggugucucuuuacaguaauagaacacugacuaagacgcucgugguacccaggauucggcauaucacagucccuucaccuaucuuggaauugcuauaaucaccuaugcaugaacauucacccuguucaaugggaagcccauucucccugagccagaacucugaaacaacagagaggcugagaagucccauuuuccuuaggucauaccccucagcgguagucugucagccuccagcaacaaagcucaaaggcucugacuuaagcuaaccuugguaauaaugaucaccuccaccagggcucacagcuucaaaagccauagcuguucucuucagaaagcuuugagauuccaguuucuccacaggcuucauagcaauggccuaauugccuuucaggaaaaauaaaaugcccacauuucugagccuccaccccaaggccccuaggccuuugcuguucacuccagcaauguuugggauugcuaguuaccagaucugauauaucuucuccaagcuguuugcuuccagagaaacagcccaagggacgacagccaggguaauggggaaaugaaaccauccuaaagcuuucaaguuuccgaaagaugagcacauuuucuucuauguuguuccccucaccugcuccuuguccucacugccaacacucccucuggcccagauuuguuggcaguccaggcaggagccgacugccuaccaggcauccucauuaaaaugcacuguucuugcuaauuacgagccaagauucucccacggugggccuggucugggcacugccauuaucuucauaaauaggcucuuuacuuugcaaacgcugcugucacagucaggcauucucaaccuggcaagggcucugugcauucuugagugguggagggaaugugucagcaagagaaggcagagguauucaugccaaagcaaggcucuguccugaguucaccccacucagucugggcagcaggcagccaacacaaugguugaauccgagacuccagccauggcgggcagcagcauauggaccagaucuucuggaaaaauuuauuucccaucauuuucaucuuuacagcaaaggcaaccuagucaauguaaaaaaaaaaaaauguuuuugagagcucuguuuuuuuuuuuaaaaagaauguucccacccuacccucccccccaaauucacaaacuggauggcgguguagggguguguuuguguguguguguguguguguguguguguguguguguguguaggggggacagaugagugcuuggucucccaaauaugccauaugcaagcuugucuaugagaauuuguuuauguauuuaacuuccuuugccuacaaagcucuguguacaguuuucuguuuagugcucagccgccuuuuccagugcuagcucugucugaauacagucugcucugaucccuucacauaugccaccccuuuucugcaccaucagggugguucuaugucauuucuuaaguagugccuacuguauaauucuggcuuuguccccauagcacaccugucacauguagcacaccuauggucucuaauccuuaacaauggaccuucaaucucauuuuguaaugagaacacugaagcucagggaugccccucccccauccuucuucuuagccaggagcaaagugaggcuugaaaccuuuagcugguuguucaugguaagccuucgacccuucgacccuauacuagguuacagagugcuggggggagauucugcucuuaggugcucaguagaaaugagucaaagaaccagccccacaccauagccuaauuagcucccuaagacaugcugucaagaagagcuguaugagaagauagcucaaagugucagggcagagaacaugccuuuuugcaaauucacagcucaugaaauuuacuauuaaaagggccacagggccgggaagguuaccggccuucccucuaacauuggugcaauaaugaagcacuccucagacucugaggugcagaggcacuguggcaggauccuguuaaagugcaggggggguguaaugcagggcuggggcuacucugagcagccagacaagaagagacugcugacagaccauguaagagcacgugggauccauagaagcaggaggcugugagggugugaagccagguagggcugggagugagagaaaagagggaaaaugucacugugugucuaucacucguugaccuaugucuccccuuaucucagacccuuugccuggaaaccccuuccaauuucuuugccucggccccacccccaaacuuucauuuguccuugaaaacaacuuagaggucauuucuaguaagcuuugccacucauugagacucagcugaguuucuucucucaccucuggauaaugguuggcucacaucuuagguucugucugccuccacccccacccccaaccaggacugugcaucccuugaggucagagacuacaaauuaaugaagugguacgaaauggguguuuuugaauacgcggagcuuaccacagggacugaaagggaucauguagaggaagccaagcuuuccucuccccaccccuagggcucagaauuaacuugaauaaaauggaugcccaggagaaaggcauacaaauguuauuagcacaagucaggcgugacacagagucuucauaaagaaaagaagacucccaaagaccugggguggaaaucuuacagacggaugggacaaggaggggaaaaaccaacaacauagcaacagacaagaagaggcaucaguagcagcacuagagacagggcaggaagaggggacagggaagaagggauggacugauacccagacugggaaaaugccauuucagauauauccaugaagcacagcaucagaaaacagcaugcauugagguauggaauagauagacaucuagucucucucauacaucugaccuuaugacaggucaaguaaaacggcucggucaaaugucuagagcaucaggcccuaaugggucagccccggcccaaagcaggagagagggagagagggagagagggagagagggagagagggagagagggagagagggagagagggagagagggagagagggagagagggagagagggagaaucaccauuauucaucugauuggcuagaucuaguucacagucccacccagagucaagagguggagaaacaggucuaugccuuggugagagaaggaccacaagccaaaggagagaagacaguuacaaaguguggcuacagggaucagggacugugaaaucaacuucaucaacuuacauugcaagggacuguggcaggcacuagguuccucucaggauagaucugacuggagggcugucauucucaggaggugccugggcugcaaagugugaccacuccucauucuuggcucaccagccaccucaggcagaugucuccccagacaggcuucccagcuguuugcuccagcugugcaacugauguguguccuugcaauucagaccauaccuaaaaauagggugagugaguuaugaccagagagagaaaucuguuaauaaaagauaacuaaacgaauaaaaaauaaguuugaguuuagcuuuguucagacuaccaaguuuucccucagucugucuaaacccuugaguuguucaugaauguaauauuuucuuuuugucuuccuucuuuuaacuuuuauuuucugaaauagggccuugugcagcccaagguaauaacuccugcucccccagucuaucacagaugugagccacugcccccaguuuguauuuuccaucuaaugguuugaauagguuauucauuaaauucagcuuaaaagacuaucuguaaaucuuuccucuuccccagugaguuaguccaucucagaggcaaauguuauuuuaaaucagucuuccaaaaaugaagagaagauuugauauaaacaaauacauaugcuuugucauugacaguauauuuugauuuuacuuuuucaauuaccauuauuucaauaaaacauuuuccaaacuaaagcauaaaaacuguucucauucuaguuuagggcaucaugauuuuccauugugugagugcaugaaagugccuguggucacucccugcuggcagccauggaguguaugucccuucucuuggugauauauauauauauauauauauauauauaaaauuagauccaacgagaucugcaggaagacacuuucagaauccaaguuuggaauugaugaaugguuugauggcagugacugcucuauuugucuucugauuggagucuuugucuuaguuguacuugugaagcacacacacacacacacacacacacacacacacaaaagauagccaauaagacagcucagaaaauaaagggacuugcauccaagaaugauaguccuaguuaaauucccaggucccaugugguggaagaagagaaugggcucuggaguuuuguucucagacuucuacaagagcacugugguaugaaugcacacauacacaaacacacacacacaaaguaaaaaugcaauuaaaaaagagagagagagagagagacaccacagaaaauuucaugagauacuuggcaugugccugguauuugggaacuauauguuuuaaccuguagaggaagccauaugagagagcaggguccugggaggaaacagauggccaagauucaaaauagaagccagucugggaaugcagcccagggcuggaguguguguuuagcaugcacaaggccuucuccacaaacccccagcacccacccugaguuuacaaggcuggugagcaccauuugggcaagccagcucauuguagcgucuccucaugcauggcugcgguuccacacuaggugccucugcucugcucucugcacucuucagauccagaggcugaauucaaggcgcacagaacuagucacuuggaaaaauagugucuuggccaugaucauuggauucauauggaucucaggccaacucagacaagccaaaaugacagucaccacugagaauucagggaggauguuaacuuauccacagucacauuguacacugauuguuucugaaugguagcauauguaccugcugccucagaauuacuaagaaacagguuaggccucgcauaucagacccacagagccaguuugucuggagucuauaauaagcucccuucaggccccgucaugucugggaacucuaccaagacaacagcauaaguaaacaugacugcguucagaaacuaggaagcucagcccuuccagaguuuauauaagggacacaccaaauguucugugcucugguggccugaugcuaagucaugggaggacugagcuuucucucugacuugaaagggcucagcugcugacaggggucccugcauggaugggacucugaagugguaauaauacagagaagcauguaguagggcaauacuagucaggagacugaucuacaucuccuucugccuacuccacaaguccuuccgggugugcaguaaaugaugcagguggaauguuugguuaugacauugggauagguugaagugacaaggaaguuagucugggggaugaggggcagggggacuagaucccagugggcacagaugacuccuaggaggugccucuacaguagcaccagcugcuuucucuggaagguggauggguuuagacuaguggauaagcaguaaggagcuggggggaauauuguuuagauuuaaagucuagagucaauguggagagcucugauuucucauuggggaacaagguauucucauucaagguccuggugauugagcuagaccuggguucuaacuguaaaggaucuguuggcccuggaguugggucaucaaggacugccacucuuaggcuuaauccaaccuuugacaguuuucauauccucuguaauugcacugcagauucaagcucugaacuccaaccaggauuccagagcugugggcuaugacauuuugccauuccaggguguagcucagcaaauccacccuuuuuuagauaccauaggcagcuucucaaggccuuaaccacauccugcacagaguuggcguucaaugaacgccaauguguggugagcccaaggcaguaaggcagcgauuauccugaaaggaaguagugccuagagauagauggccucuccuacugcauagcgacggugauggucuuguguuuuccagaacuuguacuggugcucugagucugcucuagggugucuauacugaguggcauacaguaacccucugugaucuaaaaguaugccauucucaugaaugacaucaaucaaucaaucacagguagagguagaagguggaguaucuuuccuccuugucaucagggucauaauugacacuccaauaaccaaagaugcauuaacgagaaaguguaagauguugacuaauguuuuaugugacaugggagauuucaaaagugaagauuccgacuggggauggagcucaguggauagaguacuugccuaguauuuuagcuuacuuagacuuccgacuucacagcuacagucaucugagagagaaacugccuacaugagacuaaccugugggcaugucuacggaggaguaucuuggcuguucacgguuguaagagggcccugcuguggguagaacuaguuccugguuaauugguccugagcuguauaagaccgcuagcuagcacagguuuuuaaguuagccagcaagcaguauuugcucaugguucaugcucugcuuccucaucggcgaaugagcuccagaggcaaggcucugugggauagcaagcuugccuugaauuccugcuuucuuucuuucuuuuuuucuuucuuuuuuuuuuuuucacucagugauggacucugaacuacaagcuaaaauaaacucuuuccucccugaaguugcuuuuggucaaguuauuugucacagcaacaaaaugaaacuagaacacuuagcaggcaaaagacccuggauuugaucgccaaaacuacauaaucaggugugguggugcagaucugaaaucccaacacuaggaagagaagcaggagaagcagauguucaaggucauuuacagcuccuuagcaagucugaagcuuaucugggaggugugagacucaaaacaaguaaagacccagagaaaugccaacuucauauauauuuacauacauauauacuuuaaaaaauuuuuuugagaaccucauacaugcacacaugcucuuuaauuccuccaagaucuaccccucaccuccacauucuuccaacuuucucuuucucucucucucucucucuuuuucucucccucucucucuuucucucucuccccaauaauuaauuaauuccaauuugugcugcccacguagucaugugcguguggucauccauuagaguauagucuaccuacuaggguauauacauuacaauaaaugaaaacaauccucaauuuuuaugcuuagguuugauaaagaauaagcagucaugucaaaaugccauuguguggaaaagguauggauuaugcuacaguuccuagacuguaggaaggggagcccagcagggcaugccuguccaguucuuucuguuuccuuugcagcauucucaaaagcucuggcuaagaaaggacucuuucuaaaaucaagguuucauagucuauaagaaagguaaaaccacuucuuuaugaucaucucuugcccagaaggugaagggaagauuagaauuauauuucuagguuuggggcuuugggaaagaguguguguggggggguccaguuucuacagucuuguuguggauagccugaggcuaauuauaucugauguuaauuccguucuccugugaguggcugugaacaaguaaugagucaguacucaggugauuuccuguaaaacugcuccccaccuuaaucuguaaaauagaggagagcugaugauugggcauauaaaagagaagguggaguggaaggugaggagagagaagaaggagaaaauggaagagggagaggacacagaggaggaggaagaagaaaagaggagcagaagcacauggccuggaaaaacugcaaguucuaaggggucucauagaugaaguagaugguaguguagcggcagaucuccccaaucuaggcacacagcauguauucauauuaauugaguuguguuuucauugcugggacauauuuggguuggagauuuacugcaacacagucucuguggccuacuggaaggaagagguguucuagagaggaugguugccuuguggaggaaaagggagcaggaggaagaucagaaagaagcugauuugaggccuuucuuacaccugcaguucaaagcauucagcaugacaaaggacuguccuuuagggagccacauuucucugagcuacagaaccguguccucauaaaguaaugacuuuuagaugauugcuugagugagauuuccucucacacgaauccucuugaaguauccacccauggugaccccaagcuccaaagcccagcuccauccuagggcuucuuuaguuugcauugaggaggaagugaggugcccaagcagggucuggaaggccagggacaagcuguugcaugagugagaacuuggaaugaucaggauauauggagaagaaggaaggagagaagauaaaggcaggccagagggaacugacaccuacauauagggagaggaaaagagggacacacggugacuguuucugccaggguggaaggaagaggagaaaacggcagugguagaggauggggacagggagaggguuagggagagagagaaggagggagagagagagacagagacacagagagagacagagacacagaaagaguuuggacacuguaauugaacgucuuguacuugugaucacccugcggucacuuccuuagugccaggaucaccgugcuauaaaguaaaccagaacuauauaaacuuaguucuagggaucaaacccagagccuccugucugcuaggccagcauccuaccaagcaauuuacaugcucugcucaaaagggagauuuuuuuuuuaaggaaguuuucccugaauuuaauaaucuucucugucucuguucuaaaccauaggacuacccucuaccuuccaccauggcuacagggaugggccugugcuuuccccaugagaacuggagaauuccucugacagaagaucucuagauaaacacaggagaagcaaagaccagccuaagaguauguaagacuucacaaaggacacaaaaaaggaaaaguuuauuucuuacgggaagucaaacaugcuucguuucuucgcucuuaaaagauaaauagaggaguuggcucagagaauugagggcucgaaugcaagcaugaagacuggaguuugaauacccacaauccauguaaacgcuaguuggguucagcagcaagccagcauucgaagguggaaggacacaauaaaucccaggagcgaagggcuaguuagacuagccaguucagcaaacucuggguucuagugagccuggaugaauauuguggaaguguaauuggggaagauuccugaugucaaccuuggggcuccacuuuuacaggcaagugaaaucaaagacagaggucgugugcucugcauuaggcaucacuaccuauugagaaagcaucugggaagccuccuggagcuuggagggcaacauaagauaccuguccuuagagcuauagcucuagaaaacaaggguguagccugguaugagugacuguccucugugccaaccaacugccaucugagggaguuuagcuauguccccuuucaagacgaugauccgaacugggucuguuaacuugcuuagaccccuucaugggaggugcgguagaucacgagccccucuccugaauagccaucuacgcccuaucaccugcuaagcaacucugcuuuaauugcagguguccucaaggaaggacuagaguauauaggcaggggaagacuagggagaggcuccucuauguggcuaguaccaugcugggugcaggcuuuccagauauugucaguugggaaggaggagcacccacacggcuguaagaaaccucuuacugaugcucuauaaggaagcucaauaaacuccauuguuccucuggguaaauguaggccaaacuaccugaguuuguaguugggaccuuacugcgaagggguagacauugcuuacgucuuucccugggaagacacuuaggaacauggucucucauacauaccucagacuuaacugcaauuuacagaaagccccuaaugguuccucuuucaugaagcuugucaaaaaugcauagugaguugccaagaccaggguguucuucaucaaggacuccggagaagauaacacuuaauuugcucuucugucagccuugugaugcggaugaauuccaggaagcgauguaugcuuuuuuuuuuuuuuuuuuuuuuuuuuuguaaagucagcaagccauuguugagcagaauuucugcagauauugucagagggaacauaaucugggucaaugaaucauaaauucuauuuugguaguuugccgaagacaacauugaagacagagcuguccugaaggggaaaacuugaaaaagacacgaaacgaggcagcaaugcagcaggggaggagagaaggagauucugcccaacagauuguaggcuucccuuccacuguuugccuaggcaucaagcagguuggucuuucucuuucucucugggucccggggggggggggggacagcauagcauugaauacaacagacggcacaaucacacgcaaacaggaacaggacacgggcaaaaguucccuggggucuucaaaugacugccacugcucaguuuaucaaccuguaaagaaucacuuuguccccgagaacaauuccacagacauuaaauggcagcagcuuggcaugacucccauuguccuuguuuguauagguuacagaaaacagcaagguuauacgugaacuuaucucucuuucugguuaaugacauucgggugcugcuauuguuggugggggcugggaggggaagaaagugaggauguguucauuagaugcaggcuucucccccuauaacuuuaucugacuuuauaaauaaaaaaacacggaagauaaacagcgaugaacaagcuauuccucauacagcaaugacgucugagcucuugaaaugaaaugucccucuggguagcucaccacgaccccggagguagagaaauuaccuagggguuuacucacaaccgagguccacaguuuugccacugauccucagggcuucccacaagugagaacaacucuccuuuguuucugauaaggacaccaagaaaaaugaagcuuaguagcaacaggggcgauuuggaagagauacagaaaagagucacugugcucauagugugggacccaggaaugaguuacaaugaaugaguggcagaaaagacaggagaaucaaucacagacacccacccugaagugggccauuucaguacucauccuucuggcuaauucaggguucugcugguccccucaugaggucugucagccaugacugcugaggcagaugguguuugccuccacuggagagugucugcucucgugagacuccaguccacagggauucucugguuggaguugggaaaugagagauaaaugaccucuuucaaaaugagcaauuaucauuucucauggagggaaaagggcuuuuuuccuucaucgggauaggacagcaaaacaucuuguaaagguuaggaggaggucuucacagcagacccacaaggguauccuaaagcuggguccuuggaccucuuugccugcuagaauuaccagggauauugaaccccauaguccaauuaaucaguuugaauaaugcuggcaguuuuuaaacggauuccuaagugauuuauaugaaauaaauguaugaagcaggcuguggauuaggucacaaaugucccuuaaaacuaaagacuuggucccucagguaguaccaacugagagacaguaggaucuuuagggacuuaggucuagcagaaaguguuggcaucgggaaccagcuuuaugguugccagucacuuacaaauccagcaaugacgucaccccuaggccagcccuuaccugcgagcccccugaccuucguucucucuuuccuucuucuuucucgccccccuucauucuuuucucccccaguaaacuucucccguggaacugugcuggccuggugugaucugucugaugagccgccauucuaccucaacagaaagccuuuaggcugcugugaaacccgggccccucuucacuuuguuugcucccuggcucaugaugacauaagagauuuuguucuaccacgcccucucuugccagacauucccuccuuucuucacauacucccuugucaagggcucaaaaaugaugaagccaccccacuaaggcauuaaaaacuccaaaaacauaagccaaaauaaaucuuuucccuuccuaagcugauuguccugaauacuugcaauaguaacgugaaguugacugucuuagucauuguccuauuccugugaagagauaccaugaucacagcaacucuuauaaaggacauuuaauugggguggcuaacaguuaagagguuuggcccaucgucaucaugccaggaaguaucccagcaugccugcagaugugugcugaaguagaagcugagaguucuacaucuggauaggcaggcagcaagaaguuaagugcuuugagcuucugagaccccaaaacugagccccuaguaacacauucccuccgacaaagccacaccuccuccgacaaggccagaccuccucuaacaaggccacaccucuuccaacaaggccacaccuccuccgacaaggccacaccuccuccgacaaggccacaccuccuccgacaaggccacaccuccuccgacaaggccacaccuccuaauagggccacucccuuuuggccuaugggggccauuauuuauucaaaccaccacacuaacuuucaugggaguacacugguugggcuaagcucuguaggaggcccaacagauugaaucaagcaggcgcuacacuggagcugaaaugcaggcugcugaagcgaaaccaguuuguuuaucugaccuucugacuaaucagguggggcugggcugauauucaaauacccaaauaagcaagugaagggcuaauaagcaggccuccucugcuucauucuuacaaagaagagcccagcccgauguccgccaaucagcuuucccguucuaucccagcuccuaaaugcuuccuuauuaacccucggccuuucuguuguccgaagggcgcacacagccaauuuugcagcauagaggauuccuuaagucacaaaucacagauaaaagacaacuagaucuauaacuaaauuugcugucauuuugucuuuugaccuucaagagggcacucgggaacugagggcacagccguggaagcaggacccaugggggaaugcgguuugcagcucucucaccagaaagcuuaguuagcuuucuuauccagcccaggaccuaauggcucgggaaacuggcccgcccaccaugggcugggcccuccuaaauuaauaaagaaaaccagggcaaccuuucacggagaucaacuugauaaaggaauucaucacuugaaauucugcuucaaguggcucuaggaugugccaaguuaaugggucaaggcuaacuaggacagauggaaagacugagcugaggggcauccaaaggugcucauucugucuuuaccagaaugauuacacuggguaucaaggaaguaugguggggguggagauguccagagcaccagagcaccggcuggaacucacagguuucuuucaaagucaaagaugccuauuggcuggucuuccuggccccagcucuugguagagaaaggcuucccaaggcugccuaaccuuuaacuguuauugguucacuucuccuccgcccccuuggcgggaugccaaggacuuuuuuuuuuuucuuccuccaggaguucuccagaugaucuagcugccaagcagguuuggcaacuauggcacaucaggccaagauaauuaaagggggucaugcaaaggucuccaccugagccugcucacucacucugccuuccaccucccggguguccccaagccagugauuccaugagcagacuuuuuguguggcuucccgagaauccucauuuaaaagguucccagcugugaacucacggagucuucacacuuaaacuuaagcccaauaagcauacagaguugagggagaagagggcaagggaugaccaggggacagggauugagguggaaaccguggacuagguagcaucugagggaccuuuuagcagugugacaggcagaggaguccaccaggugauaggagaaaggcccggaaugaaagaagcaaaaauuccaaggacaaaauaccauuauagcuaggcacagcccuuaaacugauguccagaaaugcccuccagaaugacagacgucuugccaaauauuucaccaccaaucugauuucccuagcagaaccacacaauggucccuugauuccugucuuauagaggaaggacuccuauuaccuuguucaaugaggcagacaggugguacaguauccccaaguccuacugagcagaggugagcagggcaggagguuauaaagaugguccagugcuuagagcguuuaacauaagagugagaaugagagucuggauccuagacccugcauaaaccugcuggguguauuggcccguuugaguccacauccccaaagccagagauaggauuuccaaccuagguagcuagacuaaucugguuucacuggagagauucuaucucaguaaauaagguagagaauuaucaagaaagaaccccagugcuaaccuugggccucuacgugcacacauauauaccauccacaaacaugugagcacauguauaauguaugcacacacagagccacaugcauacaucauacacacauacaaaugccaaaaaaaaaaaaaaggagaaagaaaacgaaaaacuucaaucauguuuggaaggagcucuggcuggucaugcugguuggugauagacucuccugucaucuuuaguaccuaauuuuuccagacucauccaacagcaagcagguucaacccuccuaugucucaguacaugguggaggcgagaauugccccugaugcacugcccucuccuaagucuggcagcuaacuaccucuugcaauccuagcucugaggcugcagacagcaagaacaaguggagggcgcauagaacacgcucaauggaugcuuucuacacugaacugagaguuaccagugggccagccuuggcugucugcugacagucgcuguccuagcauucuucucugaggcuuuggugccuggauuagcuggggcuaugucugugcugcuggagccugggaaggcagcaauauucaagacucucccacaggaaagaauaccccugagcaucuuuaugucuguuacucaacgucuucucuggacaugguggagaaucuugacgcuaaaaccuucuguauuuccugccucaucagaaagaacuuugugggucauugguuuccaugguucuauuucacagaaauggaacuuaccaucuaauuuguuuuuucuccaagaaaggaaggucugggguuucaaauaaucaguuuccugugagguucuuggaucuaacuugugucuaagaaaaucugggcaaaggcuguguuaggcccaucagucugcuccaugcuaccacuucaauaaaggaccagaggaaauuccagcugcucuuaccagcuuuugccagguuccagcaugaagacucacccuguaacuugugggcuucuguaggcauuaggauacucucagcacacugcuucccacacaccgcacccccugcaccccccccccccagcccgccaucccuuccugagagauggugcucagcagggggagugaagccacucagauucucagucugacuccuacaacagccucccuuccuacaacagccuccccuccuauaacagccucucuuccuacacagccucccuuccuacaacagccuccccuccuacaacagccucccccuccuauaacagccucccccuccuauaacagucuccccuccuacaacagccuccccuccuacaacagccucccccuccuauaacagccucccccuccuauaacagucuccccuccuacaacagccuccccuccuacaacagccucccccuccuauaacagccucccccuccuauaacagucuccccuccuacaacagccuccccuccuacaacagccucccccuccuauaacagccucccccuccuacaacagccuaccccuccuacaacagccuaccccuccuacaacagucuccccuccuacaacagccucccccuccuauaacagccucucuuccuaaaacagccucccuuccuacaacagccuccccuccuacaacagucuccccccuacaacagccuaccccuccuauaacagccuaccccuccuacaacagccuacccuccuacaacagccucccccuccuauaacagccuacccuccuacaacagccucucccuccuaaaacggccucccccuccuacaauggccucccccuccuacaauggccucccccuccuacaacggccucccccuccuacaacagccuccccuccuacaacagccucucuuccuacaacagccucccuuuauacaacagccuccccuccuacaacagccucccccuccuacaacagccucccccuccuacaacagccuacccuccuacaacagccuacccuccuacaacagccuacccuccuacaacagccuacccuccuacaacagccuacccuccuacaacagccuacccccuacaacagccuacccuccuacaacagccucccccuccuauaacagccuacccuccuacaacagccucucccuccuaaaacggccucccccuccuacaauggccucccccuccuacaauggccucccccuccuacaacggccucccccuccuacaacagccuccccuccuacaacagccucucuuccuacaacagccucccccuccuacaacagccucccuuccuacaacagccucccccuccuacaacagccucucuuccuacaacagccucccuuccuacaacagccucccccuccuacaacggccuccccuccuacaacagccuccccuccuacaacagcuucucuuccuacaacagccuccccuccuacaacagccucccccucugugauucuccagccuaggaacccacguuccaggcgaacacauacugacccuucuacagucacagcugaaauccacacccuccuagccuccuuuuuucauguuuaacuuuuagauacacauaaaaagaaaaagaaaagaaaaaaacaacucaauuuacuucuguuagaacuccagcacuuaucaaucuuucugaaugaaguauauuauccuuacuuuaaggacagagaaggcaguccuucaacauuacuguuauuuuuuaaagauguauuuuauuuauuuuuauuuuauguauacaacuguuuuauagucaugcauguguguauacugcaugcaugcuuagugucuauagcagacaggagggcacuggucucccuggaaucagaguuaaggaugguuguaagcugccauguauguacuggcaacuagacucagggccucuguaaugaggagccaucucuccagccccaaacuuccuguucuuaacuaucauguuacucuguauuucuuaaggacaaucucugcaguauggcagaaauaaaaaggacuugagauuaggaauacccugccuugacugguguaacuuacgugaaugugagcgggucauguugcuucccucagccucaguucugcuaacucuaagaagggugauuucuaccacaggggaaugagugaguagacgucuccuugacucaugagucacagacacuuggcccuaaguaacuugucucuaucuuuuuauucugcaccuucccuaugccucuccacaccccaaaggacucucagucuucaaaagucaugauuucaaguucccaagagcuuccgcagggcagcuggggcuucgggacaucugccaaagugcccaugcuggucugcauccccuaagaagaagggccaacaugugucaggacuucaugaaggaaacugcaggaaggacagcaugcuggucagacucggacaugagucugaccagaggaaggaaguuggagaacaugguagagaucuaugggagcugcagaaagcuugcaaaggccgucggggaguccuugagcuaacauugccagaggacugccugcaucucccaggagaagaucucucuuauuauccacgcucugcuuaauguuagcuggaagcagcucaugggaggcacugacgggcuuuagaaaaaaccaguuacagcauugcucagccaugcucgcaguccccaccauagucgagcaaagaggugacauaagaaaugaaagauaugauauaucucuuaauuccacagcucauagccaguaaaccuucuuaauaucaaacagugugacuucuuuggcuuuauguuugagcaaaccuaucucuagucuuagugacaugguaauguaaaggugauucggugguaggauuauggcucagcuggcuucacccuuucugggaaugaagagauggggauaugauuucaucagaucuaguccaaucugguuuggucugguccauucugaucuggccuuaaguucuggacagugacuuugauucuccucuuaccugagacaacuguguccuucccucugaggagcuggagaaauggcuuagguucuggucucacaugggguucugcaucugccucucuaagggacugguuaccaccgccauaucuguugucuguaugguuaucagccaguccccaccuagcagagcugcaccagcgagccaucaaggagagagacuugucaugaugcagccucucagaccuguugaauuggcauccaugaaaguaggacccauucugcacuuucagaaauaucuucaaauaauuguuaugaucaaccaagcauggaagccaaaacuuuugcuaagaaaccacauagcugagagaaaagaacuuaccauuguccauggaucccaaacaauauucuguaccuacccugugaacugccuauaucuugguaacuauuccucguguaccucucccucuaucccaugugccuuucucaccucagauuuacuuguacgcaauauuucccugaacauaguuaaggguuugcaugggucuucugcacaggccuugguguccucagaaagauccaaucuguauauaucucuuguaugcuuucuggggaauuucccuaaaggucuauguucccugaagguuugucaaucucccuuaacagaugaacaagagauugguugauaugacaguagaauguaaaacccaaacaggagaacacaguagaauaucacacacacacacacacacacacacacaagcaugaaagcaugaaugcaaauacacauuuacgaagcacaaucagcaaccucugcaaggugccacccugugcuuacacuucggugacuugugugugacaaccgaauccagccuucugagagcuguucuuugugucagaugccuaacugugcccacugagagugcuucccaugggaggguguggccaacuguccaaguuccuggcaauggcaucuggaaaaucuucaucaaggaucauggaacaaagaagaagggcuucuuguucuuggcuauggcugcugcuaauguaucgaggcugcucggagccaauacuaauuugcucuugcaaauaaaggaaauagugauauuaaaaauuuacugccaggccugccugguacaaagugcuuuucaugaaucaucuaacuuaauccucccaacagcuguaggaggaagacauuuaauggacaaagaaauccaagguuagagagaugauggccuugcuaaaccugaaagcucugcauggaagaguuuauacuuaagcaucaagacuaggcggcuucaggcucuuccuggucucccucuuuacuucugagaugcugguuuaaucuggauaaacccacuccccaugaaguucuccagaccugucuccuugccugaacuauuuuauuugcuggcucuuugcccuggucuccccuaacuuuguacaaaguccuucaagaccaccagagucaucaaauaauauauaauuauuguucaucuuaaaaccaacucucccgcucaucuccuuggaguccuccccugacuccggcacucucgacacucucuucuucugauuaagcauagagguucucucuauuccuugagcaugucagguggguuuaaacacagguuuuuaucuuaugccgauccuuaguugcucucaacuguaacgauaaagagcaccagugcccacacaaagacugauuugcaggacugucgcuccuaaagccgaagucaggacugggucaugaacugaacuguguaggacaauguaaaugcugugccaagaggaaucaauagcugucaacagacauagagaacaacaguaugcguccggacagguuuagauggcuuguuagugucaucaagauguggauauucggucuugugcugccuuugacaugugauaauucagucacuuagacagguagucagugucuaguggaugucuugugucugccuugggggacagcaucauggagcagaggcacagaguccuggucuucagagagccaagaauccauggauauagacagcaucugugcgacccuuccuucuagauaauguugcuagaugauaaaaagcacaaagagggauuguucuaaguguucuggauaucugaggaugagcuuucauccagaauuucugguuauuucugcccagcacucucuccagguugagacagcgcaguaacaagauggagagaggagugugaggaaagggaugaacagauagauagaaaguagagccugcuuauccuagacacguucaauggugauuguugcuauagaccccuuauauuacaugcaucaacuuuugcuuuuagucauucauacauucaguuauucaauuaucaaacauuuuuuccugugucuauuaucuggccagcguugugcuaagugcuacaagcuccaugucaguuaagacaugcaucuaaauccccgccauggaaauaagcaauugcagagacugaauuacagggcagagcagagugggaaacaaaagagggauuggcuggcuuugccagaagauguaacgugucuugacugguugugaaacauagguauggcuuccaaggcagacaagaaggaagcacagggaagaguagagcgaacgaccaggcaagauaaaaugaguauugguaugacacugaagugcuuugguguagaguggugauguuuugcuguggccauuaaaacuaauaauagggaaacuguaaucagauuauaugagauugggacagaauccuggccaucuacugacucacugaugguucuuagacaaagaaugaguaacuauauuugcauuguuaagcugugaucuauucucugcgguucacuccuugagugucaaggagaucugacugaaggaaguaagagaaaggcaacaagaaaacuguauuccauaaaauagcagagggaaaguccagcauggugcacucggcuuuaaucacaguacucuggaggcagaggcaggagcaucucugugaguuccagaccagccuaggcuacauagucagaccuugucucaagaaagaaagagagaaaggaagagagaaaggaggaaagagagagggagggagggaggaagggagagggagggagggagagagggagggagaaagaaagagagaaagagagaaaggaggagagaaagaaagaagaaagaaagaaagaaagaaagaaagaaagaaagaaagaaagaaagaaagaaaggaaggaaggaaggaaggaaggaggaaggaaggaaggaaggaaggaaggaaggaagggagaaagagagggagggagauugugugagaaaggaagaaaggaagaaagaaggaaggaagaaagaaagaaagaaagaaagaaagaaagaaagaaagaaagaaagaaagaaagaaagaaagaaagaaagaaaggaaggaaggaaggaaggaagggagaaaggaaggaaggaaggaagaaaagaaagagagaaagagaggaaagaaagggaggaaagaaagggaggaaagaaagggaggaaaggagggagggagggccaaaaggcagagguaguggggggggaaagagagguagcugggaaaggaggggauguggagacggggagaaaaagacagaggaagcuagggacacuugaggcacaucuggcucuucauggaaaauacuguccugaacacagagaguuuugcacaggacuuacacacccuccugcaggauucugauaaccuccugaccacccuuagucccuagaauaaaguagauaccauggaagucaguguucugcuauagugcagaggagggcuggcacgugcuacguauaguuacacagacagucaggaagauaugcacugaaauaauguuagcaaagaucuucucuguguuaugaaauuuuguguaugugugugugggugugugugaccuuugguuuguuuucuuuauucuugcuuccuaaucuuuuuuugaugaauaucuauuacuuauaugaugauagaaauacuaaaaauaaagauagcagaaacucaaauuaucuccccauccuaugcccuuugcagcagucaacacaggccugagggaaaugaacaaaccugagcgguuucccuggucucucggucucgcccuuggucauucuguugugugcagcuugucuaacaggauggaauccaaaagugucugcaucucaaagagacuguucuuuaagucugccccuguaagagauaccaaaguaugacuccccaaaguucaacugaaagagaccaaugaguucaguugagcuuucuuacaaagcguaugugagggauuacgugcaggaguagguguagaacuugagaauucuacuggugcagaaguugagaaacaugacaguuuuuuuuaugcaugcauguuugcaugugaguccccaugcucauguguacauauguguucggagucuaguguuugacacuaaguaucuucuucacucuccauuuuauuuauuggagcaggaucccuccuugaaccucacaaacuuggucagcuaccuagccagcuuuccccaggauacucugccuuccccuccuaagaaccgggauugcagguaggcugcuaugcccaguucaggggauccaaacugugcuguuuaaaccugcaagguaagcacuuuauucaaugagcuuucucccuaggcccuuaagaaaaauguuugcuggcuauguguuguaugguaccuuuucccaaggaccauaaugcuaucuugggcuuugccccugguagcuaugaaaacagaucaauauaacacuagccaggucugugguaauggccauggagcuauagacgcuugcuaugugguggaagggaggguuugggaccaucaccggagagcccuccuucuccagcugcuacugagccugggagaugcuaacauauauauauacauacacacacacauauauacauauauauauauacacacacauaugguuaacugcaauggauuggaacucggugguccugaagguguucuggugucaccaugcuccuguaaccccucacauggcucuauaagaaagcucauuggucucacucaguuggccuuggguaagucacacuuugauuuauugcucacauccaucuauggugacuggacauucauugugccuucccaggaaaacguaacacaaaaccacacuggcuaacugggauuuuuuuauauuguguuaucugcaaacaacucgcauuagagcagauucuucuacucaaaugacgcaaggcuuuuuuccacuuguuuuucuuucuaauuuggacagaucucugcuguauucccuguccacccccuuaacccccacugcaggaucauaaaccccagcccaaacuugaguccuugagguuuuuggagucugucacauuggaagugugagauacagccaucuggcaggcuacaaggcaagagguuuugaaauauuuauguuugugaagcaugagccaugauuuuuaacuguguguuagaagcugagcaggcacacacuuggggccuaggcaaugcagccagcagcucucagcugacuucucccuguaggaggaagcaggcaugaagccugcuccauaaagaaagagaacacagaguggcucucuuuccccuugcuuggccuucggugugcuuucuaaaggaguauugguugagagagaaugagcugaugcugagauuaauaacugaggaugcucucggaggcccuauaagcuuuaaaaaugcuuuacagagcugggcacugaagaguagacgagaagagcccaucuuaaucagcagugugaguuuaaauuuggggcucucuggcaaaguaucugcaagggccauuagcuuucauuaauuauaccauaaacagaauucuaguggaaagagccacugguuacaggaggcaggauugggaagguggcucaggggucuucgggugacaguggcacccuggaucugaguacacagcuuuccucugaguacagaacagccacacggaccagcugcauuuccagggauggagaaggacccacaguccacaucccaggagaucaucaucugcgauuucaucaacucuguugucaagcacaagggaaagaauaaagacccguuucuguucuuucuuuuucucuuuuacaauuucagcugaacugguggguaucugcucacucuuguggaugguggucucgggacacuuucagguuauuuuuaaaaaggugggcacucacugaaaaugagcagucugcuuuuguauuaauuuugaagaccaucugugauugauuuacuagaaugcuaauaauauuuugcuuuccuauauuuuccuucaagagccuccuaaaugucuucccuagccuuaugcaauauguauauguauguauauauguauguauauguuuauguguauauguguguauguauguauauauguguauauguguguauaugcauguguguuuauguguguauguauauacauauguguguauguuuauguguauauaugugucuguauagguguguauaugugcaugugcaucuauauguauauauggcuauauuuggauauguaacuguauaugcauauguauguguguauguguauauauguuuauguguauauguguauauacauguauauguggcuauauguuuauauguaacuguauguguauguguguguauauguuuaugugcauauaugugcauauguauauauaugucuccauagcuugucuguagaggucauugucacaggugguacaugaugauaggacuucaugguggcuccaguuacagggagccaaccuuagaagcaaauguucuucuuaaaccuaguguugaugugagggguaucuucuucuaaacacgacugugcgucagcuuuggggauuuguguucugggguacccucucuaccucagaaaguagagucagagaagaaaugaaugacugggcuucagggaagccauuaggcagcuaccggugaguguggagccagacacugugcugaggucucauuuucuccaugucagugacuguugcacugcugugacugugauacuggacagaaacugcccaaggaaggcaagguuugcuugagcucaggauuccugagaguuuuagcgccccacaguggggaagccaaggaagaaacgcucagucugugucggugggagcaugugguggggcucuccacauccgggaggauuagaaggcagaacucaugguagaacaagccaggccuaaccuucaaaggcccacuccaagugacucacuuccugaaguuuggcuccacccucuaagguuccacagucuuccacaauaguucugcugcuuagagaagugggccuggggaagacauugcacaugcgaaucauagcauacuacauagcaguucuguggggaggugagcauuagagcccaucacagauaagaaagcuauggguuagaaagguaaacaaccucucguuaguaugaggccaggaucugaaugcagaucauuuuauauaauaaauugaaugcuuauacuagguacuguaguuucuagaaagacauaguuaggaagcauuuggaaauuaaucuaccccuggaagcaaucaucuuuugagucagaagaaccauuuccugucucuaacccaccuucagcuccagucauagggcccaguuaggggcucuucuugacacauuuucagugagcacugaggcugagagguuuuguu

SEQ ID NO: 5037 - RNA, 12719 nt, Mus musculus
gcacaugggcggggcucugcugagcgggcggugucucgggcgcucuggcucguacucuccgcuggcuguaaagccgcggcugacggagcugcugggccuggcagguagguuccgugcgcuggcagcuggacagccgcgagugggaggacccgcgggcggucgcgaggauccccgggugcccggcgccgguacggcauccgccgcacccguguggccgucccugcuaaagcgcagguggcaugggggggugggggugggggugggggucuggccuggcggacaccuugguccccggggccugcgauggggauaagguuauaugggagcggggaaggacccuggcccgguaaagcugggucccugccagugcuagagguugccugccuacugugaaccccacauccagggugaggugggaaaagcuggugauuugcuuugccaccggcacuuccuggagaagguaccagguugcgaaccagcguccgauugaggccuagggaggguggugggccgucacucccugccuuucugaagaccauacgcuguagcgugcacacuuuaagcaucguuaagaagucacucauacuggcaucccuucuuauugccgaguaaauugggaggugguacaaguggaaacaauaucucggcggcagcgaaguuauuugacuauuuuguguuaguugaguuugcauuuucauuaguuguguuaaagugcuuaccuucugacccuuacugucuuacggacuuuugcauucauccuguaauauaaugaacguggagaacucagaauuccccaucuguauuugugacucuagggaaguaaugcuguguagaacuuuuuguguaggcuuuacacaucgacugcuccuuacagaacaaagcuguuuaaggcauugcgccuucacuguccuguuuauuaagauuauacgcggacacacguuauagacuugugagaauuagaugggagaaucucuccaucacuccuccagauguguaaaggccggaugagagguacugcagagcauccaagagcuuuggagacugaagcaggagaaugcaaguuccaggccacauagccaaaggggggagggguggagugcuuaaaauaauauguaguauuuuuuaaauauauaaauggcuaguuauuguuccuguacuuuuuucaguuaagaaaaauauaauaguuuuaagucauuuaaguauaauaguggauuuauauauguuuacuuauuuaucugaugcugggauaggaaccaaggcuuuggacauacuacaccaaaggaauaucccugaauuauaccccaggcccauuuaauugauaaccauguuuuaaagucaaaaauuguggguuuuuuuucugccaaagcaguauacuauuuaacguaaacuuacauuucaagcaauaaugccuaauuaucuuagaguccaugagcugucuuugacuuuaagggguugcaccuuuacaauuuacauacaauuugguauggccauguggguguuucucacugucuagcacuugaugcugguugaauugcuuuuuuugaauugugaguggcauauaugauggggaaaugagcaccugacauuuaauguaauuuaaguuuuucaggaugagagaaaacauguguggcucauuccauaagcaacaggcuaaguuccuuagcaaacaccucccagcuguggccgaugcugcaaaccucugguuucggcuguuugggaagcuguagagggaguguggccugaguaaugagcuucagggagaagggcagggguaggaaagguuuuuaaugaagaaacugaaaaaucccaggggaaagcgaccaaaggauggagacgcagagccuucacgggaaaagugucgugucaugugguacaaauauaugaagcugugcucaguagcacucaagcugacuauggagucagcaccaagauaaccuuuucuucccugaugcguugaagguacuccagggguuguggagagauugacacugucuuccauuguuugaggaugcacgaagcaguuugguaccugugggggcaguugaacaaccugcacuagguuaccacuucgugccuguaaaaguuuacuuaguacaggagcagucguugugucaggagcagucguugugucaaagccuggaagcccugagauccaaacaguuuuuucuuuccucauagguucaguccucgcccuuaucugaugguagauccugccuccaagugacagacacaaccauuguuuauugggucacauaccagguauuccugccugugccuucuggauauguuuuguuguuuguuuguuuguucuuuuguuuugucaacuuuugguuuacuuccaagugaaaaggucagaagugucugaaggcagccuguggguggcagugaagguguagcugcugucacuacugcacaggacaguauugaggggggaugcuggcguaugcugcgucucugaggcauccuacugagagccugggaucuaacaccguacuugacuuacggaugggcaagacaaaugguugccguuuaacuggaagugccuaccaaaauauggccuaggagaggaaaaugaaagcuagccauguuugaucaaguaggcuugacaauaaaaagguccacagauaucaccggaggcugcguugaucuugaaaccagaugguguaaagcagaauugugaaagugugaauagaccaguguguacucguagcagcaucaagaagggagggguuagaaugaaaggaaguggcacagacaauaucuaaaagucuagucuagguagggaaagguccggaacuuuccuuauacccagacaagucuucugugcauucuucuccuuaacuucaugcuaaaaagaauguuuauagagcuggagagauggcucugugguuaagagcaccagcugcucuuccaaagguccugaguucaaaucccagcaaccacaugguggcucacaaccaucuguaaugggaucugaugccuucuucugguaugugcggagagagcaaccuauguacucauauacauaaaauaaauaaauccuuuuuaaauuuuuuuuaaaaaggauguuuauggcauuuucuuuuccuccacuguaacuccaagacaaccuuucuuaccaagcaguguugugcuucgaaaagcagguguuuauauacuguuuacauaguuaacauaggccaggcaaucauaauuuccuagaauaauucaucugaaaagaccucuucucaaaaucaccuccugcacaaggcagugcuggcagaugagcaugaguaaacauucagcagggccagcgagaccccugugcaguugaaacccuugcagaggacccaagucccgcuccuguuguucacaucaggcaucauacaaccaccagcuccaggggagucaacauucuccucuccucgcagccaccugcacucaugcaaucaguagacaggcaaacauauauacauaaaagaaaaauaaaucuuaaaaaaugucuaucaugugagcaggcagggauaagccagccaauaguuggaagauuuuuacguguguguguguguguguguguguguguauacacgugcacgccugcuuguacacacacaugaaggucaaaggucccugagugcccuuugucuuuuaugugagauagugucuuucauuggccuaaagcucuccuaggugagcugagcuagcugaccaggaaguuccaggcccuccugucuccccuuccgaucuugccuuuggugggauuauuuagccacaagccaccaugcccugcucuucacugcauucuggggauccaaacucaagguccucggauuugcaaggcaagcacuugguugacugagccaucuccccagcccaacugaaggauuuucuaacacuaaaaagacauugauacuuaacuccaucaggccccgaauaauaacucagggaggcuacucuugaagaaaugcuaaacauugaucauguugcuucuaguggcaugauugagaaacugccggaaaguuacuaaguuugugugggugaggauaguaugauaagaauggguagcuacguugugaacucaugggaaaaucacuaaaggcaucugguaauaacuagaguuuaagcuaaaacuuaggaugauaaauaaauggagaagaaauccauuuaacgggaucuugcacuaugcugagccaucauuugggaauccugacccugccgugugaucaaugucuaauugcaaccauguuuaaaauaggaggaggucagauuagggaugguacauugauacuggcugugcuaccaaagagcaccuggggaggcugguggccacaucuauacuacauaagguuguucuuagucuagaaacuguguagacugcuuugcagaaacguagagaggcgaggagugaaaugccaccccuuugucuugcaggggcugcgauggaccugguucucagugccgccgauuacuacuucuucacuccguauguauauccagccacguggcccgaggacaacaucauccgacaaacuauuagccuccugauugucacaaaccugggugcuuacauucucuacuucuucugugcaacccucagcuauuauuuugucuaugaucauuccuuaaugaaacacccacaguuuuuaaagguaagagauuuuuuuuccagcuucuguuaccauaaaaauaauguuguauuugugaaucuuugaguaauacguaauuuaacuucugaaaucaagccccugaggggguuggauguuuuuauaaggguuaaucaccucuuuccuucuuguauucuaacuaauauggggaucuuguuguuuuccguuagccugggaucuuacuucaccugguacauagacgagaacuaccgauccuacccuugaugcgugaauguaggcugugguuauuguguucaugugaauauuuuacucucuagcuuuugcaugcugacagguguuuuuaucauguauguuuuucucuggcugagccggggauccaaguucagcgcuugagacuuguuccuaauuagcuuggagcaguucucugggacugccccugguauuugucagauagccccugugcugcaaggagcuggggacacagcucauuuaaggauuauuccacaagcagaaacucagcguacagauuuggugaggaagagaaaagacuucagaagggaagguacuugcugcuuuugguuggugucagggggugcuugccuuccacuuucccacacacuggagucuucacgggagaaguuuuagaaguaagccuuuuaguguaaaagagaacuuaguggaccugaaaagugagcuuaacagcuaagagugcauuuugcuucugcagaggacccagguuuggucuauagcagccauuguuaacagcucacagcugccugaaaugucacacacacacacacacacacacacacuuuaaaauaaagucugagggaaagagaaagaauugagggguagggauguaguucagugguagaguucuugccugaugugaguuagauuccaagaacagacagaacauuuuaaaaaauccaccccccgucaacuuuaugacaguuuugucgaacagcuuuuugugaccuuucgucuuucagaaccaagucucgcgugagaucguguucacugucaagucuuugccuuggaucagcauccccaccgucucacuguuccugcuggagcugagggguuacagcaaacucuacgaugacaucggagacuuuccaaauggugagcagauaccaggagaccccacgugaaaguuagugggacaacacacaugugaguguucaugugcacaaaaggccaagggcacucaaaugucaucuucaggauuacucuuuaccuucuguuuuuuuguuuguuuguuugccuugauaaguggcccugggccuggaacucacuuaaggagaagcaggcuggccccaaacacacagagauccauccacgugugccuccccaagugcugggauuuagggcaguaccaccuggccaagucuagacugagucucuaauuggcuuagaauuuaccaauaugugcagucuggcuggcuguuucucccucaccagugcugagacuccaaucuauauuaccacacuuggcuuuuuauuguugugguuguuucuaaggaucggccugccuacuuuccucccuucuccuccccuuuccuuucuuccccuccuuucucccuuccuccccaaccuccccuucuuuuccuuugucuuccuucuuucuugacagggucuugccaggcuuaaauguguagaggaugccuccauacaguuacuuucuuuaaagugccaaaccugccuuuuucucuuuucuuuccaacuguccgguuguuuugacuaccugcugucuucccuucacgucucaccacacaaguguacuuccuuaacuucacugucauuucuaaagucaguucuggaugccauugucugccuaagagggugcuaaucagggauggguccccguguuuauucccugugauuguucaacgugcugggaaaggaauccugguaggaugugagcauuacuggaaaucaccuguccguguguucuucucccuggcugccaugaccucccuuccaucugugcccgcccagcugcuugauuaacauugcagaaaugcaauacugcgcaugcgcuuugcauuccgauggcuuuaauaaaugugauccuuauauccucucuguaagaaccgucauagagugcauuagacucuguccagaauuuagaaauugacccuuagcauguagagcuuuagauuuuuauuuuucuuaaaagcaaucuggcagugacuucuguaccauucugaaguuacaccucaaaacacauuccugacacccagagcacaggcaggaagaaaggcauucgcugaggcuggcagcccagcagcaguccucagcucugcccugugccagcauacugcuuuuccucagcagcucugcagagcugggcuugcugcuaggcugcucuuacaaaggggcacagcacaguagggaacagagagucaagaaccugccuguaagcccagcaaacagauggugggucagaggcuugagcccagguaugcugauauuaugcucucaaaguaggagguagcugauuagaaggggcuuugacaaugcgugagagaaggagcaaaaucaaggagagggaauucuagacacugaggacagcaugggccagaggcagggguaagaugccacagacccuggcgggagguugaaugcauuggccugguggacaaagucucaggaggugaaggcuggaaaucccagaaagcggcucauuauggagugaguuuccggagcuaagguguuuagugggaguuaagcuccaggcaaggagguagugcacuuuccuaagguagaacuuaggaaagcugauaggaaggaaaacagugaggcuguccugucccaugggcaucuuuguaguuuaguuaagaaauaccugugcuagaaagauggcucggcaguuaagaggacccaaguucagaucccagcacccacauugguggaucacaacugccagugacuccagucucuggcauucacaugcaaacacauucacauaauugaacauaauaaaguugauaccaggguuugguggcccuucaccccuuuaauugggaggcagagacaggugggucucugaguucgagucuacacuggucuauagagugaguuuuaggacagccggggcuacacagagaaauccugucucagaaaacaacaaaacaaaacaacaacaacaauaauaauaaaguuaaaucauaaaaugaaaaaauacuguaugggcaauuuguaugguuuuacauagcagguaagaauuuaaauuaaauauuauacaaugaaugaaagguagaacauuucaaauuguuugacgaggaggaggagggagaagaaggagaagagaaaugggaagaggcgacaaaacgagaggaggaaaguaagcaguuguagguagcaaagggagcugagccuguaagguguucauguuugaguuuaguauccccuucugcacuuuguggaccuguggaaaaggaacagcaacccugggggccagcucugacucuuguucugugugcucucuuuuaggcuggauucaucucaugguuagcgucguauccuuccucuuuuucacagacauguugaucuacuggauucauaggggccugcaccacagacuggucuacaagguagagagucauucagaggggagaagagggggugaugucccacauuucaguauuaucccguuguacucuggauucuaggggcuccccuugccuauauaaaugcccaggcuccucuagccgccagccauuacaggucccacgcacauuuuauuuauauuucuucuuugugggucuggacugucuuacaguuucagucuuucgggugaaggaguggcuuugccgaucccuguguguaccaggaguggaagcuaaguuugcccuugccucaggcagaucagaugggucuaaccguaucccuuucucccucagcgcauacauaaaccacaucauauuuggaagauccccacgccguuugcaagucaugcuuuucacccuguggacggcuuccuucagagucugccuuaccauauauaccccuuugucuuuccacugcacaagguggucuacuuagguuuauaugucuugguuaaugucuggacaauuucuauucaugauggugauuuucggguuccccagaucuuaaggccauuuauuaacgggucagcucaccacacagaccaccacauguucuuugacuauaacuauggacaguauuucacauugugggauagaauuggaggcucuuuuaaacauccuuccucuuuugaagggaaaggaccacauaguuacgugaagaacaugacagaaaaagaaucuaacagcuuugcagaaaacggcuguaaaggcaaaaaaguaggcaauggagaguuuacaaagaauaaguagauuauugcccaguuauuaacuauuuuaaauaagaaaauaaucuacacagucaagauaccuagcaaauaaguggugccauuggaaugucagcauugcuugagugucaugcugagggaugguccugacaguaaacagcgggaagacaccgggagcauuguaaucgcuugguuaauuguccgacauugguccaggaacaacuugucuuuucagccggcugaccugcagccuguacagcucugaagcaucuuuaaauacgauagaaaauaagcuacucaagaagcuggucuguguccuuuugccuuaguccaugcauacucauuaaggaaaaaaaguaccauugugcuaaacgcuacugagacuaaccaggaaacccuaacgaugaagaugguccugucccgggagcggcuggcuccaccgaagugcuggggaguugcaggacuucauucaaauaggaauaucaguccaagcaagcugauacgugaguggcaguggauaggauuugcuuaauggcugauguaauaagauuguacuuccuauacagaggcaccuuacucucuggggcauuaucagauuuuaauaaaugaauaaauaaaugguauuuuuuuuaaaugucagcucuuccauaauucagucuagauaggagauuauuuaacugaagaucuuggugagugucauuuuuuuuucuuuuuucuuuuuuugguuuuucaagacaggguuucucuguguagcccuggcuguccuggaacucuguagacugggcuggccucgaacucagagaucugccugcccuugcugggaucagaggugugcaccaccacugcccagcuugaagugugucauuuaaaaccacuguuuaauaacccuacagacaugaaucuggauaaugcuagguauaaacuuguggcacccagugacaucuuuuuuuaaucaaguggacacacuuuugauguauuucucaguuacaaagcugacuuuuuuuuaaugaagggaauaauugccaaguacuuaaaucuaccugagguacacuuuuaaaccucaucuucuauuucuucccucucuucugcaaaugaacaaaacaaaacauaaaggugguuguuguaagcuaaguauauuuguggagggagaagauauguuuuuauaaaguuauucuaauggcuauuugugcaaaaaaaaaaaacaccaauaaaaguugaucauaacugcuauuauccacuuaaauguuauagcacaaaacguccuuugugcauuggggucacuuugaaggcguagaggugauguggguuauaaaaucugacagcaucccagaugcucagagucacacugcacugugugcaaacaucacucauugcaaccgucucuuucucauuuguuaguugacuuuaccaagugcucuaaggaaguggaaaccagaaggaacgaagcucuguguuaggaucuaggcuucccauuucuuggguacaacccacuagaacccugggguuugaauacaucagcaucacuaagacauggacugauuaggauguuggaugaaucuggcaccuagcucuuagcagugugcugugcauacaaaaggauccuuaagauacacuguuugguacuacaucaaggaacgguaaaccccaucccaccaccaccaccaaaugggacaucuccaucaucccuaacccccgaaggaagaggaggcagagagauugagagcagagaccagggaagaugcugcaagucucuagacaugagggggccuuugugcucguaagcucacuauagcuguggcugucgauauaugaaccagccagucagcauuccagagugguuggggucauggaugggguguggggguugagagggucccaccuccagcugggagcuuuugacaguugaugauugcuugagaagggagaguccguuugcaguggugcaaucucuaaguugcuuuugcaccacuggguuaccucccaggccaaggccuguucugauuggacucuggcuuauaaaguaaaagaagauaggaaaauuggagagggaugaggaggggucuggggaaguuuggguaugagaaagguagaguggauaugaucgaaaugcgagggguguguauguguguguguguauaauaaagaauagcuaaauaaaauuucagaggcaccugagcguuuagccuucaguuucaccucaggaguccccaagaguuaggacaugugagucagagcaguugcccuucgcacccuugcucucucccacccacgggggcugagucgcugccgcccaguaggaucaagcacaaagacgguggcuccuguuuucuggguucugugaugguugaggucggucuucugcuaggcccucaguaggaguucgguggaggagccugcccucccuucaugcuggagggugaaagacaugaagaugaguuacagaaauauguaaguaaaaucgaaaacaagacacugaucacugugaauuaucuugaaugggauaaaauugcuaguauuuuuguugcuguagcauucuuuuuaaaaaugugccauaaacagucuauaguaaaauugagagacaaaaauagaagccugucuuuacccugaaauagaauaaacuuccuaagaagggcaggaaggcuuuaccaggguuugguagaggaagaaaaacuuguuuucauaaauauuugcuuugugaagacacggugaagauaauuguucagggccaggauguagccuaauagagugcgugcauggcauauuuaaggcccucaguuaucccuagccugacaaaaagguuuucuuccuaaucucuaaagucaaguugaaagcuuuuauuaauucuacguguaauagaguuuaaaaauaaguuauauuccaguuuuuucagcagugaacuccuaagucaaaccuaucaaauccuuguaaugaaccuguaaccauucgucuuuuuauaaugagauuuucuuaaauuugguaagagauuuagcauuugacucagcucccuggucagacuuguuuuuugaggaccuggacagcguuccaucccugggaguuaaaaccugacauaggaugaugcuaucagaaaugagucauuuggcuugaagcugugugugcccucucaugaagccagcuuaucucagagcguuuguuaaucuccagcguuuauggcugacucuuugaauauuauaauuuuacucagccauucauuggaugaaaauuugacccuuaacaugcugcuaaagaaacaaauagaaacuuagugcacguccaucuauuaagucaggcacugagucuguggcucucgucuucugacccggcaguacaauucugucuugacauuucuauaccagugccaacaccacuccuggucaagacagacagauccuuaaccagugcauagcgcaugcacuggcucccucugcagucagugggucacccccccaccccccugugcaacccagguagucacuccucuacucugucccugggaauuaaucuugucuguucuauuauuucauuuaaguugaaucagaugaguuauacuuuuguguugaaguuuuauuuuuagcuuaacauguuuugacaugugugcuguuguauuuaucaauagauuguuucuuuuuauuggugaauaguauuccuauuauaguauacuucuuauacuaaguaauauacuacuauuggccaaucuguguaucuguugauagauacucgggauauuuccagugugggaauauuuugaauaaagcuauuauggauauuugugagcaaau

SEQ ID NO: 5038 - RNA, 822 nt, Mus musculus
ucaacuguuccuggggagccaucucccucugcaguaucucagauucuggaagacucgguugacuuccuaaggacugcauccuacagaagaugcaacuccaugguguuaucucagcuuccacuguugggauaugacaguccucauggaaggcucuggaacaaguaucacagcagaagaguauuccuccaucccggcacaccucacauucaucugaguucugaauacuagggucagcuggggaacgaugcaaguucuguguucucugcucuuuucuuuugcgauguauccguggaggauuggguagaaauuuucucuggaucaggaguuugaggggccaauuauggcagcgcaggcucaguuuccaguucuuugacuuuccauagccucccaucauuucaaauuccgagggugugaaccaguuuccauucugacacuguauggacuucacagauaucccuuguuugaauuuauccuuguguaacacucccuucaaguuaccacacgucacgggaagcaacucagcacuaaaaucggcauuuucuuuucugcgucuucuuagaccccugaucuuagcagugcguccuggguucuuuuucauuuucuuucucuugaaagcugccuggacaacagcuauucugccacguuuucucuguacacucauuggcuuucuccauuuugguuuugaccaguuguggccuuucuuuuuucuucucugcuucuuggguuuucuugcaggaauguuccuccuggugcccacacauucuccuuggcugcuucccauccuugcuuccaggucuucuggcacauauguuggggaacaca

SEQ ID NO: 5039 - RNA, 18679 nt, Mus musculus
ggccaagaggugcgcggucucuuuaaggcagguccuggugguuucuguuuucugaaggaagugacggggggugggauugaaugaaaagugcugaacggaguccggagcucaggaaucggggcggcuaggggacacgcacggggggcgccguccgggacucggggugcguggcuguacgcggcccacgugaauucgcugcacgucguggggaaccuccggguugagucuccccucuagaaguaggggacugccgggaauccccgaaccggacccccaacuucgagcaaacuuuguaggcgcgucuccccucccccacgcggcgcgccgggggccccggggaugcggcccccuggcugccgcgacguccccucggcgcgccccgcgcugccgcugcugcugcugcugcugucgccgcugcugcuuggggcgcugcacggcgugggcgcgggcagcggcgcuccggccgagcugcggguccgagugagacugcccgacagccaggugaucgaggagagucuacaggcggacagcgacgcggacagcaucagccuugaucugcgcaaacccgacggcacucucaucuccuucaucgcggauuucaagaaggugagguaccaucaagaguccugucccacccaccacggagggcgggcaagcugucgggcgucccaggaacccucaagcccgcagaagagaaacgcagugccgaaaggggaacgugacaugcccaaggucaccucucuaacucgcugcccacucucuggcacccagaucccggucuuuauucucuuucgugaaccccucuagcuuuuuuguugcuuggcucugaguaaccaaggcccuucucacgcacugaccggcuucaaagcccgcucccuccucagcacuccaagcugacacuccgacaaaaguucuuguuaacaaggccuccuuucuugccacugccucugugacuaaaggggaaauccacagguggcaagaggaccuugggcucucccuguuguguuggugugaaguuaguuucccuuacuccgcuguucuuuggcaaggaagcgguuucaagaccuccagccuggagcaccauuccgggaucgcuuucccugcagagcugucugcccuuggucccucccaagucugguagcagcucuccucuguaaccugaagggcugaacuacuugggagccagaggaccuaggcagaguugggggaagggaggagagaaaaggggagguuccccucaguuggaaaggguggucggugucuccgcccaugccugacaggggcuggugaaguccacaguuuagcugccccccucccgucccgucucucucucucucucucucucucucucucucucugucucugucucugucucugucucuguguggguguggugguauggagagaagaagagauguuagaguuauccagaaauggaacuccagggugcugagugacggugacccaacaacagaaaucucugaaagaaaagacagugaaaugccaccccagucaucccaggagccuaagacaggaggaacacaaguucaaggcuauacagagcuacagagugagaccuuaucucaugguuggggggaggagagucuucuaaucauccacucucagcucuucccccuaaaaggaggcauugcaccccucugucuuugggagaggaacagaagugacgaauauccaggacuaaauagccaucccuccucuucccuccucuccucuccccuccccuccauuccaaaacugagaguuauuuggagaccuuggagggagagggggcagaauuugggcagccagcuagggauccugugagacugucaugagcaucagagguaccagggagauccaguguuggguagaguagaggugagccuggacugauguucuagcccaggcccagggagucauccugaccaaggacuuagcagaaugguagcccgugcuugccacacaggcccaaacuggguucuuacaugcaaauagggccaaugagccaguguguggagaaggggaaacuggucacucagcacauccagccaaacuuuagggacauuuuauguaugguguucuggacagagucaaucaggaguggguaucuaaucuccccucuaagccucugaccuaaaagccagucacagaaugugccguuagugucccacccaccugcccaguagcccuguguugugaucacccuggaaccuuaaaaaaagauuuauccaucccuaggcucgaagucugauagccaagcuggguggggcaugaaaggcuaggaguggagcagagcuuuucuagccucuggcuacaaaggguugugauugcucugcucugaaaggcgaccaggaaagaaugcaccagaggaaagcaccagagccugcgauggggugguggccugccauggaggugggagacuagggauuggacugaguauggggagggggacaucugguugcucagauggaggggacauucagaguugauggcaagugcucuuuuuaauccccauagugacucaaaccuuucucacccaguuuuccaaagucggguuugcagguuagccuuugacccagagcuggcauuucacaucuaccccuggcagcuccaauuucauggggggggggggcaguaaaggcacagaaaguagaaagccagcugucagagcuucuuuggcccuggccaggguggaaugggauaaacagagacuaggaggacaauguuuagucuaugccagcaugucgccucuauuggccagagccacucuguaccuguccuucccccaugcugcccaucgcucacuugucaaggccucuacccucaaagccuugguuaguucuguauagaaguaaugguauuuccuauagaaaacagcccagaaguuguguuuuguacaccacacccauuagggacugcuuuaggggaaaaaaauccugaaucuucuuaggaccguggaugcuugcaaucugaucaccacugaggaacacgguacaaagcgaaggaggcaagucugguugcccgcccgugagcugguccauccagcuguuuaaucucucuaggccuucauuucuucaucuguaaaaugggcuagcauuggcaccuacccagaggccuugggcagagcugaacauggagcaaagcacuuagguaugccggcuaugcugcuggugcuuugucaagugcucaggaaaggaaggagcccuuagcuagcucggaggcuggcucaccccacuucucagccagccuccucccuggucaguuuggauuaaaaagguugaaggguaagcaagagaucacaaagaaaguccacuuagaacuaagacuagagucccucacugccucuugucuucuuccugacuuggaggcagggccuccaaauaaagcccagacugaccuuggccuuaaacucccugugugguccagguuagucugaaacuuauguuuuaucaucaauauuuuuacacagucucacuauguggugugacaaaacuuuuccugaggagaugcuccacagaggucuacucaccccaaauagggagccugugacagaccaacauaccaauagcaccaaaguccagcuuggcaaaccaucuuggcauaugaaugagcuguuacuuacaggagcaaaaaugacucaaagcagaugcauccaucaccaaggcccacccccaccuuggugaccacucacaaaagcugggaaccuggaguauccucacagccugaaggcagcucaugggguuggagaguguccuuucgggaugccucaauuguucuaagccucuuucaggcaguuugucuggauuuuucacaaagcuaggcugagcaucuuugaaacuuagcuuuuauuauuuacucggaaaggagaggccuagugauucaggucaguuucagggacuucuggaagcucuuuuugaguuguuuaacuuccugcaucagguacuucccugaaggauagaauguuucaaucucccaagaaacuguuacccuagucuagccucuuaccugacucagucucaagugauaggaacucaggugcgagagccuccacuaacaaccacccuucuggaagcugcugaaucaaaagcuagucagccccuccggggcagcagucaacuuuggacuaaguaaaccuaagggcuucagagacacccuugagcagcaguggucuuagcccguccacaaccucagcccugccuucuucccggauguguauccaagacugauagacugcuccucacuuugccugcauccuggccccgaggcugguaaagcaagcagucauccauggggcauuagaaccuggaccuggcuggcagagcccaugagcagcauggaauguccugugucacaugguuguccugugucaccuggagcccuuccucgggcuaauaccaggcucaccgaacuaaaacugaaagaaugccagcacgccauggcucaguggcuuugcagucaccugaggaguuugcagguuuucaacaccaguccugaaccucaccucacugaaucgggacaucugaacaggagagccaggcaaaugggguucuuuaaggaaugucagauaaagguagaggcaggaaauugaaugccagucugggcuacaugagauucauuaaaaggggguggggggauguggauggggcucauuggacaguauuugucuaucaugcagcaaacccuggguuugauccuuagcaccacauaaauggagcaugguugugcauaucuguaaucuagcacaugggaaguagaggcaagaugauuaguugcucaaagucauacucagcuauauagugaguguaggaccacccugggauaaaugagauacacucgcgcgcgcgcacacacacacacacacugacucuaauguguuaguauugguucuagguauugaacccagggccucaugcaugcugccgcugagccucauauccuacccucuccagccacgaaugcacuauaagcagccguuauauccugggucuaaaucaauaugcccuccacauaggaacucuaacuccuaaauaaauacaguaagcaauacucuucacacacguuaucauccaggcccuguauauguaaucugaccugcgcauauauagucacugaacacagugauagcaggcaugccaccgucccugcucuggcugcuuaucugacaguccucugaguucccuccuccacacugguaucucugacaaagcucucugucccccugucugaauguccaaaagcaggggaaggaaugagucacuucacaagccgccugguuugggcauggccucaaggagaagguggugcuguaagauaugaagauggucaugugugacugcuucggggugaaagaaauauagcagaagaggggaaacagugaagaggagagggauccuggagacccaugggcugaaagcugagggaacgccaacaucaagagccaccuagugcuauggcucagcucaggguuacuccgaggggacaaggauccagggagauuagaaacuugcuucuaaggguggaagccagaggaaagaaccaaccagaaaacaucggauucccugucccagaucaaaggcaggguuacugagggauguagccagugaugaccugcaguauucacauggacacugucccaagagaaugucacagggguaggacaagaagagaagccuguaagguccuaaguccuacccugucugugucgugcugccuauggucugugacauggaagauauguaauggguuggaaggcagaggguaguaaaagugugugugucugugucugugucuguguguacacacacaugagcccaugugcacacacguugcagggguacauauggacguguacauguuuguguguguacacuugcaugcuggaggccaggguugccaucagcugucuuuccccagucacuuucaaccuuauuaguuuuaagucagggucucuuacugaaccuggagcuuauggauucagcaaggcuggcugaccaguguagcuuuaggaacucucuuuguuucucuuccuacccagcgcuaacauuacagguauguccaauggugcccuguucuuuacauggguauuggggaccugaacucagguccucaugcauagcaggcaauuuccuaacugaaccaucacccaacccccagaagugcuuuugaggaaggagaacuucuggagcacaaagcauuuucucugaaguuuacaggaaguaaagauaccaggcuguguauguggggcucuuggauucaguucuaguccucccucauaucugaugaaguccuccuugggucaggauguaaagcucugccugugguucaagugugcucccugaccucuggcuagcaucuccuacccccuaauagagaugcuauguccagguauaaaccuauccugacucuuggugaaaacuaccacccagagccaaugguguaggcugcuggagagacugcugaaagaagaaggguuagaguucauacuuggacuccucaaacuauagaugaguaguggguaagcucacccuuccuccacagacaggcaggcaggggacccaaccuggagaugcagacuacauaggacuauggcauccugaauuggaaaaucacacauggcucagucgucugacuugcuacgccacgaaacacauuugccucuguccugcagaugcacaggcugagcuugguagugaccuuggugacaaggccugacagcuguguggcgacccaggauuagcucccagagaucuuugugccauauucuggcuaacugggcuacucuaguucucugaguaauuucuuuccaaaaagaugaagcacaccguggagaggcaggagugcagaagaacccuaguguacaagaaucuauaaacacuucuuuaucugcaguuggaaugggcccugucucccagacccauaauugccagggacuccagguuugaguccuccgcagugcugugggugguccuggagggugaaaggccaggcuagcuuugaaaauagauccuggauacuucucugcguuauuuuaauuuuaucuuauuuuauuuauuuucuauuucccagcugugugaugccaacaggucacuuagugucucugagccuaggcuccaugcuuaggcuccauuuccuaggcagagugaccgagggggacuuuuuagaagaagggacccacgagaaguguaguuccaaugcaggcagccaagugggccccuccgcuguaucucuccauccccacaaguaauugcauuuuuuuuuuuuuuuuuuuuacugcacugggaacuauuccaucacuaggagcuucugucccuuaaacuggcaaauauuuaccuacuugucacuggggauucagaugaagggcaggggaugagggaggcuggaaucuaagugagagggaaguaugacaccccgugucaggaacccugagucagcuagacaguggggagcaguugauccacauaaagccucucauuguuccccugggguagucgggaugguggugaccuuuggcauuuggcugacgagcaugaggggcugucgggagggcuggguacuggcagugagggcuacucguccugguuaauagucacacuaacccuauaacaagaagccucuguccaggccugggugaggucuguguacacagcaggcgaugcauuaagucuccuagagcauccuaccucugagugcauccacuccuaauccugggaaagccaggcagaacugcagaggggcuucugaagcugcccuugggcagccuggguagggaagucucuagcucugcaguccccagccccacccuagugaaguuggccccugucuagucaugaagcagucccagccaggagcagaggaauaaauauuuagauuggcccagccugggccccagagucacgcggucuggugaugagaaggagacagagauggcagagcacacucccaggaggcagugagcccccacuguccaguagcaagggagcuggggcuagcagaggguagguacugcuuguggaggcccuggagcagugagcagccauuggccucuggccugggcugugccacacauacacgcauguacacacauacacacacacauacacgcauguacacacacacacacacacacacacacacacacauacccuggaaaggcaguucugcgucccugagcuuccucgguuuuucgucugcucugcaguggaaagugugauagcagcaggggcugaggcuaagcaccucagcugccugaugccccaggaaccuuccagaacauguaccacagcagagcaucaucucaggaguccugaaagcuaggagccgggaggguaaggggagcugagcugugcggcugcagggccuaugagaggagaguggcugggcugugggugagacugugugagccagagucugcugggcaggagacucacagaggaagggggacacuggagaccaagggacuauggcugagauagagaaacugaggaagagaacucagcugcuguguguguuugaguguauguaacgggaaccuuucugugggaagaggagauugaagaacaacagaucucuguggaagguggcagccuguggccugaggguagggaaagccgggauaaaucugggugcaucugcugaggccagauuugauuugagaauaaagaaagaucccaauaacagugucucaagcagcgcagccagcggguuaccggcuccccugacucagucugaaaggaaguuauggaaagccaugcugcucugucuuggcccaucacagguccaggccucccuccccaggcuucuuucccucccccagcaggaaaugcucccugggccucucugggaaagcagucuggggggcccacacagugugucuccugucacggguguuuuuccaggacagcugucugccaucacuuccuuguuccuguggaaccccagcaaggcugagccagagaagucccucucucugggaaacacagugggucucacagaagguggaccaguguggggaaagcccagaggggguggaauauccaucuccaugaagugaugcagagcaccggccugaggguugggaggucugaguuucuacugcuggccuuacugcugugugacucgugaugucccugaccucuggguccccucuuagaacacaaaauaguaaguguugggcuagugggccugcaaucgugcagcccucauccccuccaccauagauaaggccgagaagauaagguuuggagauagaggaggcagaauccauuuacucagcugcccugugcuagcuccuggcuaccacagaagcaggcuggagccacuugccuuugacgccagagggccugaaugaguccuugcccaggugaaccagugcuaaggacagugaguggcuuuagggucagugaauacucuccgggguauagucaagugucaagccaacuucauaccugacuccuuagcugguuccuagaccccaaauccugccccucuugcuaucugccucuucagccaccccccacaugcucgccucaauucccucuccaucucacugagucauaguacauuccccccacccacaccccuugcugcucucaaaccuccuucauacucuucuugcucgguugucugugcaugcaugguuagggauuucuggagcauccgcugucuucuagugggcaggggugcacugccaugagaugugucccgggcuuggagcaugagucugggagggaaaguaaaugaggcgggcagggcacuggaaagguggcucugcagagcuggagguccuaacacgggaccauaucagagcagguggugccuaggagcugaggccuauggagggcggacagauggggguggggcauucccacagaguaaugggcuugcaggaagguccaggaagugacccagcacugcucauuccggaaacuguguuucaguauauaaguggcaugggauggcagccucuagaggcuuuauagggaagacagugauaauucuuagagggcauuaaaugcucggaugacgguagagucaggggaugguuggauuuaauauggcacuccggcacuccgggguggaaacaccugcauucuucacacugacucgguggccucccuguggagucuucccaccaucccuccagccccagccuauucccuuauccauccuucgccuccaggacagucagcacaaacuugaacucuaggccuuucacccugggacugaagcugauugugugaagucagccuuccuuaccucaggaguccuuuaaugacagggcccuuggacuuggccauucccuugaagcuuugccucggggaucgccacucagugaucuccugcugaugcguguggccucacgggggucaucuaaccugccuggcccuccagaccaucuacagaacaaucuuuaccaugucucaugccuagaguagaugacacugggaacaaaggauuauagugucgggagaaaaaacuuggaguccugguguauguucugagcuuggucaggucuuuucauugcuuauggugguuccgaaaggcaguacuguugauggacucguuggcaaguguagaaaccgagacccagagacuucacagauucauuggugggugguuacacaugguuacuggccagaagcagcaaggccagggucugaugcagggaguucugguucuuagcauuccgucuuagcuauauguccaagccuaccugugccucaguuauacacaggacuucagcaacccucccugaccccuccuggccucuucuugcuguaugccccagcauuuccuuaugggauaaaggucucugggagaaaggacuguauggaggacucccaguuugggagucccagcccagacccuaagccucuaucccaugccaaaagcuuuuguccaguugcaccaucugucuugggcuuuugacaacaucuggaugaaccuuccuaguggacuccaggcaaggagagggacugggagccagguuuacaucuggcuuggauucaaccagaucuuaacaucuggacagauguucucaaagcaggggagcucuuucacacuguccuguguauuucuggagccuugcuacugggucaggugggaaggccacagucaggauaugauguccgcuccuuuccuggagccagcaaaggacguguggcuuuggggcggaaacaugaucaagaucagagaacucgggcuggagagauggcucagugguuaagagcacugacugcucuucugaagguccugaguucaauucccagcaaccaugugguggcucacaaccaucuguaaugggaugugaugcccucuucuggugugucugaagauagcuacaguguagucacauacauaaaauaaauaaaucuuuaaaaaaaaaaaaagcaagaucagagaacucuggcauaaagggguuuuucauagggcggacaguggcuagcagguauuccugccugcuguuuuauuuguaucaggcuguugguuaggcgcacagagugagaggaggaacugccauguuccuaggcaaucaaccaaggauuuagguauaguggucaagugaggauguugugaaggaacccagguucuaguccuaugucugccauucaccgguucugugggccuaagcuucaguucauuccuuccuuccuuccuuccuuccuuccuuccuuccuuccuuccuuccuuccuuccuuccuuccucucagcuucaccgccuuucuccucucuccuucuauuuugcccucaaaacaaaaugucucuuucaaacugcuuucuagcuggcuguccuucugccuccacuucccaagugcuagguguacacugcacccacucagccuguuucuauccuugcacaucagggaaauuuggcuaguugauccaggagguaacuguacucucuggggaaagggcucagcugugggauagccuggacuaccugguuaaaacaccggcuacauuuccccuaaguccauggccuugagcagguuacccaacccaagcugucaccgagcucugccucuguuguggagacgaccucugagccgugaggcaauccauuggaggcguaggaacuggcaguuucuuucccaguuaucgacuucagugacucuuugccccacacagugacagaggacuuccuuccgugcccaggcagcaguuucucaguguugguugcaucuggugguugucauugcuauuaguaucuaguugagaaacagggaaggaacuauaaagcgggucuugucuaucugucucugucugucugucugucugucugacugacugugucucugugugugcacacaaguagguguaugugcagaugcacuugagcauucgagugcaugugaacauacaugcaucugcauguguggaggaggccaguggucacccucagguaucauugcucaccacauauuuugagauagucucucacugggaccugguguccauggauuagacuaaccuggcuagccaguaaguucuagggaucuuccugccucugcauccccaaugccaguaucacaagcaugcuccaccacaacuguuguuguuguuguuguuguuguuguuguuguuguuguuguuguuguuguuuuaaccugggugcugguaauuggacucagguccucaugcuugugugacaagcacuuuauccacugaaccaucucuucaacuccucaagcagagcucuuccagccucgucugguucuaaacgcuuaaugccuuccacuccuuggggugggcagaggguaucuccguucacugagccccucggcagcccugagaacacuggguacuuacuuaguucaugugucacugagaagacagcagucuccagauaggauucccacaaggcucagagcugcagauaccagugagguggacuuuggaucuugcccgaggcuccucccagguacugccugacucagacuccuggagugggagaucuuauguggaacccaccugacagaacugugccuagccagaaugggaucagccaccagcagcaggucacccuccaguguccccucggccgacccaaguugauggaggaucagauggcccaggcuggcaggauaaggagaugccagcacggugacccaagaagggauuuccugucuagaggaagugguguuaagccgagcugacucaccuuccuuccaaggcucugggaugaggagccucagggaacuuuucuccccagcugggccucaauuucucuuuucuaggcuauuacccuucacaugcccguccccaguuguugcauuuaaaguaagucauuauauaaauccgucucuaguaaaggcagucagggagaccccuuguagaguuacaguauuggugaaaucuguuagaagauuauuaacagggcagugguggcucacgccuuuaaucccaccacucaggaggcagaggcagcagaucucugcguuugaggccagccuggucuacauagugaguuccaggacagccagggcuacauagaaaaaccuugucucagacaaaacaaaaacaauaagaaaaugggcugcucuugucacggaucaucccugacauuugcuggucacgacagcaaugacaauaaccucuguuuacagugcugaauacucacaccccuccgggucaucagcuccacccaagugugccagggacaugagcugucuguccccugucacagggaggcuugagaaagccugggacggcuaacacauguggccuaaagguggaaccaucagcaccucccuguaucuagaacccuggggaacacucugaccccguucuccaaacacuuggacccuagccguuguucaguaaggccuggaugaagggggcugccgacgagacagcccaggguacaagugcagggccaugaaaauccuaggauuacauugucuggugucaggguagagcugugggcauagggaccaggaagguucccagccauacuugcugagcccaggugugucguguguguguguguguguguguguguguguguguguguccccgccugcagaagggcucuucccacauugagaccccuucugagacuuacuaaguuccuucuccccaggagaguuaggcaggcacugugguuggugagauagagauugggguugggguaugcaggaugcaggcagaugcagcugaggguucucacugccaucagacagcaaaaggugccugaggcucugccccucuuccugccccagccucccucuugcauccugugauuccgaauaggaaggaaaccauuggccugcuggucacaccaugaguuauccccacagggaaaggggaaauggagagggaaggggaaaggugagccauuccagucuuggaaggcagcaacagcugcagccggcugccuuuguccccacagucccuaauggagguggggggcuaggggccaggcugacugcagaaugcccagggguuuucugaccccccccccaagagcuacagaguaacaaagucugagaaagcucuggaaugugugcuuguaaacauguauguagucccuccucuccccacagugcucuggcuuaaggacacugggguccucacugaggggaggccuuggugauagacaagaaccaaaaacaggugcaggcuuccuugagauuaaggucuguccggucaaaggguucuuuuggaaaaccucucccggugggugguugacuuugucaguuuuccagaaagcuguggaaacccuggaggugugaucucugaagucacgggugugaauggaaaagauaagcgguuucuugguuaucugaggaaggaggugucuggaggggcaggcccugguacaguguccaggccuguccucuccagggcugguccggggccuuuccuucccgcuggucuccauccuccuaccccucccuuucaggacgugaagaucuuccgagcccugauccucggggagcuggagaaggggcagagucaguuccaggcacuuugcuuugucacaaggcugcaccacaaugacaucauccccagugaggccauggccaagcuccggcaggugagugcccaccccagagccccaacccugcagucacccuguccucauucaggcagcccccucccccacucuuccuccccgccuucucuuaacauucacucaccauggaagguccggauucccugauuuugcucccgaucaaacugacuacagagccccagaucucuacucuguaccgcggcccaacucucaggucaccccgagcuacuaauccaggucccacucuuuucuggguggagauagagauguagacugugaauugggauugaacaucaccuguccccugucccucguuagugacacuggacaaauggccuugccuauaaugccuuggucuccacauuaaggacauagguuagaaucagaacucauccgggaaaguguaucgggaaauacuguuugcggccgcccuuuggcccacuggccugcauaggaucccucccuggaguuccgguuuuccauagcuuaucuaagcugaccugugcugcaggccuaccuugugacuucuuuccccccgaggcuccaccuuuuguccacccugcuccgaaagaccucauccccuggauucagaaagcaggcaacccacacugucauguacccuacaacaguuugccuagccuaccuacccugucucccagaaccaccuugaacuugccaaagagccccagaaauccaagaagcaaaacaagaauggcuuuaacugccucuaggguaugggcuucucagguugggcuccguuccccuccacggccugaggaaaaggaaggcaaaguauguguucccaccuugugccuacagaaaaacccccgcgcagugcggcaggcugaggaagugaggggucuggaacaguuacauauggauaucgcuguuaacuucagccaggggggccugcugaguccccaucuccacaacguaugugcugaggccacagaugccaucuacacccgccaggaggauguccaguucuggacagagcgaggucagcuggggacggcccuugguggguagaaggggaagcauggggugggggaggccuugcugagugacugguguauucaagagagagcuacugagucacuucugggaugggccauguggacgccccaguugcuguagcugguaguggguagagcugaauggcaagaguaaaugggagugugcagucaugagggacaggcauucuggggggaggguggaacccccaagguaggcugugauaugucagaaaggcuuccuggaggaggugcugucucugcagcuagaauaagaggacacacaaaagacaaccugcuagguccugagacucuuuuuuuuuuuuuaagaguuauuauguauaugaguacacuguagcuauacagaugguugugagccaccaugugguugcugggaauugaacucaggaccucugcccacucgggcccugcucucuccagcccaaagauuuauguacuguuauauggaaauacacuguaguugucuucagacaguaccagaaaaggucguuagaucucacuacagaugauuguaagccaccaugugguugcugggauuugaacucaggaccuuuggaagagcagucagugcucuuaaccgcugagccaucucaccagccugguccuaagacucuucaccauuccaauuacuacauauacugaggacacacauguuccuguagauaugccuacuggguaccuuucagaacucagcaucuggccaucccuggugccagcaucucucccagagcccucagggcgcaggcuaggaagucaggucagguuuggguccugaguccccuuucacuguacaaucccaaccacaucaguaaacucuccaccaauucugauucccugguacacaguagaugagguugguggguggaugagguugacugugauuuaauguagcccaucagccuagccucaggcccggggcucacccauguucauccccagggcagccgugagagggguggcaggagagaaggcuauccugggcuaagggacuccugccuucuucaugcuugccuuuccccccagguguggacaguucuguuuucgaggcucugcccaaggcauuagaacaggcggaauuaccucguuguggacgaguuggggaucgaggaaagcccuguacuugccacuacagucugagccuggccugguacccaugcaugcucaaguauugccacagucgugaucggccagcgcccuacaaguguggcauccgaagcugcaggaaaagcuacaccuuugacuucuauguaccucagaagcaacugugccucugggaugaggaccccuaacaacaggagacagaggaccaagaacggauacuugggccugcaaauucuucgcugaccaccagagagcguggcaacccaaucaggucuuaggucucuuccugagccgcuggcccugaagccacaaccucaucugcaugacugugaaagggugucaccgcaaccuugaggcagcccugaugcccaccugugcccaucuugaggcauuggggggugggggggggaggcaguucuccagacggauacccuccccucuuccuuucaccugaaaugucccgcgaagguggaaucaaaaugcaccggccuaggccuuuauggaacuuguuccggaggcauggcccuguagcacacuaucucaccagcaagggaaccagagagggacagcuggggacucgugccccagcuccugugucugguuacagugccuucucucuacccugggggcaacggggaguagggaugcugccuccaagaccaccgcgugugccuuuccugagacccaauuuggauacuucagcgggcaccgauucuuccugccccuggacugauguacuuuggucagguucuggggcagggagggagcaugaaguacaaggaaaacuugaauuccagauuuuuaaugcaaaauauuuaucauuuguaccagaaauaaaagucuuuuaaguuuucacucacccuauggcgccagcuuaggcuuucggagagaacuuugucccgugcugccaccuagugucagaaaugugccuuacaugguuagugccagucugggcaaagcaacuucuaaagguccuauugugugaucugugagaggcucugugcuuaagaugauggaacaagggagcugggaaggacucaguaguuaagagcacgugcugcuuuuuuacagaggacccaaguucgauuccuuacauccgcuuccaguguggggagugucacggacaccuguaacaucaacauaauggagaucggccaccuuuuauggccuccaagugcucuaacacauauaauaaaauuaaauuaauuuaaaauuaaaaacuagggacuucaggauggcucagugauuaagaacacuggcugcucuuccagagaucccauguuccaugcucaagacccacaugguaaaucugaugcccucuucuggcuugcaagagaccuuguacguggagcucauacaugcaagcaaaacaccaguggaaacacaaguaaguuauauaaaugaugaggcaaggaccgaagacauagcucauuuauagcgaauuugcucaggaugggcaaggccaugguccuaauguccugcacaacaaaacaaaaaagagaacagagaagccagugaauaacugcca

SEQ ID NO: 5040 - RNA, 2428 nt, Mus musculus
ucaaagucuagacuuuuauaagccagugaucagaauauaucuuugaaccaagaguucaggcacacauuguccaaaccaucuccacuuagcaucuacugaaagugggagacuaggaagagcuugcauaugcugggaggcagcaccuaugugcuucuauccacagccauaccuacuaaagagacuuuccaaacacggcugucucuagguccacaccuccagccccagcuucgauucuguuuuggcagaagggcccugaguccagaacaaaaacccacagugcagugcugagacagguuauuguuuuuccaagauggccggguuauugguuucuaguccucucugcuggccgggaccuccuagaaccuucugagguggcucuucauucgcaaugguagaugcaguaucagguacacagagcaccagucagagaugaaauuguucuauuuguguuuaaaagccccucuggguauccaaccugaagugcuuccuaaacaaccuauucuuucuguccuaagugggcucagguccauguagugaguuguucucucucccucucucucuuucucucucccucucucccucucucccucucucucucucucucucucucucucucucucucucucucucucugugugugugugugugugugcauauuguguauauuccauguaggaggaugugacugguaaaagagcgggaucauggaagagucucuuagacugcaaugaaccucaguguugcaccauugcccaacaagucauggggugaagccgggaggguguuucuuuccucaucagcaggaaagucaucugagcagccggauggccuucagaucaacaagugugaugcucuacccagggcucgaguuacgaagcgugcccaguuucaucugugaaaucugcgguuccggucucaguucaucuagaagaugaaggcuuucucaccuccuguuuccacuacagauuaccucugaccucugaccucugaccucagcccugucuguagcucuucaagcacuuucuacucaggcaucaaagaucuuuccuggaauccaggcugccagauccauucauuccgugugggcgcucuccuucucucuugcccuuuuaggaccacuccuaccaagaagcagauucauuguggagaugagcagucuaccuccgucuguacccacaagccaaucacagaacugucuaagggcauuacaaacugaucuuuccuaaugauaaccaagcugacagcaccccucccugcagaaucuguugguaagaguguaagaccccuuuaucccucugcccuucccaucucugucuuuggacagagaugcccagagcuuggggugggggaagagcaggcugagggauggaagaugagcugugugguccccucagggcucucccucucccgccagccagcuucaucucaguuccauuaaccucacucugcgugggcuggaauaaugggcugggaagcgccagucaccuucuugucuguaggaaggaagagguugccacuuguugcuaaccucagaguaggcacagggugcuagauagaaggacagauccugguguguggccuggcuccugaaugccugcugcgcaggagaguugcuauccugcggcgaugugacaggcagcugaaaugagugggggucagaaaggcgaaugucucauguucaguuuccccuccauugcuucucacgucuccuccucggcagcuaggaagacucagucauaugcacguuccccugugccguggaaggaccugugaacgauaauuauucuuguuugauuaacucuaugacugccguguguauguccuaacuugugcaauaugcuugugaggcagagaaggcugcacagugaagaucucugagccacuugauaucacagacuuggaaugccaaggccaaacacagaugguguauuuaggaccccaccuugugugcagguucauauuucucuuaucuaucacaccacccaucacguaggaguagacccugucugacuuaccgaagcaggaaugcuggcugugugcuggagccugcagcugaaccccagccugacugcaguugagaucccaguuggacauggaugggcgccugacucaagggcauccaauuccaaagaugaccacaggcugauggagcaccaggugcagaaagcaauaguucaguagcaauuagcuugacccaccagcucucucuucaugaaaaauggaaaggaagcaauugucagggugggagaagaccaaccagacagcagacaugugaaagacgaugacuccugcugguggagggcgagagagggaaaagaugccagcuccaguauugagggaccuuaaaauaugucccaagauuugcacagaacaucuaacccugcccagucuuccacuccaaucaccaaaaguccccagugcuaaagca

SEQ ID NO: 5041 - RNA, 5644 nt, Mus musculus
acaggaggcaccauuacccucguuucccagagagggaaacugaggcuguuuggagcuuuuaaaacgacagcaaaagcagucuuaauggucuacauauggaaccccagucacccagaggcaggaacaggccaauuuggacuauauagugagacucuaccucaaaaagaccaagaagaaacaggaaauagagauagauccgugcuuagggagguuccuagaauaaguugagaagcaauaccagccaaauggugggcucuggcuugauugagagacucugccuaaaagaauaagguauaucagugagggaggaugacucuugauaucaaccuuaguccuacaccugcauggacacacaugugcauguacacgcucauucauaccuguguacccacauguguaaacauucauaaaccaccaaaaaaaggaaaaaauaaaaacaaaacaaagagcagaauucagugccuuguccucugacugccacuguuuagaaccugaggagauauaaauaauuuaaauguuaccucuccucaccaugcccagacuuugugcuuuaauugaccugggcacaacugagcccagcugcaucauggguaaccuucaugcagaacccugcucacuucugugugaucuagguucuauuuaaagggucuguauguguaaaauuaccuucugggucgagcgccagcagagcagaaggaggggggacccuacaagagagaagacagugaugggccagccaacauaggaauugcugcuaggaaccuagacaaccauaccccuugucaucuuuggaagcuucucucuguuugcaugacccccuucguguuuccagugaaccagacggucacaucuguguuggaaaacuauugagucugauaauaaguaucccuguuggcgugcaaugaccucguuccaggaaacucauacagauggugugguggcuaauuuugccaacuugauggugggcucuagagcccccugggagacaaaccuccguguauauuuguaauggaguuucuagauuggguuaacugaggcaggcaaauccacucuaaauuagggcaacaccaucucauggacugagauaaaagacuaaagcaggaugaguagccuuggucaucgcucuuuccugaguguggaugcagucuguucuacaccgaccauguuuauuccuucaugaccagcucaccuugaacugugagccaggacaagcccuuccuuccauuaaguuccuuugauggguauuuuguugcaucaagacgaaaagucacuaauacagauagcgagguugguagaacuagagugucugucugucuuggucaucaucaccugugugcauugcucaauaaacaguagugguucagcccaugccaauggaacauggcauguaaaauccaguccucagcccucuuucccagaugacaggauggaccugagagggaagagugaugcaugacuacauuuuaaagauaauagugauguuccccuagggagacgucaucuauggacuaguggcugugaugacagugacuagccagggauuuccacagaccggugccuugugaacucccuuacuuguccagggacacugacaaugucacuggcuuccacuggcagaugaggaaacugaagcuuagggaaguuaaaauguuaccagagguucuguagaaaguaaaauaucagccugcauugacacccauccccugcccccugcugucaguacagagagcuggaagagccuguguucccacacaugggcuauggguucaccuccucagguucgccuuccccagccacguuuuaacaguuaauaaaguuugaaguaaauuagggaucggugagggccccuccuuucuaucaacagugugaacucugagaagcaccagagagcggccuccaggagagcagccauccaacguggauggaugagggacagaaguuuauuaugagggcgaaacuacucauggcccccggggcuagcugccucugaccccagcguccuuuuucaucucuaauuucugugacucaggauucagagccagugccauuccucaugcagagccuggagucauagcugagaugaauuuuacgaagaguauaaagacaucaguucuaucugccccaccgugauuaagggagaagggagagaggauggccaguaucugcacagaugcugucccgggccgggcugauaugaugccagaccagaccaugcccaugagcuuggucuuuuccagccagaggucaggauugcucuuucuugaguccucagagccccagcugacccaccuggaugaccacagcagauggaaucugcccucagaacccacgugccacuguacucuucagaugccugcuuucucuuaaucucugugucacuucuugcaaaggguuucuaggcaaagguuuccccaguucaagggcauucacagcugcguuggaagacagaggggcacaagaaggcuggguuuggguuggauccagaguugaauagggaaaaucacaagcaugccuuuuuuuuuuuuuuuuuuuuaaacugcugaggaucccauggggcugacuuguggagccuccauuaggggcuagcaacuggggcaggagcugaugaucaauaagauuuacgacagaggggaagucuuguauuugaggcuaguggugacuuggauaacuuugagagauagcuuaguauuuccaagccucuguuuaaugaucuguuaaguggguacaauaguaaaauaacaacugcccaauccaacaauguggagaccacacauagguguguggcaggauccugccgugugaaaaauaauagacgaacaguagucaaacuuuguauauucaaaaugcuccccugcuccccugggguaaaggagacacucccccacacccucuccucccacuuuugccugaccuuaccucugucaguguuuagacaaagauuuaagaauaucagagaucagcauuuguauccucagauacccaaccucuccccguguccuugaguccaugacuuuccuuuuuauuggggagacucaaguccucugagaaguucuggagagaaaggagacguccucauaaccagaacagggauauagccagcagacugccauaaggcccuucccauggcggcuggagucuggcauuuguugugaauuaacgugcacuauaaguuguaccugggcccuugacaugagagacucccacaucugcaugggcccuggugggucaguggccaggaccugugugcgcauggucagggcagcgaugacucaauggacuugaaaagcuagcuuugcaccggguuagcagggaggaaggaucugucgucuaugggucauccccugcuugccuuucuggguuucacacgagguccaccuccucccgaggcugaggaacaccaggagcaaagcaagcacaauaggaaauguugugaguuuugagugacgccagaggcuuucuucgcuguuucucagcuguuguauuuuuagagacaacuauugucaccagacucccgagaagcuguuucuccuggagucccccauuccuagacaaggaggagccuccccuucucagggagggcuaggauuccagaagagccuaggucuggaaccugggaaauacccucuucagcacugaaagugucuagggaggcugagguuggggccugcuggccuguguggcccucccuggggcucacuggucaacucgaguccugaucccaggacuagcuccgcucuaagaacaagacaagaaaggguacugggugcugauaaacuccacacagcaucuugauuuuccaagcauacagugucgauccuuaccggucaaggaaagagaagaaguuuuaaucaucuucaauuccgcucccaagcuuuguaggcagggaauguuaggugcagagagcauugaucgucugaggccaugcaucaaggggcagaagagccacgaaacaaacaagggucucuugccaggcuagcucucaaggcacuaaacacuucuggcugaaggacagaugacaaccacacccacuggccagagacuggggauuucuugaguuucuccagggcuacaaagagacucccaaugugugaaaacaaacaggaaccccuuaccuauaguccugaugauuauuccgaguuuccaaccauuccacucuguguucccaagucaagucagugacucaagacuaucauuacccucacagugcucuguguauucaguggacacagcugcgugguuuuugucugauuguuuuuuuuuauggggggggggucuuguucugcaacccuagcuggucuagaacucacagacucacaauggauacaauuuuacaaugcuccuccugccucagcugauuuccugagugcugaaauuaaaucuucuugagacaauaucuucucauguagucuaaguuagccuuaagcucacaauccuucugccucugccuacuaagugcuggggucacagguauuugucauuguaucuaacuauuuuuaaauuggagucucucauacagugagagucugacggagagcugguauuaucugaaaugguuucuucccucacggugaaugccuugauuagguggcuggagagagccaaucaggcuccucccucaccccguguccuugcuuacucucuccuccuccuccuccuccuccuccuccuccuccuccuucuuucucucucucucucucucucucucucucucucucucucucucucucccucucucucucucucucccucccucucucucucucucauuuguuuuauuuuuguuuguuuuauuucuguuuguuugcuuguuuguuuuuuguggguuucuuuuuuugagauagaauuucucuuuguagcucuagcuguccuagaacuugcucuguagaccaggcuguccuugaacucgaagagaucugccagccucugucucuggagugcuaggcuuaaagguaugcaccacccugacuucuuuaagugcauuaccgcagggccaaucucugacagacugcuuacaugguagccagcuucugccauagcgagcguccaagaaaacagguuuucuggagguauuacagggcugcaucuggcaaaauucacuggccacgcucaagugauggaguuggcuccgcucacuggaaggcuacugcacgaggacaggguaggggaagcauauuuggacacugacuccugaaguuacagagugacugagggaaugacucugugggugggagacuuaguuugaagacuuaaggaccugcauuugagucccuggcauauguguacaaaggccaggcauggguugcaugacugaaacccuagcuuuggugaugggugggcagagacggguggacccagggaguuuguugaccauuuggcucacaaauuucaaguucaacgagcucucuagucaucguaagacagcauuucagcaagggaaauaguggaugucaccagacacccagcucuggccuccacaagugcauacauauguacacacauuugcacacucacgauugagcgcuacaacccacugcccaccaccucacauacacauagagaaauauauagaaguacuacucacgguagcacauaccuguaaccucagcacucuggaggcugaaacaggaggauggagagcuugagg

SEQ ID NO: 5042 - RNA, 20219 nt, Mus musculus
caccccagcgcuggugaucagguguguccaaagggaaccaagaugcuuagcagaagggcaaccucgagagauguuccagggcccuuaauggcugguggaacugaaguccaaggguucuguuacuuuucuguuguuacuuuugagacaagcucaucaacacuggccucaaauuuacuuuguagccaagucuuacuuuaagcuuccuuccuccugccucuaccggacaaaugcugagauuauaggugugugccaccauuccuggccucuuuguugcuggggauugaacccaggacuucaugcuugcuaggcaagcucucuaacaacugagcuccauccugccccaucuugaaccauccaguucuccagaaagaagucugggaucgcugggcacgguggcgcacgccuuuaguccagcacucgggaggcagaggcaggcggauuucugaguucaaggucagccuggucuacggagugaguuucaggacagccaggacuacacagagaaacccugucuugaaagggaaaaaaaaaaaaaaaaaaaaaaaaaaaaagaagucugagauaaaguaagugcucuccuugcuucuggucaagagcuccuccuaacaguccugccacucaccacucuaaaucccagggaauucugcaugugacuggaagugccaugccugccuugggugggggcucuuaaacucuaccauaguguugggugaggagcugcauagaccagcgagcuuaggucauaaggucaggaaggacuaggcagagcuuuggugacaaggauugagagacaaaagauuuuaagaaguggacauuucaucucccuuucauagaggaaccaaggaaauuauaagagggugucuuccugccgcgggcaugguggcacacgccuuuaaucccagcacucagaaggcagaggcaggcagauuucugaguuugagaccagccuggucuacagagugaguuccaggacagccagggcuacacagagaaacccugucuugaaaaaaaaaaaaaaaaaagagguguguccucucaguuggggggugggggccgcaggcuuuucaagagccaugugaagcuaagcaacagaagucuuaaguguagagaagagucuccagaucaguuccuguccagcagaagagggcacacuguggacauucguccugggcauaccgagcuaaugcuggccuaagaguuaggccuuucagacuuguuggccacaaccuuucucaggaaagauggaggaaagcuauaaccucugccugggagcccacacaucugugcaaggacgcuguguggcaagauaguccugcucagggaggaaguccuuuccagaauugcugcccuguguucaggcucccugucaccugaccuaauguuagugacccagagacucuggcaagaaggaaauucauaucauauuuuuauggugugaaacaggaauaaucaagcaggguucaugcaccauuuuauaguccucaaaacuaggcagcuauuaggaaggcaguguggagaaaugaaaauaauuugugggugaguauuuuuuuauuuuaauuuuauuuaaauuuuaacuuuaauaucauuaugaaguuacuuuaauaauaauuuaaaauuuuuccuguauuaugaaaagugcuuuuccugcaaaaaugagcucugaauuauauuugauuuagguuaauaucaaugcccuguacuccuugagccucugagaagaggugcuuuaggaagguggcaaguggcuugggugguagccaaaggguagacagugccccugcagguaauugaguuugaaaggaacagagauuguguguugcucuauugcuugggagguggccuagcuaaggagugaggguaugcuaugaaguccagagaacugggcuaggguccuggaucagccauugugaggccugggacagcaagaaugaccugcuguacugguuuguguaggauugaggggaucucaggacacgagucuucccuuuguuaaaacuaggaaggucuuagacaaacuuggacaagucguccagcucuuaaugagcugcuggacuguuccguauccucacuucugagaugcugcggauggcucugagaaucuuuguaagugugcugcaaacuccacuucguccuacuugguggggaugauggucacugcuuagguggggguggauucaggagaagggaaugggggaagggugguucuccauggcuuuaagaccucaaagcucaaaagcuugucuggauuagccccacagucuacauguggagaguuuauauuuaugggaaccaaagaggcagcucagcguuagagaccuagagaucugccuagccugugaggguuuaguccuagaauccagaaaaagaaacaguuacaaccaggugcugugcccccuuccuucugggagcaaagucuaauagggcaggcaggggucaguaaggaaguaggauccuaggaaaauuaggaaucugugggagugucguguguagggacauguuguuaguccaggagauugggaaaggcugggaagugucuuacaaacccucugaggucgggcauaugaacugggagccaaagugggcugaggaaaggcaggaaaccuacaagcugggugccuggcagaggugggcuguguaugugggguuggggcuugagcaagaggagagcaugagggaggggcugaugagauacacgggugccucacgggaggaggguggugaguuucucagggcagccgggagcugcgguaaggccuguccacucagcagccccucaccccacgacgguucugacauugcuuuauccugucaucuccagacccuuugaacauggcagugcuggcucugucuuguucugaaggcuuuugagccuuacccgccugcugcacaaaccgcuguagcuccugaugugguaugucaaucuaugccuucccuggguagggguccuaccaccuucgcagccggugacuccagaaugcugaguuuuuaccccuccccccacauacugcugucaccucauugugucugcgugggcuguguggcucacagcaauagugcucagagccugccaggcacucagacccggccgcugauagacaaggaacaguuaugcuaaucaacccaggaguggggcaggugaguguucauccacuuacgugugcauagcacacacacacaugcauacauguacauuuagucugcauggcauuuauccucauaugugcacugacacucaggcaagcacauggaaacucucccugccugcuauuuugggugaggggaguagacucuaaauuacauuagauucaucuacgacauuccucuuccaacacagacauaccuaugaugaaagcacuauuauacagccucaguagaugcuuguguaauauguuggucuucucauguccucagagaugcaucacaaagguuaaaaggagcauccacauccaugccuggcacguaggcguuuuguauuuuaauacaauacuauuaucuacaauugagacacuuuagugugugcacacauacucauagacacaugcggcguauugcuucaucuauugccuuccgagacaggugcaaauaugagaacuccacccuuccccagaacagguggguacacuucuauuuacaccaacaagcucacccuaacccugccagccaucuugucagcaacaauagucauagcaaacucagguuaggugacugcuuucuauauucccaaggccuuccaggcaugggaccucacuggggccuugcagcggcucuuggggugggugggaucagcaggcaucaucgcucuacauuuauggcugaugaaccagaacaagggaguugaaguuccucaucugggaggcagucagcagucagauggugaacuucgugguagugagcuuccuaugguccuuggaugcugguuugaugacuuccaucccucauuauggaaagcgguggccaugggcagcagcgccugcuggagucuugauucccggucaaaacguuuuccagagucagccagggccagcggagaagugggaauuggaggcugauaaagggaaaccgccaucauuagaaaucccauaaagucucauuuacaaucccugucagaugaaaggaacaauugaauguguuggagggaaaagcaaauaccaauuuccuuuaggacgcccagccucacacagcugauccagaggcuccaaaagggcauguguguguguguguguguguguggugugguaugagugugugguguguguauuugugguguguguguguguauggugugugugugguguugugguguguguguguaugugugugguuugugauaugugugaugggugguguguguguguguguguguguguguguguguguguaucuguccucccuuggcucccuccugcucugcaugcuuucuugcccuucuguccagguucucugugacucuggaggcucugguucaagggaagagaggauaaaaggacaaagaagggacauucucucccucagaauccacuugaauguuauacuugcuuuggcuaaaaugaagaagagauugcaaguccccaaacaccugccugucauguucucucagacccauuaagaggcccugagggcagcuccuuucaaagcauaugcaauauauaugcaguagggagguggccuaaugauggggccuggagaguggcugccacugcucuucaccaugcuuggucaccaccuuggaccuugguuucugcaacauguggccuugagggccgcaugagaugaggcaugcagagccugagagggcgccuggcaugcuggugaaccauacugagucagcccugcccucuguguugccagcuuccuggugaaugccuucacugacagcgcugggaggcggccuggagagaagcauaucaccaaccagccuccugggugugccuggcccggugaggguggcaaggagggaggaaggaggggcagggaggagacaucuguuugacacucuugucagcauccguuaccugguguguauuuucccaggagcugauuacauuacagcauguguugauaaacauuuggagucagagcagagggaacugagcggaaugcuaagcggaugguggcauggucaggagaugcggagaaagggcugacuuggaagagcaauaggagaugcuaagcacccugucuggagccaucuuagccuagcuggcccugaucucuugauuucuccccuccucugauguucugguccucaggagcaaaccaucuagucuuggcccagaauuagacagcaccuacagcagaagaggggugggacucagucugucauagaucccaguccuucuucugcaacaguuugccuagugguauucuggaccaaugccuuaaaccucccugagacucagacgucucuguuguggucuuaacauccacacuagaguggaggaaaggcuaaagaagaagcuauccacuaugcccugcacauggagucagguucuguacuucuuguuccagcuuacgaagacagccgccucagucuagaugucuggcaaccuuucuuaccacugccuugaccuaagagaggcauggcuguucuucuuccugauacagacuccucuccuuccaaccauggcuaggacugcaacauguacccuagguugaacaucgugguuauugucccuggagaugagcacuuggguuccagagcacagacugucaggucacagagcuuagcucaggguagaaaggacaggauaacucuuuguaguuuaggaaggacucaucccucucugggaccgaaucccuagcuuucccacaggaccuugagugauuguuuccugugugcagcucuagucucugaaguugugacuuucuugaggacaaaggcuuugagaucuucaaggaagugugacugaaucucuuuccaauguagacuugugccaacuagaacgagugacuugguaacucuggcuuccaaugucccucucauucuucuguggccaccauuuccagaugcucaaaugccuccucaagcugcugggcuugccccaagugggaugagcacaguggggucagcgccaucuagcggauauggggucacggggacugcacguccgagucuuucccaguguaugggacccaggacuguacaccacugcuugauggggggggcgggggaggggagggauacuuuggccacugccuauauugaccuucuguucuuugcgcugauugaguguacagauguuccugcagagaacucuuuccgaguugagggacacuucgagggcaguaggcccgagucccgcacccuggugucccagaggcagccuguaccccucccccaacacugcaaguccuacuccccucuucucugugccacaaagaggccauugauuggcaagaguagccgggcuaugguagggaagccgagggaacaggcacgcgugcccucgugcaacuacacacacacacacacacacauucacauucacgugcuacacacgcacaaugccucuuugcagccccaucacucugcagcaggacaggacagagugggaacuuggugugaagaaagagcucugccucgugauagcagguuucccguuccucacccuccacgacucauuuuuguaagcgucuuuggaugcauccuuagcacuaaaccuccauucugaccagcuagccacccccaucccaccccucccucgcgggcucuccacucccugcaaagcuuuucaguggcacuuaggagcccuuuuuaauaccaggcgaagcccauaccuuugggaaagaggaacugcuaugugcagcggcugcaaagacaaauacguugcagcaaagcacauuggcugcuguggcucaccuggcccuccccugggaagcccagaugguguggcaggggaggagaggggaagagagggggagagcuggggcagcuccuccuugaugucuugucuaucucuuuaauuggaaaacugccagggccuaaggauggcacuggauuugugucuguuuggggugcuuucugacccauccacaaagggcuuugugauucccgcugggauagcaaaucauccaccuucugggcuggguuuccuaucguuacaucuacauauucaaagagcaggccugguucuuggacccugcccccaaggccuccagcugggcaucugggggucggggugggggcaggcagcugauaagggugugacgagcugugggagugguaggaaacaggcuccuggacuugguccuuggucccucccucagcuccuacuggccaccugccacucauguguacacaggaguuggcuagggggaagggagggcggggugcuggcuggcagaguuuauaauguaucuuccuguuauucacaggcaguguggaggggcccagagaagugaaggugcuuaucugaagucucauagccaggaagcagcuaugcuucaagucaaagcuagaaagaaguguggcucugucuauguuuaaucauauauguguguguguguguguguauacacacacauauguauauaucacauauauaccguauauauguguuauauguauuauacuauauaugcuauauguauguauauauguauauggacugaggggcagacaggauacucauguucagagaaugagugacauccagagaaagaguaggcaggcacccacacauguauguuuauuuucaacacuguuuguaagaagucgaccuuaguggguuccuaggaaucccagauaaggaaccuugucaggaauugccuucuccuccucccauccuuuucuccaucuccucuuguuucauucacccuuguucagggaugaacccagggcuucacacaugggaagccaaugcucugccuccgaaugcuccagccagaccucucuccucuuugucccuucuuguaccccucuccaccuaccuccaucauugucaucuucaucuuugaaaaaacaaacccaaaccaagccaauuuaaaaaauaucuuccucuguagcguaagcuaguccagaacucaauauguagcccagguugacuucaaacucacaguaauccuucugccucugcugggauuguaggcaugcaccaccaugccuagcuaaauugaaaaccuuuuuagcacgagguuuucccaagcccaguaacuaacucuaccugggagcugccaggccaagcagagucacuacccagacauuacaugcgugcucgcugaggugguguagacggaaugugguugguagauaggaaauaaauaggggcucuguauuuauguuccgugccagccacaaguucggcugugcacgguucagggagcuuuauguccaauuuuaugucuagacagcguuugggaugagguuaucaccucuccucuaauuggagcaggaaggcuuccccggaugcugcuuucgggaugucuccugcuguccuggcguucccaucuguccccaagagcaagacuuggggcaagagaaccaacaaugaaauuguagucaggaucuguacauguuuuuucagccuugauuuuugucaccagauagccacaugaccuuggauaaaucauccucccuuuggcucuucacuuccucauuugcagccuaaaggggaaagcugguucuucggguggguaugcccccugaagucugccaaaugggaucacugugugcagauaggcaggcuguauagugugcaaagauacccagccaaagaguagacaggagcggaaucuagucugugagcucaucaaucuaugugcccaagugggccugcauccacuuggcaaagggaacaccuuuucuaauucaccuagaggugcuaaaugggcaaguagugaccuugcagaauccucucucagcuuggccuccugcugguggaaugggagugcccuagggagggcuuuccaggugagauagggguggcaggggcagaucaaggccagugggaauauguuagcuuggagcugaacuucagagguaaggaaacuugggauagugaggccacccaggcugccagugucuccugcauggguccuuugauagauccuugugccucuuggagcagggguuuccugcucugaucucacagggauuugcucuagcaagaguagcuuuccacugagcucucugcuggaggagcccucaggauccugggguuacucuuuaaaggacaucuccuccucuaagccccuggauuuggggccuauauuaauuccuguucuccuuccuacaaaaaaguaccauacaaaagcaauaaggaagaaaguaucuguuuaggcucacgacuugagagugcagucugccgugauggcagaguuggucguauugaguccacagucaguagacacagagagaugugaauguugguguucaucuggcuuccucucuuugccuuuuuuuauuccauuugggaccccaguacauuggaugcugcuaccuacguucaggguggguccuuuauccucaguaaaaccucucuggaaaugcccuuacagauacucccaaauguuuccuaggugauuuuaaaccuagucaaguugacaaugaagauuaaccauugcaaacccaccccuugucaacuugaugcucaaauauaucauuuuaaaaaucauaacauuccaccccugguccucaaagcuucaugggaaucucauaauaaauuguucaaagcauccuccgagacucaaggcaaucucuuaacugugagcuccugugaaauaaaaaaaaaaaaaaaaguuaauauacuuccaacacacagugacacagaaucaacauuccuguuuccaaaaaaagagacucggaaguauaccgaggagagccuggaccaaagcaagacugcgauccagcaguucaaacacugaaacccacagauacacaacuucugggguuauggugacaucaguugggcucccugugugcagccugcuucuuuaauucuguugcaugcaucacacguagcuacucucucagcuuggugccaccuaguuccuauagcuucccucaguagacguccuacccuuggaauuccccaaaaccagggauccucacugcaaccuuagguucaucucuguagucuccugccauugccucucaggccucccuugccugaaaauccaacccugcuaugcagcacauggucucaguagcuuucugaaaccuuggugcaaaucacucaugaucuuguaacccuuguauuuuacacgccugcaaacccagcacugugugggugcugcugccuuauucugcuuugagcuugaggcguauucugauccccguagcugugccagcaggagcugaggaaguuggucauguugcauccccagucaggaagcagagagagacgaacgcucagcuuuucccacuucuagcuuuuaaauucaguucagaacccagcuuaugggauaguguuaaccacauccuuucuggguaagucuccuuuccucagucaacggcucuggaaacacucuuacagacaugcccagaaaugugucuucuagacuauuucaaauucagucccaggugggcauaguuaccaaguuucaaauccagcuccugggaggcagaggcagguggaucuccgugaguuuaaggcuaguuugguccacauugugaguuccaggauagucagagcuacagagugagacucuaucucaaacaaaacaaaacaauggauucagggggcuagagagauggcucagugguuaagagcacugacugcucuucuagauuucccgaguucaaaucccagcaaccacaugguggcucacaaccaucuguaaugugaucagaugcccucuucuggugugucugaagacggcuacaguguacuuacauauaauaaauaaauaaaucuuuuaaaagaaauucagucccucuggggauccugugguaaauaaccagccacggaccuugccagcagcaagcgcauaccacuuagugugcuguggucugacaggaagugucccugucccagggacaucuaaugagcaccagaccauucugguaucuacucugggcucagucuaugaaaggcuaccaaguagaagauccacagggggcagauguccacagcucuuuccucucuagggaggcugugaaguuacugaggggaaagaaagcugggaucuaaagcuccugcaggagaaagugugccaggcuggaggcccugggaaagcgucccuuucgcuggugagacuaguaacugaggaggggguguuggggaggugaauucuguggguggagugacccauaauuggcuagccagacugagguucagggggccaucucaucuccuuccccacuccugccuuuagcugacaauaggacagaagaauaauuaaccuucucacuuacucagggcuucagaguaaguccuacauuaucugggcaccagagaacuccuccuuuugucucacuccaagcgccuuccuaaggugcaucuuguucuuuugcacauugcacagugggugcaagguuugaugccaagggccaagccuuucccagccaccccgucucccuggcaguaucauuguaagaugagguacaauuaagcucccagcugucaucucuguagaggcgaagauaggaccaucuuuaugacugugcuagaugggcccaccccucucucccgggugcccaccacuccugcucuguaaaagaaagggacagcagggaugcugaucgucugucuuauauuuaccaaguguaacgugccaagugacauuuuucuuuguggcucucccuacccacuggcagcgguacauucagucuucaguccccagaagagugagacacgcguucugcacaguucacauaggaagccacugugcagcuuccauccaguccaaccauaaagauaacggaagugauaaugagaugaugucuguugagcucuugcugugugccagacacucccaaaguguucagcauggguaugcgcuuccuaccaaugcuguaacaaauggcucaaacucaggagcuuacagcaauacccaguucuucucuuacaguccugcccaggguuagaaaucugauacaagauccucuuggauaaaaccuguuucugggcuccagggucuagguuaggcucugaucaaaagaggcaagagcugggugucuuguuucccaggggacccugcucuaucagcuccaaguggccaggcugggucagcucugggcuaauggggauggcuuacugcuucuggccauccaucaugacagaaaaugggccuugggcaagcuugggaccugcaaaucacagaaauuauggccaauuaaaggggugaagcagcaguccaugguggagcuuagggccacagaggcaacuccggagcuuuauggacgcucccucccauuuugugguccaacugggaggcagaaacaugccagcucagcacaaggccacauucagaugcucugugugagacagggguggguauccuuucaacaggauccaguuuccacuugcugucucuuuugaauauucacaggaaccucuaauaucagccuucauucuauggagcuuccucuuagccucuugcuacaggcuucuuucucuccauacccgcucuguccuuugcauagaccucuggaggguugagccugaggaccgaggagugggggguggggggaaggugugagccugucaaucgccuugaggcucagucgggcuuaucucugcuucugccucccugugugcucauccccacaccagcuagagagcucuuuuuacuucccugugggucugacucugggacaaacugguugucugcuuuuauuuucccaggagaaaggagggguggggacccuuugcauuugggcaccuguggcaagacagugccagaggccaaucaacaaaauccaaguuaauccuccugguuccagaguccucuacagagccugugggauaaaguugagcuggguauuggccacauucucuguguacggggcacuaugcuaucucuguccuagguucuggguucugggucaagccccuagugcuggauugagguugucuucugaagagauaaacccaagcaggcugguaagagggaguuucaguguucgcuaccaucuuucagaggccucugagcagaucuucagcugauucuuccucaucaccagcaacagaagagcccuggaauucuggccaagcugguggacgacggagcugagcaaggcaguaccccagccaucaugagccugggagaaccagaggggaagagaaagggcuaagucugagaggaagcaagaacccuuggauucuuggagauaccuggucgaggcagauuaugguagggcaggaugggcucuggguauaacggccccacccacuccuggacuuaucucuccugcuucugaggucuaggguuugcuaaagcuccgauuuuuuccagucugauuuugagcaggaagauuguugaccuugcguagguggcauggguuacgauggcgaugaaauaauuuuaagaaugcacaacauguagaaagggaagugcuauguaaguacuagcuauaauaauuaguauuacucauacuauuuaaaagaccauauuaucagccagggagauggcucaguggguaaaggcucuuugccuugcaagccugacaaccugaguucaacccuuggaacccacaguggaggcagagaauggacuccccaaagcugucuucugauacacacacaccugcugugguacguucaugcgcacacaaauuauauuugaaaaagaaaagagaaaaccauauuauauuggcuuaagguggcaaagucuggaggaggagauacaggaaaggauaugaucaaaaugaauuauguccauguacaaaauugucaaagaauauauuuuaagcaauuuuuuuuaaaaggaaagaagauugcaggguuuguuguauaccuagaggauuccugucucagcugugaccuuggcaaagugauuacacuuuucugagcccauuuuuucauugacaacguggagacaguaacuguaaugagaaacaguaacacaccuugcagaacacacugauuuuuuuccuccugauggggcauuggccugggacagugggagauaaacagcccugacucacaaggaggucaguugguacaggaaguccgcaggaagaggacccucuuacaacuggacaaggggaauccuggaagcaggaagcuugccugguucugccucacaucucccccaagcccccacuccuccacucugcccaaaaccaccagcucugcugcccugggacuccaaaguguaguaguagcagcugaggugagaucucaguucauugaguugcaugggccuuggcuagaucagcaggucauagcugggguuugaccaccuuauguccuguggauucugauaagcacacagaugugcagacucaguggagaugugugggacuugucccuucuagagagccuggucugacuuugugggcucaucugguguccuguuaaaggcccugaaagugcuuuguuguuguguuguuguuguuguuguuguuguuguucuucuucuucuucuucuucuucuucuccuccuccuccuccuccuccucuuccuccuccucccccuccucuuccucccccuucccccucacccuccccccuccuccuucuuuuuuagaauuauucauuugagccagacaugguggugcacgccuuuaaucccagcacucuggaggcagaggcaggcagauuucugaguucgaggccagccuggucuacaaagugaguuccaggacagccggagcuauacagagaaacccuguuucgaaaaacaaaacaaacaaacaaacaaacaaaaaagaauuauucauuuauuuuauguauaugaguacacuguagcugucuucagacacaccagaagagggcaucacaacccauuacagaugguugugagccaccaugugguugcugggaauugaacucaggaccucuggaagagcagucagugcucuuaaccacugagccaucucuccagccccuuuuauuuuguuuuauuuuauuuuuauuuuuuaaauuaaaaaaauuaauuauuuuacuuuaaaaauuuuuuugcucuguucuuuaucugcaucucgauuuguuaucuaugcaguuuuuacaugauuacugagagacugaguugggauggaggucaguguagaguguuuccuuggcaugcuagaggcccuggcuuuccucuccagcauccuucccauggcagcacaccuggcagaugaacccaggacuuuuguuuguuuguuugauaacugaauaaauaacacucgcagcuaguacuuaccuaacuuuuguuuugcaccaucugauacucuaagcacuucacaggucucuaucaaauuuaaccucaugccacaauaugugacgguuuauggcuauaaucccuguacuugggaggcugaggcaggaggauugcugcauguuugaugccagccugcacuacauagugaguucuaggccaguguggagcgaggggccagccucaucgcuccuggcuuguguaccuauuccucucagaaaccucccauacaggguguggcagacacaagaagaaacaagaucucugcuaacuucccagcguuccuucuucucuuuccugggacgcuugcucaagggaaggacaagucccagcacagaccugcuagccuuagcacuguguggguccugugggucacagcugugguggggagcaagguaggggcaggagauggaggggaccuggaccagugcagagcugacugacuccugagaggggcagggcuuuaucccacagagucuuuuuuuuuuuuuucuuuuuuuuucugaucucugaccccucacuuccaucuccagaguucacugucaucuccaagccaaagggagccaaccuuggaagcucccugcucugaccuuuugcuggcugaaggccgaaugcuaagacugaccucaagaugaggcagcagucuguaugcugaucucugcuccagugucaaugcacaggccucuccaggaaugagagucuacauuuacaacuuggugaggugggaccuagaacacauggcuucuaaggucaccuccaguuucaggcagguggugugacuugggaagucccugggaguuuugaccaauuuacuccugggagagugaauuagaggccgaagaggaaguguuugcuuuguaguuggugcaaugccaggggcuucacauucuuuaucucauuaucucauuuaaucuccuacaaaaaauaucuauucaucuuuuaaaaagaaggaggaggagaggagagaaggaguggaugaggaaggagaagaagaggaacaagagaaggaggaguaggggagagggauacaaauauuauuauuugaauuuagucacaugaggcugaugggaucaggacaugcauuugguuuagugguuauuguacuggauuggaugccauggcugucccccagaacagagagacuugucccagaguuggggauggucauauuagugccuaaggaggaagaagucgagggguaaggagcacccuggguugaguagucacugacaggggcugugaguuagguccccagugaaggagacucuggcugcaagugucugacccucacaagugucagaguacacuguaggcuacugccugcaggggcagccacagguuccugaggcacauacccaugugguccacaugcacaggcaugcucuguccucugcugucacagccugcugucacagacacaaacaagucuguucuuggcucacucugacagcaguucaacucuuggcuuuuuacuugcuuuucuuguuccugguaccaccuacacagcacagccuguguguguuugugugugugugugcucaugaauacauauguguaucuguauguccaugugugugauuguccauguauuuguacacaugcgugaacacauguaugugcauaccuagucuguguguauuuuccuuggccuguggaauucucugcuagccuuucuuggguucccacaaauauuuucauacaguuugauaagcacacacacacacacacacacacacacacacacacacacaacuucuuggcugcuguuugcuggucuuuccaucuaguccacagaguucuuggcucuggagaaccuuaucaucuuaagggccuggguguguucucuguugucucucucucuugccuccugccuccagauuucccagugggcucagacugcugaggaggcuugucaggucugguauugaccuugaaaucccugugacucuugggccacucucaagccugacugcaaguagggcaggcucugucccagaaguggcaucccuaggagcagcuggacaggguauggcgacguggguggggacagcauggcuggaagggauuugucugcuuuggauucuuuucugugaaauuuuugucucuuugccacgaugcuccauucauuucagcugaugucacuguggugugugggagcgccuuugacaucuguguagagcugaggcagauccugacccaggcagcaggaaacccugguucuaguaguagaggaaucccugccuuuuuauuagauccuuuaggcccuagaguuuggggcuuggaacugaggguccagaacuaugaaacuuugaggguuggggaaaugacuuccucuuccucuuccucuuccucuuccucuuccucuuccucuuccucuucuuugguuuuucgagacaggguuucucuguauagcccugggauuaagggugugauccacuguauuuagccgugagaagacuucuuuuauucaaauucgucugucauucaauuugcccuggucauucugaucaaaacucucucagugacuuucuuguacacacagacgucacacauguuuauauauuuccucccuugcauguagacagggcacugccuagcccagcuggaccccgggauguuucuggagggggcucaccaguaagggacuuaccugaccuuucuugggguugaucgguuuccaaacuucuuccagcuuggacacucgauggugauuaagucuugcuuagacaugaaggcaagcaaacccacaaaagccaugacaaugauggcaaggugagcccugcccagucucugccagcuacauagcuacaagcuccugcuugagcuuccuguaaacacaccuuauucugacaaaacaacucaaacccaccuaccaacccucaccauucuccccucucacaagcucuuuaucauaguuuccucagcagaagccucagcaccaggugccauauuagaaaugcagauucuuaggccagacaugauagcguaaaagauggaaagcugugaucccaggacucgggagacaggcagaaguucaaggccagccaggacuacguagugaacuggggacggaaugcagauuucauguucauuacacuagacuuuccagguuccgaagacaaacagugagacuuaagggauuucuuucagaccuacugagucagaaugguggggguaaggcccauuugagagccaaugggcuugguugguacaguucuccggcuucucuuuacagaugacaccugacgccuagagagcaaagcucaagguuaucauguggcaucauggacaagcugcaaugccagguagcccaccugugauacgggagaggcaaggcuggggugggggugggguugucacacaccucucugcuccccgagucaguaagagaauucagcgguggguauguuuggagauguuuugcuucaguuaugcugagggauacuuccaggcccggucauucaaggauggcugugcacaagagcucaguuggaguggagacuuagacugugacuccucaucgagucacauaugauacauaugugucacauaugauaagucuggcuucugggaaggggcacauuuaggagaacagaagcguguuucaguacagucgguaagaggguacacuggggaacagcugggcacagggagggacuuagucugagcacagugaagaggggaguguucuugggguacagugguaguagaggcccugcuaccaggcccacagaaaaacacggacuucucucucauagagccaggaaacauuuaacaucuccaguuaauuagccagugccggcuagggaugagggaggagaggguagcuuggagccaggaggcuuugaaaaggaaggcugcucccugacaaagccaaagccugccugcaagguuucaaaggcagcuucugagcagccucugcguuucauguucauuaccccagcacuucccagguuccaaagacaaacagugggauuucggggguuucuuuccuuuuuagagucauuacauucugagccgggcuuucaccuggggaggaggcucagcagcugagcagcuugcccuucccaauuccccagccucuugguacccugcaagcuuccagccccugcccuaccugcuacuccauagcuccacgggguuccugccuccaggcugggugaacagaugccucuggccagcugugagugaaugaugugagagagauacaguccuaguucugcuggaucccaagcucucugagggcaggauccggcauccuucugcauuuaaaucccacugcuuguugauggucagcaaaugggagcauggauggaaggaugaaugaaugugcccaucaucugcuuccugaucauauccugcucuucccagcucugguuuguaugacccaaggaagcuucacuccccagacucucuuaccuucuggcuucuggaugaguccagucaguuaaaggcacuggaagaagguggguagagagagaagccuagaucuuugucuccauggggcuguauuucuacagcaucugccucuccuccuuggcuucugccaauaagccccuccucucauauuccaguucucccugguugacuacaguggcuccauguucuuccuggucaucucuguguugagcucuacuuacaacauuccccaguuccagccccaggaaggaaacaguuuucuauguggcuaauaugggcucccuaccucucugucaucagacagaauugaguccaccaauuaaauccaucugcuugaaaugcuuugagugguuucugauuugucaguggccuugggggugggguaaauaaguauacaugcugugugaccccuucagaaacagauuguacgugaacuuucagcuuugagugggcucgaucugcuggggaccccuagccccucugaugcggccgcc

SEQ ID NO: 5043 - RNA, 2830 nt, Mus musculus
ugaaaccgugcagcaccuuuaugcaaucaucacauauaacgcaauaaucagcccgggaucucaaacuuuuuugaacagccaaaucuucaaacuccauuaagagaaauacuuuucagaacggucaguguuuacaguguaugaaaacaacaugcuguguaaacauggcucucauuaaagcugggaguuaggacccaaagauguuguagggcucucaaaaugcaauuugaaagccagugggcacaucagccuccucggucugcagaugaggagaaaugagacccagggugguuaugugaucggcgaaaggggacagaggacacaggugagaagacagcccauuuccauucaguguucaguggguaugaggugugcuuuaggucccagggauaagaaagagaauaagaugguacugucccuguccuggaguagaucaagcauuggaaguaaucaucaguaaggcugcagggauggaaagggggcuguggggaaggcagaggagacguaaguaaacugaggccaaagagaagguggcugaccaaaaggaccgugagagaguugcacaggaaauaaauucuaugaccagcagcccaggacccuauaguaucucagacucaaagcucuagggcagagggccguaaggcuccagaagcaggcuagauccaacaggcauggcagaggccgugacaauggccucagucuggcaggccagggaaggguucucaugcauacagccugucauugguauuagaaggccacuugcauuaaaugccacguggugucccgauuuggauccuagaggagaaaauaaacacaagugagaaacuugagagaauccacauaaauucugccguucauguacuagugauauaggaaugcugacuucuuaguuuugcuacagguaucacacaugagccauuaacuucugggaacguaaguggagggcaaaugaaagccacacgaucguuuuuugauuuuuaaggauuuuuuuuaauuaugcuuaugugugugcacauguguuugugcacucagaaaagcagaaagguguaucaggucucuuggagcugggguuccaggugcuugugaaccaccugaucugaacucugggaacggaacccagguccuuuggaaaagcagcaaagacucuuaaccacggagcuauuucugcagccuuuuuauaccuuuuuuuuuuuuuuuuuuuuuuguaaaucuaaaccuaucucaaaauaaucuacacuugaaauguacaaaaugggaaugcaaugucuguaucaaguguauaccccuccagcagggaagaacaaaacuguacguggggacacagauuacaggaucuaugaagaccaacaugggcacaguuuucuuuguacacuaggcaucgucccaagugcgucccaugucuaagccucacaauccuugggcuggcauguggucuacuccuauuuuacagguaaaggagccaaggacacagaauuaaaguuaggcugaugguuuauugcagcccugaaggaugaauuagauuggaaccaaaggcaagggaaagagaaaauuaugggcaaaugggaccagcauaugcaaguguauagacugagcuugucuaaagacccauagugacugaaugcuauugcuggaagacgauuacugaaaagagcuggcauuuaagaauuuggauccagggcugaagaggugguucagcauuaagagagcgaauauuguuuucccagaagaccugaguucaguucccagcauccacuuguaacaucucuaagagcucggaugucuccggacacuuuggacacuguacuuccaugcacauacacacaguuaaaaauaauaaaauaauaaaagcacuugaauccagagcuggccauggugagacacagcuauaagccuagcccuagcgagacggagacaagagaguaaaauaucaacuucauuuacauagcaaguucaaggcuagccaaggucacaaggagauccugucucaaaaaacaaaaccacaguguggugggccaggccaguacucacaguacucaggaagcagaggcugguguauuucugugaguuuaaggccuucugguauacauagcaaguucaaggacagugaggacuacguaaagagacuuuaucucaaacacaaaacaaacuaacaaacaagaauggaaucuuuuggauuggagagcaaaagaaaaaacaaaaaacaaacaaacaaacagaaaaacccaaccgcccgccucuuaagccagguguaguggcccagaccuuuauacugugaguucaaggacagcuuggucuacauagugaguuccaggagagucagggcuucagggcuaccuaaagaaacccuguugagaaagagagaccccguugagagaggagaagaggggaggggaagggaagagguaggaggaggaggaagggaggaggaugaggaggaagaagaggaggaagaagaggaggaggaagaggagggaaagagagagaguugaaucaaggaauucaagcaucaaagucccauguacuuggucaauauauuuuccucuuuguccucagugugaggaccacauggaaauuaugaguacagggucgagguggacaaaagcagaagugagaugauagugccaucaugcaggaauugagauagugcuaucacacacagggcacagaaacagcagagccaucaaguucuuuuugucguuuucuuuucuuuucuugguugguugguugguuuggguuugguuugguuuguugguugguuguucuuuuugagacagggcuucucuguguagcccaggcugucuuggaacucacucugcagaccaucugccuccug

SEQ ID NO: 5044 - RNA, 63480 nt, Mus musculus
agagggagaggagagagcgcggcucgccucggcaccggggcagcuccacauuguugcggaucgcccgcaccgagcgcagcggccgcgguggggacccguggcgcacccggcucgcuccccucgguccuccgagaccgugcagccccgagccccgcgggcagcuggccgcccuagccgcacaccaccgccugggccccgagcccuccgcaccgcccggccacccucggagaacagccggccauggacgccugcaaguuggagccgagcgggagggugugagcgcgcccagggccgggagccugcgccgcgcuagcccgguagccgggcgcgccgggggugggucccucuccccagccgggcuuugcguggaagaagagggcggggaccggggcgaggagaagagcggaggaggcgaagggggcaugacucgugcaacuuacugcgggcaucugccgaggcucugagccggcggcagccggggaccggauugcggccgcgcggaucccacccagcccaccccgccccgaccgacggcugcggcugaccuggauccuccgagcgcccgccaaccgccagcgauccgcccucgucuuccagacugguuucuggagcgcgaggagcgcccuccuggcagccccuuucgccggacccccaccccccgauggcucggauggggcuugcgggcgccgcuggacgcugguggggacucgcucucggcuugaccgccuucuuccucccagguaaggcgauugccucugccucccuccauagccccccacccaaccagaaccuccccgggacuuggagcuggaugaugggcaaggcuacggguuguagggagcgaacggagccagaaaaguugggucacgcuuggauaagggggggcaggagguggcaccguggagaaagggguugagaagcccaacagccugcccugcaggguagcaaucggaugcacgucucuauguagcaagaaagcacuuucuccgcucaguucuucacaaaaauaauaauauguaauaggguucuauuuauuuaauaaccaguucucagcucgagaagcaguuuggaaacacugcguguuacauaaaugcaaaauaaucaccguaaucacgggcuugggguaugagacaacagccccagggggagggcgucagucuccuagcuggugggcugugggcuaggagaguggcggggguugggggcgacuucauuucuuuuggcggccucuugucagaugguuucgggcucaugggggcccccuccugccccacaucgccccacagcgggcgaucggaaccugcuccugcggcacaggcagcuucuuacucaccugcgguuccuuuucuggagggugaggucgggccgccuagggaucgcaaacuccgggccuugcgcggggcugggcuccgucucggaacuccacuucuaaagcggagggcucucccaggaggaagcuccacgggcuucaugccagccagguggccgcaugacccacuuucccgggaggccccgagggugucccgcgugucuuuccucgaggugugagcugccggcagaagagggguuaacuccgcgcccgacccugggguggcccauauuggccuauucugacggauggggugggggcgggcggaggcuaggacggcccaggcauauugugcuggggaaugaacuggaaaaugcguuuaggaggcaaauccuaccgaguccccucgccuggguuuaaccccuugggucccuggggaagcaacuaggcugccagcaggacacuaauucgggucaaaguggggagaguaucucgcuagccaacucccccgucccccguaaagaaaccugagacaagcucuugagauaagauggggucuuggaaggcuuguuucguggucgucaacucgggguggcaaaauagggggcuggaaugcagacagagacuucuggauuauuaagaauauuggauucccggccacugugauucugcaggcuugccaggcaguuugguaaggagagguaggccugccuguccagguguagcuuggacucucuccuggauggcaagagccuggccuccucugcuucccuuacugccuccuccuccuccugcugccggccuucuccgugcuggggcgcugcaccucuccagcagugguggaugucaggaaagcaguuugggaaagccaguaccuaggccaguguggagugcuccccucuugggugucccaggaagggacauuccacaucccuuuccacuucacaggggcaugcugaacccgugggggcaugcugaacccgccgccacuguggucugggugagagugacagccagucggcuacuuucuugcugauaguguuaagugcggugcacacagaaacucagccucugaauuuacauggucagcauaggcugaacuucagaacgccuuuuaauucccuaacucuuccuggaacccagaguaagccacuugccaagagccccuaaggauuccuagcacacuagggguuaaccuaauccggggauggacaaagggccagaggguuugcggagggauaagcucagcacauuguaucuggugcuugguuccccaguuuuggguuggagcagguuaauuccauuggcgggagguggggguugggguggaaggggggguugggguggagggggggcggguuagagacccauuguacuccacccacacaagagguggagacagaggugacacucaccuggcucaaagcagauacuccccaccaaaaacccaaccgagaggcuaggaugcccagaauggagucacagccaagagauauuuaauaagugcucugccgcugaccaugaccgguggacggguacagcugaggcagccaaaguucgccaagcucuuagauggaaccugcuuccguguaccugcugccuccucuacuugcuuucugagguccacgguggccaagagcagguggauccuuggacugaggaagcuaggagacccccauuggcaacugguccucacuguguccgccccucuccaguccucugccuuucucuggggauuugccagucugcugcucucaccuggguucucagagcugugacagggagcauuggggaaguggggaggcaggagcccccagcgugugugguggcuccugacuuuauaacacggccaacccgguucucaaaguacauuucuguauggcagacggugcaggcagaauaggaagggcccgggagcuucgucuuuguuuccugggaugacagaugacuccuuccagggcgcucacuuagaguagagggucagugcuacccacagagggcuggaagccugaagaggaagggguggagaagcugucugggaaguaagugucccaucuuugccacacccucucuaauuggcuuccccacaccuuuggucuagaaagaaaccccacacccuaggugucaagcucaccaugcaaaagccugccaggccacagagucacaggcuauaggccacagcgcucaucccuuucgagcuaccugugcacagcaccaauuccuggugcuuuccuuugaagcccccagagccaagcuauuggguucuuuuucucuucccuguuucucacagacauggugggcuugggcuuacugggccaggcauuguggcugaauccguucuuuugaccuggggcuugcacuguaaaaaacacaaccaucuccaggccuaugagucgggaagccuuccggagagcaucuucugagucagauccaaggccuaacugucaaggccggacagagagcuacacacuacagaguuugggcucagcaggccuggcuuaguggcccagaggggggcuucugaaccuagucaaguccgcccgugggacauguagucaguggcuucccugauacaagcugggaccaucuguaggcugcagguuccuuccucggccacuuggcucugcacagugaguccuccuaggagaucgccugggccgccuggccuguggacccaguugucggcugccagcauggcugugaccacagcugagccagugggucgggagggagggccagagggucggcucccaucucugcaucuaugaugcugccauuguuuagcagcugacuaauguucauuguucagcacaaauagaaaacacccaagggaggugugacuauagcuuagacucuucugauuguaucuuuccugguuaacuuagcauauugaacaccuccucacugaagaaggggcagagagguagcuacaaagucaccuguugggcuuuuguucccuuuccuuuccuuuuuucuuuuuuuuuuuuuuuuucuuuuuaacuuugaacguuuagccggggcuccaggugagaaugggcaguaggcagcugugggacuuagccucuaacacuucuggcaggcucuccuuuggucuagcguggguguauuacgcaugugcacagggcuuugugugaugguguuggucaucuacaauuucacuguuacaaguacagaucugcaggaacuagaauuagggaguguauauacucauguuugcagauuaccauggaccuggagcuguaaguaccaaaugcuuguucacacauaacugauuuuuuacggcauucagaaggguugcacgggugguucugagccaugaggacgccugugacgaugucagugacuugagggugauuuggggaggagacccaggauuugcuuaagagcuagcaaggccagcccacuccagugaaaacugcuggauccuaguccuuuggggcauaggagaccuugagucugcucccugcuucucuguccuuggccuucuacuaaauccuugcugggaggagcacaagaccuugacaacaccuggaaaggcucccucucugucuucuguugucuccuuggccagcggagcaaugcuggagucugcuccauaggcucucaagauccuggaaagucuggugggaccaagggacauagguuuucaguucuucaggcgccuuugcuuccugcacgagcacuuaggaaaaggaauuuuggaaauuagguaccacacuauucucccccccccccccauaagaagccugcagagccaagaggguggccaggucaucaauaugaaugcaccugauaggcuugggcagcaggagagagccugcucguuagaaaaggagguggcagcgagggacauagcacagggaagcagcagucucaggagcuuagacuccucgccuaaaccuagcaggcauguauccccaugugcugccaacaccacuccauagagagcaggccugcagagccaacagcagaugugcugccuggugcaggggguaacuuaagauccaagcggaucaccuugcagagggaaugcccugagcuggagauaacaccccugcauccaguuaacccucuaagcuccacgcaccugguggagcuggaaggagaggaaaaggaagaaacaugaagcugucagaaaagcugucggaacacugaaccuucgccacauagaggcaaacccaguauaagagaagagacccaagcagacacagauuuugugauagcagauauagggucuugagggcaauaguccccguccuggaaagugcagaaggggagcuuagagguguauucuucagggguagggcacggggaagcugggccuuucucugucucucuaaguagagggcagagaagccagucgcuuagcuguccuccuguaaccaguucuucgccucaucuugguggcccagccuaguaaaacuggcugagcuagguuggaaucccagcucugcggaugacugguugagaaaccuuagcagagcugcggcaugagccucaguuuuccuaucugcgagauggaaucccgguggugcgcuaucccagauuucaagaugagauggggaaugaugacagaaaaagcucuugacucaaggcuagcaugugauaccacgaaacaaauggaggaccugggcucuuacccugugucuuuccucugaaugacccugccucucauuggcuagcacuaccuuuaugcucuuuugagaaagccacuuagccgccugcucauugccagccuuacuuccuuuuucuccaaccugguacuaugggaguaagucccugccccuauuuggacaugaugcuccagccaccugggagccgcuggcauggugggaggacucguguggccugaccggcugaagcuaccugcccaggccaguccuguggaggccugugcugcaccggcagcaggugccaggcagccuuuguucugcagcuugucacucagggcucuccaggcacccgaguugcucccuggaugcagcccagcuggggcgcccgccauugcccaucuggagccuuugcugaggcagccaccaggggcugauggggagagccugggacucugccccugcuuuucuucaaaugucuaccuacaucugagaggaggggaggcagcggcuucuguugaggugauagaggccagguaaagagaguccguccugggguugcccuacuucucuuccuggucuccuguugccaggugaacacuuccacuaaauugucaugaaaacaaugcagauggaaccagaggccagcaccacucuccgcucagaguuucagccagaacucaugugaguuguguuuaggauuaauaucauuccccuuuuacagaugaggaaaacaaaucuuaguuaaucuuaguggccaaacuagacaccaggccuucugaggguaaaugcuuuagaccagacaggagaaacuagccaggaugggugcacacagaagaguugagccaggccaucaucauugugugagugauacaaacauugucagcccccaccaucuuccacucucccugucuugcagcuccugggggagguaaggggugcuggagaugcccacagagcucaggcuggcccaacguaugcccaacaguggagcagugaagaaacaggggagaaugcuccccugggaaugugggcugagacaagggcagggcccugaggugugagcguggagccccagggcaugggcacgccaggacagggugugggcuuggcucaggcagagagcaggagcccaggaagcauggaguggauggagcacccaagagggcuucggagauacaauuuggcaccuugagucagcucccucgcccaggaaucucugccaccucugccaccuugagucugcacagaccccaaaucacuccuaguuuaugaggagucucauuacccagccacacacaauaaaacccgccugaccacucuggcccgaaucucauuagaggacauuaguuccgcuggcucguggcuccuuugggacucagcugcaggcgugguccaggaggcgaaaugggccauuggccaugggcacaagacugucccauugagaggcugaggucaaucgaugaacuuaaauggaggccauccguccagaguucuggaaugcaugcaccucaaagcuggagacaagccacucucaguuugccccugcccacaguggaguagacccagcuccuuuccaagccucucugagaggaguugaguauaggccccagccaucaucauugcaugggggcggcccuuagggacagggacauacaaggggaguuagaaccaggaguccucaguggccuuguccuaaaucuuggccugucuuccaucuaaaaaaagcagaggauagagauugagagacccuguagcuaaagcauuuucccuaucucuaacuggaguuucauucaggccagaacgaaagagcuagcugcuaccaagaaccaccuaguagccuuggcagggcuuuguguggcaccuccucccuagauuuggguaccgugaucauaguaacugguagggacccauaguccaccuuggaguucuugcccccaaagaugggguuguuucacagcagacucuagcaccugguccagccuuuguucugcccguagccucugcugcuguguuagacuucuugccugaaacccagcauaccagaacaccagcauggcuccguggaugucacaaggaaaaacaaacaggacacuucucagugccucaggcucauugggaaaaugcaggccagacuucaauaacugguaugaacacacucaggcucccugaucugcccugcaccaauaagggggucaugcaggggagcccacgcucuggcaggugaacugguauggccgcccagugagucacuggagcuugaucuauuugggcaaacgcagucaacucugcacugaggaaagugggguuccagggcauuccuugugagucccuucaagucaccucugguuuauaaaugauagggauagggaguugguucccuucucugucucugagcuacaccucagguguugcccccucccaaucaacugcuuagaugagaguuagagaaggugccucagagccaggccagcccuacauacacuguggugggcucugaugacaguaucuccuugcugaggcugcuacuguagcuccuagcuuguaucuggcuccgguguguccacacucccaggauccaccugagaaggaugcucacaagcccaggagcauaugauagcugcucccucccugccaucuuucccugcccuugcccgcacacaccgcacacuccucaguuuguaccaagugucuuugccccuccagugccuuugcacaugcuguuccugcacacugcccacuauuuccuugaaaugucaauucuaaacacuagaucugagccaacagcacuaugaaaccuucguagucugcccucuggcugaagauaacuuuucuugaagccuuccuaugccucauugguaguucuuugagccugggauuuaucuucuucacagggcugagaauaccauuccugauagggcuugguuagcccauggccuaacacagagccagccucauacaugcuacauggaugucuaggugcauggauaauaaugacggugaaagcaaacuugcauucagagaucuugggugccagacuguuggcagcgucauuuaauaacuuaaugaccaucacggaucacgugggauguucacgauagaugugguuugccuguuuuuauauauggaaagacgaggcccagacagguuaggugacuugcuuguggccaugaguggcagagccagaguucaggucuaggaaguuagacccaguguuuccacuuggcuaagcuucucuuccaggguguugugggcaaaggauggagaagccuguuugcuaagccuggaguacucacaagacagcacauuaagaucaguucaaccccugugcauagcacuauacugcuuacaucuguguccauuugaggauccccucauagccuggugcugugguuguaaggccuggaugcaucacauccucaagaguccuagugcugccgggcgugguggcacaugccuuuaaucccagcacuugggaggcagaggcaggcggauuucugaguucgaggccagccuggucuacagagugaguuccaggacagccagggcuauacagagaaacccugucucgaaaaaaaaacuaaaaaaaaaaagaguccuggugcuauuccuguaacaucguccuuuugcuacauuagaguucuagaaauucaguuauugcauuccugccccuccugccccugcucgugucccuacccauccugggccucaagaguguucauuggcugggcuggaauggaauagauacgauguuaucauucuuucauccugagucuacacauuacucguggcaucggccuccugccuugcuccaugcagacacaagcaggucaguuggcuucucuagagaacuugccaaaagcuacucccaaauggaaucaagguuucuggguuggguacugaucaugagugaguccggagcucagcccagacuucuggaagguuaugaucucucuugcugucuccuagagaucccaaaagauggaaagggaggggccuuugcugggguggaucuaggguguucaccuguguaggaagcuuugaucccuugggaugaaagggccagggcuuccucugcccgagggugacuggggaccgggagcuggaguggaggcagugugcuccugaggccugggauucucagccaugcggcagugugcccgcaguaggguagagaaugagcccagcagagacaauuucaggcgcagaaaaaaaucagaccuuucccuguauuauggcuagggacuaaccauggguucugcaaagaguaugaacguauuacccucucagggcuacacagaguuagagcuuuuccuggcacccaugacccuacaggucacccaguggacucuggccucauagcuccacuggcuuaauuaggaagcuagcugggcugaaacacagucaucugaucagcuucgaagccaaagagaaauuccucccagacccucugauuguccaugcuccauuagcuugaaucacgauguggccccuguggcccagacaccagccggagccaugcucuggauucccuagacuggaaucugcuugaaauccccuagaagaagcaagcuuaggaccuguuuggauccucccuaaacccaaggauugcccagugaucacaaaggcccacccauccacccacccagagcuugcuagggguuugcauggcugaauucugcagcaucccgaaaccucaguuggagcacacgcagggacaggcaucucccacguguaaauaagauacugacggaggagccacaccaugcacgagaugauuuuauuauuacugcccgccacccccgccccgaagcaucgccaucucauuggccuagauugcugcaucucucagaaugauggaugggccuucucucccuucccaggccgggcagcagcccugcuacccagauaccuccuacacagccccuuccuaaauuuauucuuugugucuguggugcccagagagucaucaguguccugaaccagcugagcacugauuaucuccgauggcuugauggaugggccuuuaggggaacuuaggcgacagacccuacccccugcucccuccucugucccugcuacagcacccuucccagcccucccaggaggcagauaaugggccugugucugugcugaggagaagcaggggugauaaaggagaagaggcggugacaguccuuggcgcccaccucacagugcuacugccgcagagauagcugggaagucuccauacccaccccgccccgagcucugcauggacgcaucuuuccaggcagugucuccuauuacccugccugcccccaucacuccauuauccuguccccucagcacuguggacgcgguuugcaccgugguaauaaucugugugguucacgcgaguucuucacuaguguuuuuauguccucugaguguguacuagggagguuuauggcugugugugcgcgugcgcgcaugcaugcgugcuccugacuagaugcuugccuucuucauggagcagggccucucacucagcgccugcugcugcugcagagcccggcuacuggaggcaagguggccagacuggcugaugcugagccaggaucugcccuccccacagugucacagacacgcagaggucacuuucauaauuguuuugucuauaggaucacaaacaacuuguuucccuguuuuuccucucaacacugaacccgcagguuaucuuggucucaggauuuuaugagugaccuguguuggccuguggaucgaugccagaugauaucuaaacauggcuucccuuaacugcuaaguuggggauggagaguuugaaaggggaagcaacugagagcugagucauaucauaucacggcuguuuguuacuagcucuuuaccuaaggacucucagucuagagaggaagguucaggcuccaaagaaagacacucccccuaacccccauagcagcaaugauacacugucuugucaagagauuccuccaccaagcugggagcagauguguguccuuagagguuuuuccacaccucagauggucaccugguggcucuuugggaccauuuggucuccuuucuuaagagguaguuggaagccaggauuaaauggcucagacucccccccacauacuucugaccauccuugcacaauugugguggugagcaagguucaucccuacagccaaggacacagcagcaaacauaauguccuggccagcaguggauggcaucugcccucugcccucucauacagcaugugacaucucagggugcugacuccuuuaagcaagaauguccacagcacagaugccuggaaggcaguauagacagaggguugcggccuggugggucauguccacgcugaccucccugaaucuucccuguauagaaauuaaggagagcaggguuagacuagguacuguguuuucccuucccuuucaaggagagccccugcuuccccagcagacccaggucuagggagagccucccaguagacccacaauuuagggaguuucccugcagcagagggcagagcagauugguccgaauccuggagucucagcauuggaggcaaaaauuaaauaaaguacugccacaaugacauccugaaccccuuacccaaacuccuaccaucuggugcagcuuccagccacagugugagccccucuagugacagggagcucaccucucuccuuggaagccccacacucuccaugcaaggaugccaagaucuguguccugacaccccacucccaaccccagcucuguuucugccccuuggaauugccuggggcacauuggaugcccuugugauaaucugcuucagaaagcccugaagccuggcucuucccagagugcgugugcuuccguggcccagggucacacacuuccccaucgugggugcuuuuuuggggagcgaaccguccagauaucuauuagcagaaguaaccaccccaaaugggacccagugcagcugagguggacugacugagcagccugggauuguagccucaauucccaacugccugugagagaucuaagaggaggcggaguggggcaggcuggcuucacaccucccgccacccucaccccuuccucucccagcccucaccccuucccaccccuguuuucuuuuggauuaacuauaaauugcaguggaagaucggcuuaucuccagugggaauuaaggaauuaaguuaguggugggagagagggaugguagagggagcauauugcggaggauuggugggggggggggggcagggggcagccagagugaugggauaggacccugucugccuguaucuguuaccugaggugugugggggaguuggggugcguaacuugggcucccgggaccagacucaugacugccugccuuagagagugugaugacuccauggggagggguggcaggcacaugggguaccacugguggaccgaucuccuaguagccucuucuuuccuuuucuggugucucaugauccaguacagcagcucuguggcaugucacagcauaggacaggccagccccagcauguggcaggguggggcacucuacuucucgacgcuacagugcccaagcaaauucugcagucagaaguucaggggcaggagugggucagacagaaccggccugucuuugaagcgaguccaggcgagccucauugccugccuuggggguccuuacuggacgaugcccaggaguugcgcugaaacccacacacccaccagccucucagguccccaaggcugggggggggaagaaucagcuuccucuacuugcagagccacccagaagccuuugugaaugccaagugagaggugggggggggggggucacacaggaucugcuuaccugucgccaccuuacccggucccugcuccccgcuccccugaggcaggccuguauagagcccauacaugccccaggcauccugccuggcaucaguaugucuaaaacagagaugguguuuuauagggugucucuccucuccuucauucagacuccuagccugagccaagccagucacaggagaggcuggaaaugaagaagaagugacaaggcuaaggaccucccuguuggcucagacaagcugggggaccugucccaaaacaacugucaauccugguuguaggggucacugaagaguggccgccaucagggcaccagaagacaagauccagaccagaaguggcugggagagggggugguacuuaacucugaugacagaggaagccaaccagcccaaagguccaggcauuugguggguuaaucauuggugacucugguuaauaaaucauuggcaguuuuguccccaaauuucagccccugccaacccuaaaggucuuucuggcuauguccugggaccuuucacuuccaaagcaagagccucucaucaugugucgcccaccccuaagcuggucucuggcauccagagucagccugcuguguaaucuccaagagagauuaguggccugccuucccugcccuccccccacaggcuguggaugccccuagauacuuccugcugggaggguaggccacccacagagggucuccaggugcccuagugagcagggcccccuuguauguaggcccuuucugaagcucuauggugcugugagaggaaugagccaacagauucucuugagauagcuccuuuuuugugccagguacuccuagcacaaaugcucuuuuagcaaccugaaacaaacaagcuuagagacuuuguucaguggguacaugcugggggcaccugaaaccacuaucaccgggcccuacauuuaggauaaaaugaggcaggagucacacacucugagguuuuagcauuuucuuccucugccugcuggggcacuugcugguuggagguuggccagguuucccgccucugacuuaugaucuugggcaauaauccuguccugguggccauuagaacaguuuuccuagcugguuuuuacaagccuguuaucaagggacagagugacagaaaggaagcgaaagaaaggccucuccuuucugaauccagaguaccagggugggcucuucuagucuccccccuccuucacauccccuggagccaagcacucagugcugggcugaccucaacaguuggguuccuggccccugggaauggugcuacagggcauccuaccugcuugcuugagugguugaagaaugcagagguugggguggagaugcaggagcuggccuuugugaggguggguuccagaggcuggagacaucaggaccaccccaaguggaagacccaugccuucagggggucuguggaugguggugggcaugaggccuuggggagcccccuuggagaagggggagggcuaaagagaagcaaacccacccuauuucagccugaccugugugcagucucauaccccaagaucugcaaaccucccccccuucucaagcuacagcucacccuggacucuucccauuugugcugguggaacccccagguucuguuugguguccuccauucuuucccucuuugcugcuguaagaccuggguguccuugggacaccucugagcuuggaacuguuauucuuccucagggacucuccccauuccugagcagccacucaucaaggcagaaugaugagaaguuugagcguaucauacucugaagcccucgcgagcuccucauggcugcugaucucagcucaugcuccgugaccuaggccaggcccuacagccuuagcccugcucucucggagcaagacgagccuuggagcgugccauccugcacaccauagcaugguuagcaaugguccuagccucuacucgcuagaggcucauagcauccacuucuaccccccagcccccauccauguacuaugacaauagauaucuucaagcuagacaugguggugauaccugccuguaauuccagaacgcagaagguagaggcaggcagaucacuguggguuuaaggccagucugggcuacaggguaagaagaugucgucucagacaaacaaacaaccaaaaugaagcaaaccaccaaaaacauugcugcagcucccacccaggcugccuauucagcaucacuggucuagccugcugcagccagaccucuuuuuuuucaaagcuaccucccauguuguucccugagcauaaagucagccacuccaacuucuguuccugggcugauacugagcccuugcacaucugccccugaaacaccccguuugcucuguaugacuuuucuccuccagauccuuggcuucuucgggaggguagaucagugccuuuguaagcagcaggugccucaugaauguaugauaaugugacagaagccagcuggcucuuggagcacccccucuuugccguuccuggcacccuuucucaccccguagccaagagagagcuucggaugcuccguuuuuccugacaccucuauauccaccucacuuuuuuuuuucacacacagcaaacaaaaaucaucuuuuuuuucccauuugcuaagcacagggguaccgugguugcgugugcaaagcuguguguggcugggcggcuuugcaggcaggaaccgagugauggcauguuucugugugucggguaucggugucugcgucagaaaugaugccaucugugccaggccuugucuaggggucuucucgcccacuaguugcuccacacucccaauuccacccagauggguucaguccccugcaagcuaugcucuuucccagcuuuguucuggccggcuucucuguugggagaacccugccucacugccgggaaaacuccuacucacccuucaaaacccuuucaucuccaaccgccuucccccaagugaaucaaucauucucuguggccacagugcuaugcgaacagucugauccaagcaaugcucguauuauuaggucauuuguccagugucuuugaguuuauagccauauuuucaggcucuccauaagagucuuccaagauguuaaauaaaugggaauaaauugcuuauuuuguucccaaagcaaauuuuuuuuuguaccguguuaaaagugugucucuguaaugacuuuguuuaaccuuucugcacuguuaacugcaugugucuguccauguggauguguuucaguacacaagugugcuuggguaugugcgugugcgugugugcguacgugugcacacgcacgugugugcuuccauuuugaugcucugaauuuagaggugaaucccccggugcugcuccccacggcuggcauuuccucaaccucuuugccccacaucuuuaagaacugaaggcaugaggacaggggugucuggcggugagacuauccccccaagccuuccguccauuguaggggagcccuggguaugugugggguggguuuuggggggaagagcccuucauggccccaucagaucacacccccuucccuaucuaucucugcccuguuuaauuggaauuuggcuaguggagaccaucuguucuauuccauccuguuuccaugacaaccaaguggcuugagacugagguuuguggugaaagaaguggccugggggaugcugggaaaaaauagcuagguccucccccucaaccugcucugucuccuccucuugucuuugccaugccuucaccuccaaacugggugagacauaaaagccaccccugccccagagcuggaguucccugccacauucugucaucuccccggcccuuucccaggcaggcaccuuuuggccucccacacacacuguucccccucccuccacuuccauucauaaguacuuuccauguguggaugcgggcaugcaggaucacccucauccugugccccagcagauggagagacugagucuucugccgcuuucuuccugguaccuuucugucucccugcccacccaauucaaagcauccaaaguuuccccgugguguuccccacacugcagcuagugugaggggaaccccaacucccacagaugaaccagcuaagggguagggccuucucugucccccauggggaagugagugucuucagaaccuggaacuugugacucaguguccuacaacaaggaccaucuugagaagggggucccagcuucuucugaauccuuuauccuccugccucagggaacacauuagguccugcagguacaguagcagagaacacucuaacuccagggagacuguggcagucugaagucagaugacccuuggucucccaggagcucugacaggucugauacacugggcugugagggggugggguccgucucauauccaacagcuaguucugcuuucaugauguuauuuucugcccuaauuuccucaucucuagcaaagccuuuccgugccugcucuauucccaggggacccgccugucuucaaaaauaagugggguggccugucaggugaccuguuuguuaugcugggcccagacaucaugugugggacaugcaugaaacauuuuacuauauagcagggggcuguggguaugccuggugggguccuagaacccuugcagugcccaccccugccagcagaaucagcccugggcuggggagggaagaugggauuucagaucuuuguagagacacccccucauggcuggcuuucuuugaauagaguaccccaccaucuaaccuccuuguacuuuuuuuauuauuauuauuacaauauaauugacauaccauaaaagucacccuucuaaaguaugcaagccaguggcuuuuuauucuacucacugagcugagaagcuaucagcauuuaaaauaucugcgccaccccagagaaaaacucuagaccugucacccccuucccaucuccugccuguguguccacucauccacucugcuuccuauuuaagcacauccgauaaauaagcccauaagugagacuauucagugucuagccucuuucacuuagcacuccacaagccuccucaagugaccaugucacgucucugcccagaaggcaauaauggcacccgaauggcucauaggucagguuuaauaguccuugucuaauacaaggacuauuuauuuauuugcuuucuuccuuacuuauuuguuuugguuuugagacagucucauguagaccaggcuggccuccaguacacuaugaagcagaggcugucuauggacuccuaucucccugucuucaucucccaacguaacaguugagcaaguagugucauuugguacuggggauucaaguguacagacuacccaagacuccuaaauuuagcucuuaccucccuugccuccuggcuaccacucuccccucugccacagaucccgacacacacacacacacacacacacacacacacacacacacacauuuucaaaagcacgauuucucuccuguccccucucgucuuccucucugagagacucccaugagacccaacuaaaagccucuuuuugcuuguaccucaucacucucugguaacauucucccucauuggaaacucccucaauuuugguucauacuucacaaaacaaauaaaagccagcgcuuggcauaucauaauuguuugcuuucauguccugggcucuuguuagccugagugucuaaagaaaaagaaacuaucucugccuuccucggucuucugucuucuuauggucaucuccaccugugacaagcugacauaguguucagcauuaguguaaugucuuaugagaaacagcggggaucaaaggauauggguaaggggagugucauguccuaagugaggugacuucuguaauauggacagguggucaguagaggcaugggagauggguuuggagaauuuggcagaggugggagcagaauaggguuugaugauaaaagaugguguaaugugaccuucggccagaaaguggaagugguggaugaaggggaaggcacuuccugcagacagggaaucugugcagaggcccagggggaggagagagccagggccuacaauacgauggcguagagcccagcauuuaggcagguagagugccgggggcagcugcccuucgcaccugcaucugaugggaaccgcccugugugacuucucagucacacagaauaccaggcagacaagggaagaagacgagcuuauucuggcucacaguucguggggauacaguccacccuagaaggaaagguguaagugcaggaggagaugguggcggaguacauuauagccacagcugccuucaggaaggagacagacagacagacagauacugucuggaacaccgcuugccuccuuuuuauucacucuuaggcccuaguccauaauuugcguggguuuucuuacgucaguuaaccuaauuuagagauuccaccacagacaugccuagagguuuaucuccuaggugauuuuaaauccuguccgauugauugacaaucgauauuacccaucaugcccuucauccuucaaggucauuuaaagauggauugcugagcggagccuacuagaaugcaaauggcagaugcucugccuauccuuccucaccucucauagcccugugcagaagaguuaaggggcuaaagggcuagagagcugacucagcagcugccuuucuguucuugcagaggccccaaguucaguucccagcagccaugucgggcgauucauaacugcuguagcucuucuuuccuugagagucgugucacuccagaggauccagugaucucuucugaccuccaugccauauguacucagaugcacauagccacacacauacacauaauuaaaaauaaaucuuaaaaaaagaaucgacggacaaggguagaucugggggucggucccuggcaucugcuagccuaugcccuuggacuuuauggcagaccccuggccccugguuucuccuucugaaguacugacuaguuucccauagugaugcaugccugucaccccagcacugggggcaggaagaucaguuauucagggcuacccugagcuacaucacaagauccucucaucucaccugcaaauaaauaaaagcaaguaucauugccaccaacuaacuccaaggauuuucgugagagcugaaagagauggcagacaccaauggucuggaagggugugccaguguuugcugcucucaggugugcuguggacaccauuaaccaaacagauaaagggcacaccuaagccucugaugcccucugugccaucuccaaggguuuaaaagcccuaauagugacaguucuagaccguguauuugaaacagacuagaaagcagcccacacugugauuucugggcauggaagggaaugaauggguuuuucugcuaccucugcucagaagggauagaugagcagagaggggagcagggcccugguuugcaggaucuuccugaguugugcagaggccuagaggcaggaguucucaaagcauaggggaccggccuuucccuguuccuugaagcugagguagguaggggguuggcucaaggcccaggucacugccuuacagaggggauucaguucccaagaaaggcaucaaacagaccuccugcccuaacagaaggcaagccacugaauugccuuuuaaucugagugggguccugcucacucagugcugaguagaaaagagaccauccguccccuugagugaaaguuauuugaucgcugagugucuggggaaaguaugaggagaagggaggagcgggccagacucuagauagacccuggggaggccaccccagaaggcucuauucucugugugacagcugacccaaggccauuguuaugcagugugcccccaucccuacccuguuccuccucccucaggccaggaugaguaagacagcuugucugcagggagagggaguggggcugccagcugucaccugcacaggugggagaggugggcuauggagagcuagaggucuccccaugccuugcuccagcgucaggcuggagaguguguccaugaugcucuguaagccacugaaauguccuaguugguaccgucuagcgugcagucuagcguagcucucugccuccauucccuauagguuuagucccagcaguuaucugcgaucucgugaaaacaagccagaucaggugccuccucugcucauccuccgcugcugccucccaucucacucagaggaacugucuaggccccgugucacgugacugcuguguuucucacuucagcaacacaggccagaaauuccagaccucuccccuccgggcccuugcaccuucugcucucucuacuggaaugcugcucucucccauccucuguguucaucgguguuuugcucagaggucuuuucucugucaucccagcuccccaccccuccacucugauagccuauccacacuuccucucauuucuuuucuuuuuccaucauuauuagcauccggacuugucaggaacagaagauuuguuuguguuuugucuggugcuagaucccuggaccugauaggaacccugugauaccaguaauauuuuaaugaguggacgcuccagagggaagccaccgccgcuacccuugcacacacucaugcaggcucauguugcacaugcggacacacaucucuugaucaccugggcuggcuccagaacacugccccugguauccaugugaccacagugaacaucccugccuuuucugaaucuuccuucugccccagagucucucaagguacuuuguggguagaggagucucuacuccucuaagaccugagcccuucuccaaggaggagggagcucacucugagccauccugacacuuagccaaccaauuacagauggauacaggaccuggaagggucuagggaucucucccuaugcuugcgccaaggaauuuaguucacagucugauuccaucauccucccuccugaaguccuuccuccucucuggcuguugcuucuaugucuuagggaacacugaggggugccccagaaggccagaggaaggaggaaggcagcccaaaaucucaggugauuguacaggaaaauagcauaguggucucagugagcugucuuccagaggugguuccuuacagccuggagaaccauaucccuuggaugcuugagccaggaaccuucagaagagguuccaucguggagaacuaacuugcagagagggaaacacagugcgugcaugauuugagccugcuugaaaagacaggucugaugaagguggauugccucuucacgacgugacaggcauguuccacucacuugucaggaagcugccuugcagguuccaugguccgucauccuuucaggaucuuagcguuugaggacaagggguacuuucaggauaaccaggugaugggcauccagggugggacucuuacaggaagugguuugcuaacuuaggcuaagcaugcucacgugggaagagcaucgguuuggaggugagacgcucccccucagucaccaagcaccucauaacccugguuagucucuggccucggggcuucuaagaagcccuugggaucuucuguccugugcucugugcucagagaguccauguuagccuaucaccuugcuuuccuaccucuuaucaaggucaaagccuugaaacccuagcaagcacguuacccaagagugaggagcugagacuccugcaaccucugacgauaaaucgaugucuuccgccucuguggaagaccuuuacuuuuugucccuuuggugugcccaggagcccuucauaacagcuggggccuucagacuguggacuccagagcgugagacaagagaaaccugaaggcaaagcucuucucaaauuaagccccaggccuuuccauggggcuggagaagcuuuaggaggccccuggccuccugguuuaugucggcuugccacugguggccucccaugugaacauccuggcaggcucuaagcauccgcucuuagcaaggcagggccaugcguguucuugaaacccguggccauuauuuaccacuugcuuugagccagggucaguuucuuggacucagcuuagagaaagucauugauuuggagccagcaagaugguuaauuguucuuugaccucccuaugugccauggcacacacaccuacccacccagacauguacucaaaauagauaaauguacuuaggauguuuuuguuuuuagucguuugaccuuuccaauagcuaaucaacgaauaaggaaauaacaaucuucucuccuccucaucuuucuccucuuuucuucuaccaccacuacuucuucuucuccuccuccuccucucccuccuccuccuccuucuucuucuuuucccucuccuccuccuucuccuucuccuccuccuucuucuccuucuucuucuuccuccuccucuucuucccccuccuucucuuuuuucuucuccuccucccccucccuucuccuuucuuucucccucccucucucccuuuugcaguaaguaagauuuuugcuagguagcacaggguagcuuaaaggcaugguccugccugcuucagcaucuccgguacugggauuucaggugugugcugccauacugugguuucuuuucauugucauaaauggggacacaggugucagaaguguaaagucacacaagcuagcaauuagagaggugggcuuuggauugcaugagugaaaacagaggacucucugcuaacacagugagacagaagagucccugguuuggcggaacaagaaggcagcaugaggcagggaccugacccuucccagaacaaaagggaaucccccacuauuuuaggaccagacgugacuggacagugcauggacaguaucuaucucuagccuuagccuggguggugucuggcaguaauagauccauucacuccugggcucaguaucaaaaagcauggggaaacggacuuucccuucagcaaaaaggauggagauuaaacagcaggaagaacuucccagcugucaggaccauacgcuuuuaaaacaggcaucccaggaagguggaggcccaugcagagaagguuaaugcuguugcugcucagagccguuggagagguaaugugaagaaggguaugcagcugaccccuccagggucagaccaaagaugcugucccccaggaaaaggagaccauuggcuaucccuacguugguaccacccucuuccuaggaccccaucugccccagcccugccauuggacuucauuaaauugcauuuucccagagcagggcaggcuggugacagaaugagucaacaccagcuugcuacaacugucgccccuggagccugcgggcauagagggagauaauugggagcaguuugacagcuuaaugucuggggcuggcuuccuggagcagugcagggugggguggggguggggcaggagccagaaauggggugggggauagauuggguugucuucagaccaccaccaucaccaccacagcugccgccgccgccgccuuuccccuccguuuccccagcaccagcuuguugggcaggaaaauaaaacacagaaaaggaaauuagauacggaaaauaaauaaggguuucuuuauuaauuugucagaacuaauuaacaucucccugagauuugucuccucuccagauacccucagagcaggaaggagggaagucuggcagaggucaggcuugggcuucagggucccugucccaaccacuccuaacagcgccugccccuagaggagagggcagaagaugggucacucaaagggaagccccccgggguccagcugagagagacccuagacccuuguccacuucucugggcgcucuugucaccaugcugugguugcucuccugacuucguucacaucacauuccccgcugaagcagagcuacugccugacugguucgaggcaguggggacagugucuagugucaaguaccauagcgggcauggucaggacuugcuguugcuugggagacagagauuaggagaaauacugaagcuucuacagaauucuucaucccaagccucuugguaauguucaccuauaaucccagcacucaggagacugagacaggaggauuguugguaguucagugcuaccugggcuagcuauauagagagacccugucuuuuuuuuuuuuuuuuuaagguaucuaccuacccucaaagucuuuaggguuucacaugugcaguagucuccagaauacagaguaaguggcuaaaugugccuuagaggcuggagagagacagaguucccaagaacucgcuggcuguuccuucugagcccugucugcccaucucacucaccacagggccugacuuaacuuccaggagucucccuaacaguugucucacuuccugguugugaaugcaaguucucccggccaggaagccaccccagcugccaccccagcugccccuggauuugggcgagagccugguuuuguuucccagagucaggcccaacccugcuuugucagagggcuucucugagaaaccucuccacagccacaccuuguaguagacacugccuuggaagguugcaaaauccagucuguucugugggucccacuguacugacagcaucucgagguguuccacugacaccgaccaaaaagauuccggaggagaugaaacucugucuccucucccagguccgucaccccccggaguuggcugaaggccucacagagcugagguccccagacuguugaaccagaagaagcuaaagggagagagggcuaaauggccagccuccuccugcagcucagaugaggacccgaaggccuggaaaaagagccacagcuuacugggucaagguagccccagcuuuagcacuugagucugcugacucccuggccaugccucucacgaacaggugucagggcuuuacaaauggcauaggaaguaaauuaguuugucacaccaggcacucucagaaccaagaaaaccucuggggaauguggugggcaugugcucaauggggucagacuacaaaguuauuguccaggggucaggucaccgucccacccacuauggacauaugcucuugauguccccuuugacuuuggggacauuuagggcccugccacaucucugcaucaguaguaagcaguaucuaaagucggcagaccuggguuugcauccuggcucugcuauaacugugaccuuggcuauccuugagugcagcugagccuuaguuuucuggcugucuuagaauaccugcuuugaaauauaaggacuccaugagcuguggguaugaugcuguagggauagggucaguguccaguggucuccagagugucuugcaaaaggcuccuccccaccuccugccacuuucccuccacacugggcagaaauggaauggagucuuuucugccacccugugguuuuaacucaggcugccuggcuccuugcugcacgcaugcccagaauaggugcuggagagcagcacaggcagcuagaauaggggccucuguucuccaggucucaaagguaggcaagaggacuuuggguggugacuggggauggggauagagagggccugguaagauuggucugugucugugggcugggcauggaagggagucucagaggccacuuggaacuuggggaacuugucuuggacuuggggaacuuggagaaggaacuaagaggccucuuagcccugugaagccacaccauacuucuuaccacuccccugcaccuuggccaggaaaaacacagggucacuugcacuugcaucucugcaggaaugacacccaaugccguguguggcucuucuagguuccugucccccaggcuaugggaccucaagaccuggcccaacuucuguagucaaagugggggugcugauuugaugggggaggcaggugagcugcccaacuguggggcuucuacaagacagcuuagagaauccagacaaaugaacauagaugcugugaccuuagggagcuggaaaaggccaaggcuggugucagguuguggcucuagcccugaucccacagaagcuuuaucgagcuccccguccugaauguccugaacaauucauuggccaggcaacugcguguugcucuaucucagccauuuuaacaaaagaugucaaguccacuugcuggguaaggaaacuggggcuccuggguuugaggcaacuugccagugaauagaagagcucagccugagcucugccucccaagcucucucccuacacccugaguccccuccuuaggaggaagagcuuacugaacccugccuugcuggcuggucaaacaagucucagcacaggguacgcuaccacugcagcaggcggaugaggacaggcauccucaggagggaaaggauaaggauugcuugcuggccagucucccaggggcaguggugaggugccccacucuggagacauggacaggaaaagaggaacuuauuuacugauugggugagaggcugggaggccaggcuugccaggcauggugggugguguaugacagcuucucucgaacccuucccuugggaaguuucagaaagcaagaaaagcuugacuucugucugcugccuccuggccaagagagucagaucugagugccauuuucccaaagacuucuguucccaucuacugggacagcacaucaggcugggcagguguggcccagcuaccuaucugaguucuagcugacucccauccaaguccuacuugcuuucuuccuucccugucccugaaaggggccaaagggacuccaggcugggucugccacugagggcuucagccaaugauguucuuguucucuuaggaaagagacuuacagacuucgcuuuaacaacaggguguugggaggacuccaggcucucacccaggacacggcuuagacggaaaauuagguucugcuuccacugccccagcucuguagcuugguggaguccucaccaaaccccaggccacaguuuccuccucuguaaaaugggugugucucgagccuuguuccagaacacggcagugaaaguggaagauuccagaagcacuuuugagcgcccaguacauuaaaaaaaaaaagaagaagaagaaguggaacaauuggcucuccaauuccaagguccagaagcacaaacucugccuaccagcauuuauuuuuaggguucagagagccuccaaugaugggguggggaggacaagcuuucucaaucugugucucagaaagaaagaguugcugagaacuguuggccgcuguaauggagccagagcuggagcaaagacgagggucuaaagucagaugugugucuuuaauugcuugaguucacaucucauaaaagagagagaaauaauaacaauaauaauaauaauaaggcaggagcccugccauuccccacccccuuucucugccaugagucaagaaccaguucccaccagucuuccugggguucaaagcgucuccccgcccuaauccucacuuggaccuccccgcccccaccacuccugugggcaagagacuuuucucugggggugggggugggggugggggugugggcucugacacuccuaaggccagaccguggcaacauggugggcagugccugagguacuggcaaagaggggacacucugccaggcuuccuguugacugaagcacaccauaaggggacaggcucaacucuagcuuuuaucuagcccagaccugauuucucccuguucaaugguggccagaagguucccccuccuagccccuaucuaccagaggcagccuugcuuuaacaacaacuagggaggcagaggucugggaugaggcccugaaccuauaggcucccuucccaccuggggaagccaccuuggccugcugccugccugccugccugcaccuugauucucuaagguggacagaccuccagcccccccccaacccccuccaucucccuuuaccccaccucaaagcccugacucacucccucucuucccucucaagcugugucuccaggacgugucaggacagcgugcuggguucugguccuacaggcuuggcugugcugcucucacuggggguggggcaauggggagacuuagcuuugaccugcuucuucaaaccuccuucccccccucuuacccuggguggggguggggggggugcagacagaacugaacucuagagcaccuccucuuugcacccacaagaggcucugccugggaggcagcuguagccuagggguggcagggaugggacaccacauuucuucacccuaauccugccguucugggucuuucggcugugugcaugcaaugccacuuggccucccagagacccuuacccagaagccuucacucucagaaggcuguuugucauccaguggcugccgccgcuuccccauuauucugccgucaauggaaaggaaagggucuuggucucuccuuguuuuuuccguugcuuauuguauaauuguaagucacuucacucuacugaguagucuccauccuccucaaauuggucagcgcuauccccuugauugcuucaggauucuggaugcccaaagucaaugagacuggaggaaggugugcuaggauugcaugcccccaccccacagucagccuagccagcagagggugagagagguaugccugugucucacugagaucauugagagugaaugaccccgcaccccuguggcucccagccuccucucucucauagagaaacuucucuggggaaguaagcauggccuuugccagggagccaggucuucuuugaucugcuagcuuccuaagaagucuugauuaaaagcucucagugaccugggaagucaguggggaaccauguugaugagucuguuccccagaguucgggguucauuauggagaucagauggagccuguugccaguacaggcaucagguagguaccaagcuggccggggauucagguuccagccuagccaaccguggagggcccagggauugcuauuugagcaagguggagguagaggcuguuggggauaugagaacagagccaggcgauucugugggaccugaguguugaaguaggaguuuuccacuuuggggagguguggcggguggggaugugggagggggaggagaggaagcugggaauuuaagcagggguagauugaaggucugauacugguuuagcucugccccaaggcugcggagcgggcaggaggcugugucauaagaucuaauuuguauucagauccaccuguuagcagugucuauugaauaaaucacugugccagccugagccucaguuucccaggacaagaguggcaucugccucaacgggguguuugugagauuuguugccuagucucacauaaugagaugugggugccucucaggaaaaguucacugucgucagaguugccuacgaguuuguaaagaaaaggaagcucaaaccgugucuagaaacucccaaagaguaaggcuaaaccgcuaucccgcagugacuaaggaaugaguuuuguagauggugaggaagugguuggcaggcaacaugcucuguaguguuuauuuuuauuucauguacauuagacucggucagagagagagguuugggcaucaugugcaugauggugcccuugaaggccaaaagagggcacauuagauccccuggaacuggaguugcaggccauugagagccaccaugugggugcugggagguggccuuagacccucugugagggcagucugugcucacucuuaacucuugacccaucucuucuucagcuucuguuuggaguuguuuugucacuuuagcauuugagacaaggucuugcuaaauugcccaggcuggucuucaacuccccguccuacuucagccucucugagcugacccagcuacuguccagcuacccucuaucucucugauuccucccccaucugcugccucccgguguaguagaaaguccucauguaccaauaaagauccaagagcagaugcuuugcgccccccaccccaccccaguucucuugaacgccuguaacuucauacuguagccgggcaaaguaagccaagcaugaaagaaaugggcagucagaaacauuugaaccuggagaaaagaggccaaagggggagagauguaugguuggggguuauggccuccuagcggaaacacccucugcucuucugcucuucuggcuucuuaggugagcuauuugcuuaucuugugacccagaggcaaggucucuguagccacaacaagagaaacaagcauaccacaguccuaaggucuuguggcuggcugauaagucuuucccaggugcugucauggccacugucauugagccaucucaggccaagucauaacuuccuacccccuucuucagcuagcuccucaguuccaagcccuaccaacuuccuuacauuaguugaaccaguucauuccucugugauuuuuuuuucuucauggacaaauggggagccagucccagcugguccccuacuaaggagcccuuugaaggauccgaagccugcuucucccccacccuagaugguccuuggaucccagucugaguccacugucccuuugacuuuucuauuuauguaccagaacucacccaccacauuucaguuucccaaucaaaucauuaauuaccccaguaauuaaauccaauuagcaguuguaggggccuuucugagugaggaaccauuagccagggugaaaaugccugggagagggagagagagcgaaaaacucaccccuucccagcuuucaaagugaaaacaggagucagcagugcaaggccagggcccccaauuaaaguuggggccucacucauuaagcuaauuuggcaugcuaucccagcagccucuggugggaaggccagcaauggagccggccaacauuugguggugguggaggugggacgagcccugcucaccuugagggcugagcuggagauccaggcuuacucagggaagggcuggggucucgugaguaccacuugcuucuggcuuccuuggcuuuggagcugaugaggguagggugggcugaggugaggugagacaggaaaucccaaccuucugcugccugucuggggaagagacagcuuagcagucacuuaucuuucuaggucuaaggcugaggggagcucccgucccaggauggcugugaagaacacacacacacacacacacacacacacacacacacacacacacacacacucacacacucacucucgucucugaagcuccugggugccugguagccacccuugcccccgacuccaugauuccugaaaguagccuagcauuuucccuccauuccccuacagcucgcaccacacaguucccagguugagaagcugagagccagaaagauaaaaaucuaagacagagucaggcuuggaagaaugaagaugagguauguucagaguccucagucaggucuccuuguggcucagcuggccugcagcccugacuggagcagagcugggggccagggugacagacucagccuuuucccagagccaggggugacaggcagaggggaugaugcucgcacuucuuagauaguagggacuccucgcccauccugcaucagacagguuccaugugucugucaugaagcuguagaccacugcuuaaccucccaaaggggaaggagcaagacauacauaccacgaggcucaguaauagaaggcacagccucuggagacaggcuguucuugugugaucaucuggccuuggaauuuggccucucugaauuccucauuuccaagacgagaaugguaaugaaaccuagcacccaggaguuuugagaaugaaacaaauuagccuccaugagcauucagacuuuggacuggcacagugucuaacacacacaugcuaacuguacuugccaucuccaggagaggcccagcaggaaacaugucccucuuguguccucucagggacacacaggcuucuguugcucagguuguugcccaaccuuaggguguucagagggggacagggccgcucugcgcagggucagaaggacaaggggaugggaaggagaguuagucaagggaagcagguggccgcagaagccggcuacaucuccgcagcugggcgccaugccccgugccuacgugcuggcucccucugugaggcaggauggagaacaggcccuggcaugccagccccuaccagugacuccugaaaccuugacaagucugagcuagaagcaggccugggcgaggcuccugauagacucauguugggcagagggauggucggugugggaaagaccccacacuugaaacugugacgcugcugggagaaccggaaggaagcccgggaggaugcugggugguggcugggcucagagccuuuucugacucucuggucuccucacucccaugugucccugccaggcaggacaggaagaagucaggcuacagaggcagcagggaggggugcccucagcauuuugccaaguguaaggugaugguuugagugguguggagagagaagaagggagcagugacaaccgugugccagaaacagaggaagcugcccaguccuggggaagugaccucaccccagcugagugagcuggguaugccaggacuuaguguauaggcaggaaggcuagcuuuggggaugggcaugagacuuggccacgggcacugacacuggaagucacugaagcagucuagaucagcuaggaaaaccuguauuaacuaccauuuuuagccucuugggugcuggagggaaagaccacccagggacaauuguacagaaucuggacauagccucaggccugcacaaggugggggcaggguguuccagugagcacacucccucucccugacccaccaugucaggacccucugaagagcuugucuucacaccacacaaaggcugcuagguuaaaaucaacaacaacaacaaagcgagucauaagugcccugcuucccugugacaaguaagcuuggcugaauuuagaccugaaguuccacaaaaguugaaaggcagccagcaagggguuacccaccuguagucccagcaagggggcacccaccuguaguuccagcuccacuuuucagaaggcugagguaagagacucuccaaagcccuccauuccaggcccagccugggaaaccuguaucccgaaaggagagagauugggacugucaccacagggcuggaaugcucaccccauccccugcuggagguguucugugauuacagcccagaagaggucagcacucagguuggagucgugacccugguuugcuguagucuggguucacacgaaucuaggcuagaacuucgacugugaggguuuguguugaggaggugggggagggugguuuggagguuacuguggguguguauagggaguugggcuaugaccccuaaagcuaauauugaaagggcauccaugccauauacaagagguuggggucacugcaguucugagcuacaaagcaucacucaaguuaugccuuuguaacugauaagacaguuggccagagcaggagcaaagccugcucugucccagcaucccucagggcccuggcccuggucucucucacucccacugcccacuuggaucaugggaacucagccuccugugccauugaguuucccauauugcauggucccugucccucugcuugaggggcaggcccucucuuagaagucugggauacuccucugacccuuagcauugcccguaagguagacccaaaagugguguggggccaaaggagagcugccagccacgugcaggugccuggggguauagacaaagggccaggagggacaaaugccaguccucggugggacagacaucgaggauggggcaauggaaucugggugucacagagugugcacaugcaugcucucgugcaugugugcauggcuauguguguuugaaggacucucuccuuagcccaccagacuggagagaccuggguaucucuagucaggccuucccacauucaagcaaaggcaggagagccaugcccagggugaggagagcaaacagcaaaacuuaaugacuuuaauaugaaagaauuugccacuaauuaagcacaaacacuccacuaaugcagagaacacauguuguggauuucacuuaagcaggaaccaaaugaggugaaaauccuuccaaaaugauagcaguucaccggcagaggaagacgcugccucuccuugguccugucgggcaucgcuaugagcagaucccggccuucuaccagcacagccuccuacccucccugacuaaagguccuggccaugcucccucgaccugucuuccugcuggcaucccuuccccuggcuguccuucccugaguucuuccauccucuggagacacaaaaaccucuccauggccugugucuguccaacagcaacuccugagcccagcauucugaccaccugucucccuaagcacagcucagcucugcccuucagacacgaaggccugccuuccucuucuuucccaggacauacauggaagguuucuccaucggcuggcaccucucacucccucuacacccagcuugccacugcuggcccuacacacccaucaugcauuucgucuccccuaccugagcucaucguccccucccuagucccuuggucuucauuaaggcaauuuuauuccuuugggggcaugagacggugucugaauaugauuuaauugucacacgugaaggugcuguucuucauaucuaguguguagaagcaagggguacugcuaagugucuuacaggguccaagacugaccccaccagaggggacugucuggcccaaaugucagcaguuaucuaggugcccuugcuggggaaaccggcucaccugcaucgaggcaggucuuuccucauguguuaccaguaacagcacuuagguagcuucucuaugugucugccaugcuagggacacauaggaaugggcucauugcccucuuauaucagcccuagcaaucagcacugucaugauccccacuuuauacgugggggaauugacacccagagcgauccaugcaacuuaaaguuguccaguucguaauuagugcucacgaacuaauuacuucauguaccccaaugaucuccauagaccucacucuaugucucucaaccccuucucccaaccucuugggugucuuaccucucacccaaacccuuucucuuagaaugagccuucccugcaggcaggcaggcaggcugguauaccugcccaauagacuccccuuccuaccuccaucucugcaaggcagagccuuugcagagcugggugcuggacuggcccaccuugccuucccugauacaaggcagacccaagagcccugcacugccaagcaggcgcuaagccucgcuguaguuuggaaccgugaucacugaggcgaggaaggcacaugcggguccugagccuuguaaaggcuccccaggggaaaccuggggaacucuucccucugccuucucaacagcccccagccucucccuccucuaugccagucucccaaaagggcugcugcugcacuuccccagugugucaguagcagugcaugcaggcucacggggaagccccggcugugucugcgacaguaguguucacugcagcgucagccacccucaugucgcccuaccuuucugaaucuuggucuuagagccagaggcuucagugccugcaagucaagaauggccaggucaggcagaagcagcccagggcuguggagggaggaggguggagccggagaacacagagacguaaacaggcuuagauggcaggcugggagcaaggccccucugcagcagcucgcuuaggugagaaaacuauuuuucaccuuaugcucuggugugaggaaggaagggagaugggguacuaggaacugggacagaagagagagaaagggaaucaagccugacagcugggaagcgagcaggaagauacaggauugaaaaggugggcgagggaucaaaccucgggguuucccauucucaggcacgggagagucagacccgaagcuguguccccuuaauacaggugaggucccagcuucuccuccugcuccuuggcuaaugcacuucccaggagcugccacuggaccugggacaacgguuagccuuggcucaggaccacaaauggcucacagacuucgccaccaaccagugggggugcccugugaggucugagugucaggcuuugggcugacaugcucuaacaagugcaugcccaugugugcacccugagcacacaguaccaccuaacccaugauaggggcaagaagagggggcucccggaagcugccucccuagaggggauucaggaagaacagaagucacaguauauguuuaacagaaggggcagcaagccagaucuccagcagucuuuucauagccucauuuucucacuguucuuagucugggacuccuuguucagugccuucccuuggggcgugguggcucacacuuauaaucccagcacacaagagguugaggcaggaggauugccacaaguucgaagcucacuuaggcaaccuucggcuugaucuuggggaguucaggaaguuuacucuaccucaugggcgcuccagccaggacuguccacucagcaucguccugcgauggaccaaugacaggggucuaggccacucagggucaaggcuugagcaggaggaaagcauagggcauggguguuggaguuacaaagaaagggguugugcgugggggcccagcccaggcguguugagaaugugaagugagagaccacuggggaugagggugcugauggugggaggagcuuaggcggaguuuagauuuggaccaguucguccuagggucaaagcuguuuaggaacuacugugggcuggaccgggugacuguuuggcucuggaagaaccuccuguaccccagcuuugcugugguacaguguggauuugaucugggaggaauuccaggagaaguuggccagcauacaaagacagagaaccaacuggucauuucacagugaauccagaggagggccacaguuguggcagaaugaccugagcagaucccucugggauccucaggccuaccacucccuacucaagccccggagacaagagugaccaaguggcagggaccagagccugccugcucguuuccugcauguagccuuccucucaccacugcccagaggaaaggcgucaagucuaccaggggacauagaaugggcugagaccuaaccccgugaagacuagagauggagacagguagagccaggagugaggcacuguuccuggugugccaaaguagaguuccugcuugccagagccucaagggaugggugacaacagaaagugagccugcaagacagugguccaaaauccccaacccuuuccguguuccuugaugggagaaccaaaguccaaccucccugacucaucucggucccccaacccgcccugccaaguuucagggagagauagagcuugucagggcaccccccgccccauggcuacugucacccucggggcuucuguauugccagggcaguggggcuggcccagucugucuggaagauccugcacccuggcuccuucuagguccuuucccaggcugccgcucccccucuucucccacgcacuggguucccccacccaaggcaacugggcgccagccccacagccccaucauuaaccaacuccauguggggagucggggggagcauucagccaagaggaaaacaugggcaguuucugugaccccagagcuggggguggaggcgccugggcucagacaguagcaauuagccccugacugugggaucacaggacaugaucacuacugugaguggcugauagugaguggaaggauacagagccccuggagccaucccagaaacucuguccccaagagaauuccccaaggucuucucaccagcagaggucccugaacugcagaaaguaguaggcuaaccagugugccugaccagggcaggcacuaccaugccuucuugcuaugccuccccagggagggcuggcuggacacugggacaaggagugggucagccgcugucucugucugcuccuggugcccucuaauuccgggucacuguguccccaucccgggugugaaggggaguuuggaagcagguguugcagccugagagccaagcagcuccugaauuaauggggaaccaugccuggggcauagaugcgagaaaggacaaguucaaagggcuucagcgagcucccuacccuuauggguucuuccuggcagaaugaucagguccagaugacagguuggcaaagccuuucaagaggagggugaccccagaaagggaguucccuccugauuccuuuucuuccuuggcagccuaaaugcuuccugcucaaacuuccagagaguugacauuugagaaagaagcugggcuaaggggaggguccuaaagcuuuuucgcugacucaggguuucagggaccccccccucccccacagugagucauucucacuugcauuuaccuguuucucaccaccaccggaaggaaguccuguccuugucugccaguuccuggaggggagggagggagcaugccuagaaagcccuagaagcaaaggauauugguuucaacugggguuguacuuuguugguagggcacuuuacuuagcgagcaugugcaaagcccuggguuggauuuccaguacaguuacacacacauacacacacacacacacacacacacacagagagagagagagagagagagagagagagagagagagagagagagagagagagagagaguuagagggaaacaggguugauuuucuucuagccagaugucacauguaacuaauguagcucucacauuguaaugaaucccauuagucaggaagcuuagucaagagauuaaggcaggagaccugcuaugaguuugaggccagccuaggcuacauagucuuguucuagggcagcuuaggcuacagugugcaauguuugucucgcaacaaaguaaaacaaaagaaaaacaaaaaaacaauguugcuuuggcacagagucuugucagagagccuagcacccuacaccuaugcacacagacuucucucuuggacacuaacacucugcucaagcgacugcuggagacacugaggccacguuucuggaaaugaaggccuggagaagaucaccacagccaggccagggcauagugguccucccagaagugcccccuuuacacacccaccugccgagccagacccagcuugccuagccaggacaggaguucuaaagucaaaaggggcaggaagagaaacugcucguguggccacgcccgaugcgugggaacucucaccaucccgcugcagauuaccucuacggcaagcagggcagggccuuggggagcagguucguccgccacaacugaagagccuuuguguuuucuugcugagcuugggcuuucucaggccugugacguugggggcggggggggggggugcuggccugaugcuugccuugcugggucagcacuucugagaagccaggucgccccaacugccuagccugugugcucuguuaaggaaaccgaggcaccagggcaccaagccucagggaccagugucuuggaccuugacuguaugggguggucagggaaagacucauugcuuguacccucugauguaagaacuccuccugcagacgcaggucucacgucucuguccccuguccccuuacucauccagcucugaacauagcagcuuucucuguaggugcuccagucugaguuccccagacucugugucugacccacagugacaggaucccagcacaggguacuuaugaguauugugacugaguacugugauugucauuggugucauuuucaaaguacugugggguuucugaaggacaccacccagagcaaagcccuagagagacagacugagcaagacacaggguuaggaugggaauugcaguaggccaggggacuacucuccugugucccugggcaggugacccaauccucccugaccuggcuggugagagguuuccugguccauugaacucuuuuuuuuuuuuuuuaaagauuuuuuuuuuaaagauuuauuuauuuauuuauuauauguaaguacacuguagcugucuucagacacuccagaagagggagucagaucucgugauuggaugguugugagccaccaugugguugcugggauuugaacuccugaccuucggaagagcagucgggugcucuuacccacugagccaucucaccagcccuccauugaacucuugugugcuaccaugucacaaagcuccaggcuauggucuguggggaaaggggacuuuccuauuggguaaccagagagucggcagguuccccgugcuugggcaaaauguggucaacacagcucagggucaaguaugucccugcuuuccccaugguagcuagacagcugugagugacaggauacagacucugcacaagggcaggaaauaguaauggguacaguugcccguuauaugacauugggguccuaguggaagugcccacagagagucaggaacaagaaccucauggugucccagaagagggguguggggcuguacagugccuacugccagguaggaaacauuuguugauuaaaguucuagagagggagaccuauggcuuugcagaugguggagauggugaggaugcagaugguggagauggugaggaugcugaugcugauuauggugaugauaauggcagcagccaucgcugaccgagcgcuuauuuugugcuaaugcugccuucugaguuucccaugugcuccuucauuucauccucacaacaguuuuauagggcaggccuuagcuauuggaagcuccccuuugcagaugugcacccucgguguaaacugagucauugaaaggcuaagucauuggccacuggguggcaccgaggcagaaugcagacucuucccggccucauugugcaccuccauagaggaugccagaaagauuccacugagcuugggagccacccccaccauuucccacauuaggaagcugaagcagaaaugaagagagaugagcauacacuaaggcccugcuuccuugaaaaaaaagaaaaaaaaaaaagaaaagaaaagaaaaaauuuuaagccgcccagucuaagagcugauacuuagaccugacuugacaugcuugguccaagccagggagcccccauagaagcuugggaaccaggucccucaggcugccauguugaagagggacccgacguugcuaaucuuuuguccccucuuuacucucaguacuccaggagccccacaugccaccccacgggcuaccucucagcccuguuaacagcuggcuauggcagaggccaagaguaaaugugaacacacccguuacugagaaguccuccgugucccgacccagcccaucacagggccagaaagugccagaaaugccuuuguguaugaugaggggaugccaggaauguuucucucuguaccaccaugaagcugcuucugggagaagccaggggagagacaaacaggcucuacccagcauagacuuagauagggaggacacagacaugcaugugugugugugucaugcacacacacacacacacacacacgcgcgcgcgcgcaugcacacgcacuugcacacaugcacaccugcuuuggcacaggaaccuccucaaccuccauggagcaucaucaacaaccuccccucuuggcacugccuuauccuugaagggugaagucauugcuuaggaaguagccugggaaugucagccuguauaccagcccccugccaccccugccagccacacaccugcagagggacaagaggagaugggguacuggggucagugggccaugugccccuccaggccaaccacgccuagcaccgagaugguuccuggagcccgugccccuucccccaacucucaccuguggcccaagcccucccaacuggcuuuuccaguucucagcuuuguguggcgcaaguuccccaauuaugcucacauuaucacagcugcugggcagccuccagccugccuggggagcggaggcuagaggagcaagcaucagggagcacccacuuauccugucagggaggauggaggaaucaguugcuugccagcugaccagucagcaagagugcuagaccaucugacccacugaccuccucucagcacugcuucuggguggggcaagggcugggcugcuguaagacagagccagaaggaaaugggagacccagggcagccagccugcuccuuugacaaggcuagggaaauggcugccagggucccacggguaggcggaaacucaacccccagcuugugucacacuuugcuccucccaccuccuccagcccccccaguaccucugcguggggugccuggugcuuccaagggccagcuggggagaugggaacacuugaugugcuuguaaagcuguaugaacagugagaaggauggggguguguauagaauucucagugucaaggguauggcuucagaaagccaaaaccagauauuagaaggaauucaguaaucccacacacaccucucucuuuuucucucucucuucuucccuccuuuccccucccuccccacuucuuucuuucuuuucucuccuuccccacaucucuccuuuucucccuuccuccaaccaccccccucccuguacaccucaagucuuacuguguaguccaggcuggccuugagcuuaaucauccuucugacuuugacucuugaaugcuaauauuacaggcaugucccaccaugccuagcuuagcgcgcaucuaucucuugagagccuacuguagacuaagccacugagaucccacugucacuguggucucuagaggagaggaauggggaacagugugcuaaagggacugugggcuuuagggccuucccggggcccccacuucucugucacacagaggaggcaaggaccugaggccucuuggagccauccuucugccugugggucaguggagggccugcuauuauugaucaguaaacuggagaugcagaauaggaaguccacaaauguggucacucaucagugacaggagcaauucaguccugugacaaagaugccaccuuggggacaugacaggcucccagauggagagaaguggagggcagagccuggucugggguggucaccccagacuggcaccaagcucaaaggaaaagacuuucuagaugaggagggggaacuuaagucucacccagcugccggcuuccuccuaggaauccccauucucuuggcugccaugcaguuugcccggcgauaaauauuugcuccacuagagaaaaggaaacacugaagccugcuguguaagacagaugcugagcugggcuaggcuuugagaacucaggaaggggaagaguucccuguaggaguccauaguacaggauagaagucagagguauaaacagccauauucugagacagggagggcaguccugggaggaaccuggaggaccagacugggcagcuuccuaacggaaggacuuaagcaggccuuaugggagcugaggggaggggcccucuugcaccuucuccggauuccugcccuguacccccaugucccccauguccuuuccuaccuguaugccaucugguuccccagcaauggguaagguaaaggacacuggauaaucuggcucacuugucagaugagggaacuaagacccaggaaaacuagcuaggcacuucuuggagaguagaacuuuccacccucauacaaaaugacggcaugcuagguagguauggcugcggcgccugcaaccccaguauucuggaggcugaggcaggaagauguucaguuucaagaucagacuugacuauauagauuaaaaggcauuguugggggcagggcauggggaggcagaguguggcuguagcucagugguggaaaacuugacaggcacgagcaagguccuggagcuccauccacauccagacaaaagggagaaaguaggaugcggauguguguggaauacugacccauaccacguacagaaaagcagcauuuggaacaaucucuacaauacgauucugauucuauuugguuugggagcuuuuuucuuuccuccuuucuuuuuuuuuuuuucuuucuuucuuucuuucuuucuuucuuucuuucuuucuuucuuucuuuuuuccuuguuuguuuguuugguuugguuuuuguuuguuuguuucuuuggggguccuggguuuuguuuuuguuuuuuuaacuaauguagagagcuaaggagauggcucauuggguaaaaugcuugccacaaaggcaugagaaccauauuuaggguccccagcacccacacaaauagcaaauguuuguaguggccugcccaggacacaaaggugggaucccuggagcaagcuggcuagacagacuaaccccaucuggguacaaccgagagaccuugccuaaaaauaugagacugagaaacucaugccuucaacuccagugcugaggggggccgagacaagcagaugucugcuaaugugaagccagucugcuuuacauagcaaauucuaaagcagccaggacuacauaguaagaccccgccaugaauaaauaaauaaacaaacaaguaagaagaaagagacuauguuggaacucacuugaggaagaucuuuaacaucaaccucagacccccauguggcugcguaacacauacacaugcaaauacagagagagagcaguuguaaccgggcaugguagugguauucgugaagcaugccagugcucaggaagcugaaacguuuggggauaaugaacucaaggccauucugagcuacaagugaaugaugucauugucuucucagcauuuuucagaauuauccagagugggauuuuauuauuaaauucauuuauuuauuuuguaugugugugcauaagccauugugggugugugggggucaagagaacaauuacaggacuccccuguggguuucugguaucaaauuuaggucaucgugcuugggagccgaugucuuuacccacugagccaucuuaacagccucuaagugguuuuuauaucaaguaaguaauuuauuuauuuggggauccuggggaggggaguuguugaaaugaguuucacauguaucucaggcugauguucuagaacuuacuaugcaacccaggcugaccccaaagucccauagcaaacuuccugcuuugccucccaagugcggggguuugagccacaagccaccagacccagugauuauuuccauaagaagaauuauaaauguaauggcugccguaaaggucaagggcagaggacggaggaugagggcuggggaguagugcccgggugcugaccacuucccauuaucccccccgccaggcacucacacgcagguggugcaggugaacgacuccauguauggcuucaucggcacagaugugguacugcacuguagcuuugccaacccacugcccagugugaaaaucacccaggucacauggcagaaggccuccaauggcuccaaacagaacauggccaucuacaacccgacuauggguguguccgugcugccucccuacgagaaacgaguggaguuccugcgacccuccuucaucgacggcaccauccgccucuccggucuggagcuggaggacgagggcauguacaucugugaauuugccaccuucccuacgggcaaccgugaaagccagcucaaucucacugugauggguaagcugcccugggccucuuuuucuugccugucuagauggcuuggccauccuuaacgugugccaccauggccacagacaccccuguugucauggcaugcucccagaaguccaggcagagcgccucugacuugacgagcgagacuacccaauuucccaaggaucaggguggggccuuagcuuuggacaagggacaggcacuguauuuaguuuggggcucccaccaagggacauguguuggagaauaggaagcaggcaggugcuuuagacacugugauaaggaaggaagaugaacacaccaagacucuuagaagccuaaaaccaggucuguuugcacagcaaggaggguuugcuggcgcgugaggaacuucccaagagaaauucugggaagggcuucaguguaacacagcugggaggcagagguggcuaggguggguaccuagcagaugcccaggccauuucaacuaaugccaucguguugcccccgcagccaaacccaccaacuggauugagggcacccgggcggugcuucgagccaggaagggacaggaugacaagguuuugguggccaccugcaccucagccaaugggaagccucccagugcgguguccugggaaacacggcuaaagggcgaggcagaguaccaggaaauucggaaccccaauggcaccgugacagucaucagccguuaccguuuggugcccagcagggaagcccaccggcagucgcuggccugcauugucaacuaucaccuggaccgcuucagggagagccuuacgcucaacgugcagugugagccagggccaggggcccuuucccauccauugcccccugccuuucuugucuguauccuaaccucucccuacuacuuucucuuccaaaaugcugcaaucucccuguccccucccuugcagcuuccgcugagguucugugauagauaccuacuuguucuaggugcucucauguccucaccauccuccuuccuuaacucuuccuucuaucccuucccuggcuguuccccugaccucacccucuuccaacauccucccuugccucacagaugaaccugaggugaccauugagggcuuugauggcaacugguaccugcagcggacagaugugaagcucacgugcaaagcggaugcuaacccgccagccacugaguaccacuggaccacgugagugccgcgaguuggccuguccccugaaaauacccccacagaggcccaaccacccaccucuggggaguagggaggauuagaaucuaaacucggauuuuuccgucggggucgguuuaagagaccgccacaugcgcacacacacuauggacacacaccgcagcauuugagugcuuagguuuggaacuaauaauccugccagcaggggcuucucucaacccgcuucccuucucucacuaauagagaguuuugucauuuucguuuggugacucaggcugagucaccccaccccaguccccacugcuuauuuuuaucaagguauccccugggaagcugguguucuggaacaccccagucucucuuuguuucuagcccuccaguaaccccagguucucugaguggaggcagcagcggguccccuugucccacugucgcgugcuugguuuuacagucuggcucuugaccuucagagagaaaccaaacacagccccucuggccgacuugaacaucucaagcgagcguucuuuccgcagagagcuaggugggacucagacagggugugugguagaagcugagaaaguugacauggugaccaacagcucagagugagucuagaguuuuuuccuaggaaguagagagcccugacaggcccucccgguuaccuuccauuuuuuggcacaaaacugcuucugaagaugaggugggcagggccugcuugcccugccagcccuguaguuggaguggcugcuggcuuagcugaagaagaguggacaaaaaugaaggucuuucauauuugacaaacucucaaggugguccccacauggaaacgucuuaagacacacccagcaauggcuggaucaucagugggaaggagcucagccaugccugccuguccacuggacuagcuucuucaaaugcacuuggcucaacagccccacuagaagaaagcuagcuaggggucaggacccagauaucucuguugucaacccaaggagacaaaggacaaacgagggcccaggagcaguggaacucuccugcagccugcagccugcagcuccagcuggcucaggcucuguugcuuccuagcuguguguguguguccuuggccuuggaucucggcuuucaucugauaugugggaguaguacccaccugccuugaauauauuucaaugguuugaugaucagacgugaaccaccaggcaugguggcccagauccuauaauuucaguaccacaggagcccagucgggguuacugcaaguucagaaccaaccugggcuacauaacaaagcccugugucaaaacaaaaagacacaaaaacaaaacaacaacaaaaaaguauuacugaauaauagaaaacugugagauacaagagguuauuauuguuaacuucuaccuuaaacauacucuaacauacacccucagcaaaagggcuggcagauagcacuuaagccaaguggaugcucuaggaacuuauugggucugaagagucauaacccuucacugugucucugacuaucuacagauugaauggcucucuccccaaggguguagaggcccagaacaggacccucuucuuccggggaccuaucaccuacagccuggcaggaaccuacaucugugaggccaccaacccuauuggcacccgaucgggccagguggaggucaauaucacagguaagaaucucagcgucccugaagugccccguccucagguuccuccacggcugcacccgcuccgcucaucgcaucgcgaugggaagucugcaucuuuuucucccuugcuucucugggguucaggccacaauucuuucuuugcaguuuucucuuugcuuuacguggggcuaaagaguacagucagagugacgcucagcgagagaggacagcaaaugcuguuuucagcaguggcauuuaggggagucauacuggcuugguggggcaggucugcagguggagcccaugaccuccaaguucugcagcuggaggugaggaaacccguagggcugcagggugaggcucgccucaagcagaacacaagacaaugucaccggggcuggagugagcagcucccugacagcauuggauacauaugucuccagaccaaauugcucuuuucccagaucuuucugucauuacaugagggggucugucaguccggggaaaugagcacuuuugauguucugcauggagacuuccccugggacaugaccugagcaggccucaacuguguaauggggccagugugaccugccuugaaggaagggcuccuguccagugacacagaauguaggucacauaaccuagcacaacucagucugucaguaaauggccagggcucugugauuauuguccugaccuccagcauuaacauugucauuagugggagcaucaaaacaaaggcaccaaggacuaaauugccaccagaugucacaagggggagugccuguaguaucaaaccuaaguuccuuugucaguugagaaagugucacaaagacccucugaaaacaggaagggacaucccacugccaccaaaggagacaggauguagcaugugcagagugaccuugggcuucaggaagcuaggugauggucagaguuguagcuagacacacaucuggcauugagccucuaucucaagaguaagauaucaaccguggguccgcuccaaacaccacaaagcagcuggaguucuccaggcacugcacugaccuguccuuggggcugucuugucaccuaggaacuacagagugguauagucacuuacaauuuucuucaacuccccgucccugacucugagacuuguuuauaggugcagagguaccagggcuggaaccuggugacacccaaggugacagacaggccagauaggguuugggaguuccuauagaacagcagacaugcagaagagagcugccacacauuucuucccuucuggcacaguuuggagccucacaggggccugagcuuuggcucucagacuguaggauuggaugaggaaaagccuagccacuucauuugaggagucaccauagcaugugcgaccaguaugucauucgaaggacaggaauguguuccuauaaggaccguucuuggcuguguggcccccaacaggaucaccaacgucaccacaccaucccacucugccacccgggcacucugggaaaauagcuggguggaaauuuugaggaaguaaggagccccaaagcaucuucucacugaugcuacuucucagcaugagaagacugaccagagauccugcuggggcaagugugcccagccucagagccacagauagcaggagagugauauccucccuucucugaaagcccagggacaaaggcaaugggcacgaggaagggcugcuccuuggaggcucagguccaggagcagaaaggaggagaaggaagaggaaauuagccauaaagaagaagcugccauggguacccaguaccggcugugggaccuguagucaggucuaggugguggugugugaucuucugcauauaauuucugguggucuaaaaccacccagagcuccaguuagaaaaggguccgucauaccagggcucuguuguuggcaaaucuaaugccaggagccaagagccaaaaaagcaaggcaguccuugagcuccugauaagagcuguaggucagcccugcagggagcagcuuccagcccuucuaagggauucagccagauguccuaagcuuuucagugcugugcauucucuagguggccgacaaccucaccgcccuuuuccccacaccagcaagggcccucugaaaucucuggggaccaccccaaggggcacagcugggcccugagcucccagccccacuggucuaaaggcaaugcaugagugagaaggguaaguggaaauuuaauauuucauucugaccauccugucagguaauagcuuugcccuggguccaucuggagagaggaauagugagcagcuggggugggguaggcagggagagcauguaaggugagaagcuggaacagcaaugaugggcacagaagaagggccuugcgaaccuccgggagacucucagugaagcagccuagcaguguguguguguguguguguguguguguguguguguguguggugggggggggggaguuugaccaggacaucaguuaagugccaucacagagaaugaccccuagugugaaguagacccaugcuguggccaaggggaggagaaagcugagcggacaagccaguagaauuuguggauacaguuaacaacaucuggccacucaaagaagcccauuugccaggcccuugugcugagaagcaguuucagaguccgggucagcggucccgggucaguggucccacaguguaguagauagaacccuucuuccacaagggcuaacagucagugugcggagggacccaggguacggccuugaccaaauaggaguagcuucugcccuuaaggguguugggaagaaagccacagguuggccucuugccacucccaagagcagggaggggaagccacucaaguucacugugucugucccaacucuuacuucuggugaugucugggcucaucccgugggcaugccagucaggccaguucuuuggaccaagguuugucggccuucccagggagugucucuugcaaguguacguguccagacaugacuguggguguguucuccuguaagcaugugugagccagugugagcaggcaagccacugucugccugcugagugugcaaacagaagccuggggcuaugcugagggcaaaugggcagccuccaagccagcaaauggcaguauguuugggaauccgaggaugcagcugcaucuguaccucugggaguucuuccuccagcuugcaggagccccugucagacuuuauaggaacuacacagcugcuucagcuaacagaagaggauggcagggcuucccagaguaugaccccaggccuucccaucuucccuguggcuggccucacugcaugcugggaaauguaguucucacaacuuucuggcuugaucugauguaggucauuuccugccugccaaaauauccggcauugguuauggaagcaagcccagacauucccuuugacccucgauccuagcuccagacuauaaacccuaagucugguucaccuuagguccauccaaagcccccucacacugggccacccaucuuagucucagaacuggggacccagaaugaaaaguuccauugcucugagguucuguccaucccaggcccccagagagaagucugcaaaccuuuagaagcagggccaaguggaccacuuuguagaaggaugugagagggaccagcugggcccccgacagcaggagcaaauguccccaguguggcucuuccuucuccacccagcuguggcgcuugucggucugcuucuggugagaagcugcuggcugaccacugacaaguggaaggggagaggggaggggcaggaugcccccuuacccccucugaacaugaauuaaguucccguaacgaucccuucccucugccucccuuuggcgcuuuuauuuugacaucucagccaucccucugcuccgcacagaccugaccuuaaaguaguuaaaauaucguggguucccuuuggucccuaaagaucccccaggcacaguaaaccucauuagagcuuaggaaaaaaaguagaggacuugggcaggggaggucagagguagagaaccaagcauaaucugccccuaagcugcugcuccuccuaccaugauucuuauaaaugagguccccaaugugucccagguccacuuuaucuguggacugaaugcuggccccgcuaaggcagagccauggcaugagagaauguguccuuuuauccaacaaggaugucuuugccguguaaucuaggcacuugggauaaaucagugagcaaagcagauccaacuccguccuuggaaagcuuaugggguccugaaggggaauaggcaaaggaacggugggaaggaggcugccgugcugccgacauugcaauuauaaguacgguggaugaggaaaguggcccuggggaggugguguucaacccaagcccugaaggggaugauagcaugaagcucccguccaugacaaugaucccucagcuugcagaaaagcaggacaagaugguguaagugcuuggcagggcgccggucauggagagcauucuaggcucuguagcuuuggcuuucucugagaguaaaacagagucaaugaggggcugugggcaggguagcgaugggaugugacuuacacguuaaugggauuuuacuggcugcuguaucaaauacagucuauagaagcaaaggggagagagcaguugggugucgauaaccauaaauaauccaguugagagauggcggugucuugaaugagggugguggggauagaauggugaaaagcaccuagauucuagauuuauuucgaaauauaauuuacagaguaguuugggacaccaaccauucucaucagacagaugauacagcaaacccugucauccugugauuaguggggucagaaaauccaaucuagccgaguuaaauguaagagcgcgguauuuuucaaugguucuucgcugggagagcagggagguaaccgcgguggaacuuacaugugcauagcggccgcgcuucagugagucagcgccaaaggacaggcggccacuucucccagcucuucccuuauuccgacuggaaggagaaccagaacccacugugauuaaucguaaccugcgcuuauuagcaaugaguuuguaauuaauagacuuggaucugacaucguguaaaauacagcgaaggaugcaaagccgucgguccauaggaagucuacagaggaagaguuaaacaugaacuacagaacugaagcaugguggaggcauugcagcagggcguguggugugaacgaaggcuuguuugugcuuagggacucacucgaggcugguucuguauucccagcuauuugggaagcugaggccaaaggaucacagguucaaggacagccugagaaacuuaccaagacccuaucucaaaauaugaaguaaaaagugguuaagaauauagccuggugguagaguacuagcuggugccaggcacuuuguuaaauccuuaguauugcauacacaccgcaaacuggaacucagauagcaaacauaauguauuaaucagcuuucugguaccugucauaaaauacaugagauaaucaauuuaaaaaguggaaagguuugcauaccuuuaaucccagcacuugggaggcagagacaggcagagcucuauggguucaaggcuagccuggucuacauagugaguuucaggacagccaggguuaugucaugagauacuugucaggucagggggugcagggagguagguggggaggggaggggaguacacucuagcucacaguuucaaaaguugcagucuaugacugauugaccuguuacauuagggccuaugacgagacaguguaucauagaaagaaugugacuguagaaugacucauucacucuguggaaggcagcaagcagacaagagacaggguccccauagcccuuucacagguacaccccccagugacuggacuuucuacagcucuaaagguucuaccaccuuccaguagugccaugaacuagcaaccaagccuuuugcacuggggccuuugguaaggacaguuauccaaaucacagcagucagcaaugaaggugcaugagaggagcuuggcaggccagguucuaagacccagcaggcaauggggacucacugcuggucuuugagacagaguggucaugucuuuccaaugggaauuaaucugcugacuggguggggcaaccaagaguagagacucaguaaaggugagaggcccacaaauguucuaccacaacaaaacccagagaggaacucagagugaacaaauggugguggucgugggagcccaggggaagcccgguaaauagagagaaugagaaaggacagcuagccauguuagaacaggugggaauuuugaguuggcagucccagagguuucuugacucuauaaucuaacuguuaguucuccgggaugguccugucuucuggaagcugggaaacccuccauccuguguguguaugucauacuccaggguaugggggaaggugaagggcuccagugugucaucuaagccaauguuucucaaaguguuuguccagcuguuuuugcugaccucugaguaacggcucaagguuccaggaaguacaguuuggaaaacuaucccagacaccuucagagauaacaguucuguggcugagugggagcuguguacuugagguggcuugagaagccaggaggaucucaguugagucacagaauggagcugaguucuguccugagcagagacagcaaggcccguagguccaaagauaaagccuccgcagggacagcggagaaagcucacagugcaggugguuacagagcauugaaaggaaaagccaaggacucagggcuccucaccucugcaggcgaggggagcauagcaguucagaugcagcaggcugguccuuccaucuagaugccucgauuauugucuuagccucucugagcccacaccaucauccuucaaggcuggacaaagucuagccuccaagaaaccuuugugaauugcgugccucaauguucuuauucucuuauucccugagcacuucacugucagcuccuuccaugucugcuugcugcagugaucccaggcauuccuuuggcucuauagcaaugcuaugacuagagagaaaaaauagucgguggauauuugcuaacugaauaaggaaguagacaggugaagauuggccaggaguguggcucagaaccucaacgcucaggaggcugagcuaggaaggucauaaguucaaagccaacauggguuaaugagaccuuguuucaaaccaaccaagcaaagaaagacacggaggcagauggagaggaggacuuuaucugaggccuggagcuggggaggcaggcugagaacacagauuuccuuucuaaggacagugggacccaguaaaccaugaugagcucccagagaggguugcaagagaagcagucaaaacagcucucaguaaacacuuaaacucucucaguaaacucugugaccugcacugaggacacaguggugacuaguggggacccaaauccucugggcuugugcuucucucagacagcuccaggcucaggagcuucugggcggccacagcucagccaugugaccucaggcaagugucccggacccuguccccuuuugaggcuccuguguuuucacuagcccucccagccugagcaacaugaaaaccucuucccccauccaggaccuccgcccugcuccugccugcuugccaguagcaccccacacacucacauggggcccaugggaggcgugugauuccaauggagugagugaugcugaaucagggagugagcuggcugcagcaggcucccaggagcagacacaugggcccagacaguuccuugacccuggcccuccugggccagaccgggaagaggccuggacagcagccuuccuuccaugcuugcccugggucuacaccccagcgccuuccugaggccagucauggucuccggugccacccugugguggugcugggaaccgucucccuguguccugcccuaggaccucuuggccucuggccugggcuggccuggacugacuucauauucacucauccaccucccaggccucagaggggguggaaaaaagagacaacaggguagaaaagaaggccaccauccaccucccccuuccaucuucuucuggucuuuuugucuuuuccugccuuuauugccuuuuaauuuccacucugcauuauugacuuuucauuuuuccuuuauauuuuuuucuuuuuuuuuuuuuuagacagucuugaucuauagcccagacuucccuugaacuuauugcaaccccccuaucuuagucucucacauccugaaguuacaaguaugagccauuaugccuggcucagaccguccacacuaucugcauauccuuccgcauacauuugugccuggcaaaaccugugggacauggaacaugcucucacauauguaugcuccugaugugugauacacauguaguccucuguauccccuuucugccugucccugcucugugccuaccaucugucacuuuggguguuucaacccuguagcccaagcuagcaaucccaacaggucucuaccuugcccugcagggccauaccacaaccaaaaagucacagcgcuuguuuguagcacacugauaggcaguuggcacucacaggacgucggcugagccaaaacuugggaaucuacuuucuaucuguccugaagacaaaaggaauuagucuggauuaccuacuagguuccugguguugggucagucacuucuacaugucaggcaaagggacacugguggcacuugcauaggguugauaugaaaaaaaaaaaaaaaaaggcaggaugauuucuaauugggccuuuggguaaguuaaccucgcuagccaucuccugcauugaauagaaaugaacagcagaccuccuuggaggguagugaccgugagggacacacaguugggugcauguagaugugccucugcaccaaggugggauaggacagaacuaaugccaccuccagggauggucaggauggaaggcugggcgcucuggguacaucagcugccucugcuccucucgccugccuggcucccagugcugcagcugaccucaggaagguggggugcuaaggggccucuggaaucagaacugcucaaacucgggguguggacauccuguccugggcuuuucccuccccugccucccuacacccccgcugacuucugaagagcagacacugacacaacccccuccaucucuuuuccucacccagaauuccccuacaccccgacuccugaacacgggcggcgcgccgggcagaugcccacagccaucauugggggcguggcagggaguguccugcuggugcugauuguggucggagggaucauaguggcccugcgcaggcgccggcacaccuucaagggugacuacagcaccaagaagcacguguacggcaacggcuacagcaaggcaggcaucccgcagcaucacccgcccauggcacagaaccugcaguacccggaugacucggaugaugaaaagaaggccggcccauugggcgggagcagcuaugaggaggaagaggaggaggagggcgguggaggaggcgaacguaaggugggcggcccccaccccaaauaugacgaggacgccaaacggcccuacuucacuguggaugaggcugaggcccgucaggacggcuauggggaccggacucugggcuaccaguaugacccugaacagcuggacuuggcugagaacaugguuucucagaacgacgggucuuucauuuccaagaaagagugguauguguagccccgccuucuggagccucugucugugcccacuucucccaggccccuacccgcacgccccccugcccacccccacagcccacugcccuaaaccagccccaaacuccugaggagccagaggagcucagggcagaccccacuuggcuucguuuuuuuguuuuuuguuuguuuuuuguuuuuuuuuuuuuaauuuccucccucacccacccuucccccugguguuguguucgaccguggcuuugguguugcuguaccuuuccuuuaaggaccccuuccacugcccuguguguagggagcccuguucuugucuuguguacuugggcaucccuccaggguuuggggagccaguccucucccacccccccacccccaucccccaacacuggaauuuguuuguguucucuccguugggaauggagggcaaagggagcuucgagauggagagcacccucacccccacccgauaugcugcuccucuucucagaaagauguaacccaagcccccacuaagcugaugcagucagugcaccuaagagguuuuagaggaguucuccgugguacccaggggagucuuguguggggaauaauggagcugaggguucugcugggguccugggcaguguguuuuccuggugagggugguuuuauguuuucuuuuuuuuuuucuuucuggccccccaaauggaguuggcguagcucucauauaccccucucuguuaacgcccaguccguucuguacacagugggugaccccagguggauucuacccacaguuccuauaugccucugccaacauaugcacacauauccaugcacacaucccugggccuaugccaaccucucacgcccugcccaggcugaacacugcccgaggcccaacccucugcuccaccucuuacccguucccagcucaggaagggaucagcccacagaagcauucagagucagcuaggaugaaccucccgcacccacccacccacccccaaagccacucuacaauuucaguguagcuccaaccuuuccugacaauguacauguuucucggauuucuccuuaucugucaagugcuagcaacacuugacucuucuggaaagucagggcugggaucccaggaaggaaugcgaggcacagaauuauugagacggagaaggcugcuuuguggaaacugcaaacacaauugaagggggacugcuagcgucucauaugggaaggcuggccuagaugugucucgggucucaaagaaagugcaggggcaccggggaccugcugcguauccacagacugaccccugcucacucucuccuggugccagacuggcaagauggccguguagaagggccuuugcaugcagucucccucuuugaaugggauucuggcuuugucagccguucggggcugggccuucccuugagugcauggaaaaaggucuccccaccccaccucaccccagcccucuguccccaagcucaaagugccucgguuucuccaucugugcccccagauuacccucauucuaaaugggcauucccagggccugccugucaggaucucagccaacucagcccuaagugacacucgcugagggaucacaaacauuggggagagggaggcagaccauucugugcccuacgggcacugacccacccugccauaggcuuccuaagggagccccagcccacaccccacuccucccuggugcugcuauugaguucccaguccaagcgccaucucuggcaccccuuacucagcccaccagcuggggcucuucugccaggcccucacugcccuagucccagcccaggccgcccaguagccacguagcagaagucugaagccaugccagcccuggggcggcucuccgucuuggcauuggggacacuggauggggugaaguuuggggaagaaaauucuggggccuuucuagccacagggagaaggaagauggaggagcugggcugcuucucccagaaguauuaguguccuuuccaugucacagcucauccuguuccucauaccacucugccccucuccuuggucccccucccccacccccaaggcaggaggcagaacccugacugccccagagugguauuucugucccuauggggccauaagacugaaagacucacccucccgagucucucgcaccuuucacggucauccccuauccccugucuugugauggaucgaggaggcccugggccuggacaaagcaccuaagcucccuguacaaaccugcacgccuuuccccgaagcaaagcacaauuuauaggguccaugcagcaggaucuaggauccccagccguggcacugagcgcuuccaggcggccgccaccugggcuaagaaaggacaggagucaggggucgguagcuggacccaaggagaaggggcuuuucuugcccuguguuugcgggacaguggacacagccagcugacagugugacagagcggagggcauuuugcuucaccuucaugccccccccccccagcacagcugagcuucugccagacugcggagaguaaacuugguguguuaccugcccagaccccuccggaugucgucccuagcugcccucccccuccugucccuccccugccccuggaccccuguuucccuacagauuuugguauuguucuggugugcaacaacccucugagucucuuuuaccagaaggaccugaaauacagcaacacacaauuagugaacacacgcccagcacaccaacacacgccuuccacagaccaagcacaggugugugugugugugugugcacaaguacacacauaaacgagaaaccuguauuaauuaaugcucgggccccaagcccugggaaggcgcacccucugccagccaccccagcgugccccagucacuggugcaauaaccuuccugccaucguccaggugggagaaucaggacucacgucaggugggugaggccaccccucugagcccagcagacacugcauccuuuccugggaggaggggggugcucccaggccucuggaggaguccagguagagacuuccccaagccuaacugccaacugaaacccucuccuggugagggcagguggcuccagcugaccugggccggagacaccgagaggugaggaaccagccucgcugaugcugcuuucugaccccagcugugaagagugggcuggggggaagagggugacuuuuuuuuuuuuuaacaaauggaaacaaaauccaggagaagcugccacccucgccugagugugacuaagcuuccuuugcuucaguuucuaugucacuguuuuccucuuugguccuggggacagcccagcagauuccccugguccugaccuggagggggggagugguugccccgcccccuuuuacuuguauuaaaaaaaaaagauggguugaaaauguacugagaaaaaaaauguacuuuuuuauaaauaaaguguuuaaaacaag

SEQ ID NO: 5045 - RNA, 2125 nt, Mus musculus
uugaucuugacucgauucuucuugugccucgccaagaucuucaugggguuucccucugucacaccugauuuuuaucaguuuggauggaauccagagguuuuucuuuucugcugaaaucuccucccuaaccuuaccuccuuucuucucuuuuagaacuuggacucccaggcugaucuaauucagcagugcuuucuagaauccaguguaucuuaguaguugugcuguuugucaacaaagcacauuuuaaaccaucuuuuggagacaccacaucuccuuucuaucuauucuaugagcauuuccauccaaguccuguuacaacuuuuauaccuguggagccuauaagguacaucuguaauggguuuuaugucaugaugccuaaaauaccauuguauucuaauagauguguaugccugagauucaucagcuuuaauuugcaaagucguuuuaagacagucaucaucucuaacaaaugugcaaucucagaaucguuccccucggaacucaaggcagaagccccauuggaacuacaaccaugcaucaacuguacaauggaugggaaaguguacguauuucaauuaucuaaacucuauaacguggaacacacaguccacuguguggcauugcuuuaaguuggcaucagcaagcagaaucugggaucuucauuuaauauauugcaucucuaugggcugccaucccaguuucucaagcccuguggagccuucccaucuggaacuguuuuuugauguuauuauaaguuccagauuggauuacucaguguuuccuauuuugauuuaaaggucccuucaaccucuguuucauggucucuaaucuauuaccuaauuucucagucucuucuuucuccaagucugucuuauucugaucucuccuaaagaggacuguaaucauugaaaaagcagccauuugcaugcugauaaucgaagcaagaucacguggaauccagauaacauugugccaccaugcuuccuuccaucccaaauauagaaaacauuuuucuauuuuaauaucaagacuucucccuaaggacuuuauuuucuuacauuuaaauuaaauauuucuuuucgugaauuuuuaauaucucucuuuccuucccuuuuauuguucuuuaaauuuaauaccucaccaguuuagauucuugggacuuuuuauuuuguaucuugugcuguugcuagcccagcccuggccauucagauagcucagggcucuugguucccccuuaugcuggcccuggccaggccuuaccuguagagcuucugcuggcuucagaccuagcuccagcacguuuuuaacugugcagcucuugguugacguugcagccauugugccccugggcuuugguuugcuuuuguucuuuuuuacauauaccaggcaggccucuugucuggcuagccuccguccccugccuuucaccuaagccuuuucaggcugugugcuuggguucuacuugcaguaagucuaaugacaauuauagaaguuaggucugauacuuccucccagcuccaugcucccagaaauaagacucagaauauauuuacacauaccuuggccguauagcuaggcucuuaacugacuggaucacgacuuaguauaacccauuuauucugaucuacuuucuaccauguggcugguuaccuucugcccagguaccaugcuuccaacuccugagcaaaucaaccaugccugguucuaucccagaauccuuccugccuccuggaugucucuccuccaauuuccugcccuuaggccaucagauuuaucguugacaggugccucauccauacagacaagguauucucacuacagaugccuucuuugguuuuuauuuuuauauugagaaacagaaaggauguugauccagaugggguagggggagaaacuaggaggaguaugaggagaggaagccagaaccagaacagaauauauuguaugaauaaaauuuuuuuuuucugcgacaggguuucucuguauagcccuggcuguucuggaacucacucuauggaccaggcuggccucgaacucagagguucaccugucucuaccucccaaguccugggaucaaaaaggucugucccaucaugcccagcaacaaauucuauuuuuaauaaua

SEQ ID NO: 5046 - RNA, 8511 nt, Mus musculus
cagugaagcggucauuccagaaggcgaccagggccagcuccaugccuccacagcaggguagaggaaccugacugagaguccucuaucagggauaccucucuguugcuccucugcuagaggguccccgcuaguaguggacaaaccugagcgagcgcugcuacugcguccaagagucuacagcgaccgggccagcuucugccgccucggccagucauucgagccccaggacaccugucauugcuccuucaaccuuuccaagccagaaaacgggaguuagccucuaggccuggaucggggagcagcagcucgcagccagcgcgccgggggcccgcccccuagggcgcggggagggggcggggggcuacgcggggcggggccgggcggcgcccgggguccccucccccgccccccugacgucagcccccgacagcggcgaguuccucacuuggcucgcgcccuccgucggggaagcauggggcugcccaaacuggugugcgucuucuuguucgcugccugcugcugcugucgccgugccgcgggugaguucuuuauguugagggggcuguggggggcccgacccgcgucccucagagcccaggcguugggaguuuggggaugucuucgacggagccggacugugccgccugaguguaccggagaucagagcugguagcaacguagagucggggcucugcaccccagugggcgcuccuucuugccagaguccccgauuuccaggcgccccgcgugcgugcaacuucuuugcgggugugcagccuagguuuuagaguauucugggaacggacuagucggguugcugcagcagcgagcgggaagggguggggccgagcuucugcaggacgcugggcccggccucccgcagguguucgcucugggugcuggaugcugggugcuggagucccggcagagaggcgcagccggggcgcauccccaacccgugcaucccgcgcccgccuguugcuggaaaaggcaguuucccuagcuggagggggccgccgaccccucccccuccgccugggccucacgccaguuuggaggugagcgagggaggaggccgcuccugcuggggcugggcguuggcaagggcagcggguggugugggucuccuugcgccuccggguuugacgggauuacaggggaaagacaacagauggagaaguucuacaacaguaacagcuucugugguccacuagagucagguggagagagccuggcaccucggagcuuuccuuuaagccaucgaguagacaugcuuuccuggguccgggcuucccuuguagggcacacgcagcggugucguguguuauucuuggcucuuucucgcgucucagccacuggucaggcuggggaaggggaggacugggcauuacccacuucucuggccucuugcccagugccagccacgucccugggguacuccagucuagugccucccagacugaccuuauuucuggggaaagggcuaaacccagcuaggcaaucgcagcacagaaaacucaguuucgcucugcccugcucuucuggcccuuagaaagcagggauucaaaguuccugcuguugguagaaggcuauucccaccuucccuccagucuggaagccacacaguccagacaucccaggguccaggcagauugugcuuagugacaucaccucuucuaagagcuggcagcaugcuggcaccacugacgucacuccugcccacucucugguuuuugaccuaacccuuggcggagacugaccccucuagacuuggauggggucuucagauuguauugcagcguuucuugacaugcuacugugggaacauaaaucauagccucuggcuagaguuggcucacugugucuuccagaggauuugggggacagaggguagaauagugacgucuucguggagggggggcacacaaaggggccugugugccccagccuggcacaugccuuacauuccccuagucugagcucaccaggacuaggaaggggcccaggagcaaaggggccuucaucuuggcccagagcccauguugcucuuaucugucucuccaccagcuucuucuaagauauacccagucacucugucuguguuucacuccguauuacacugggagaggucugacccagguugggggugugggcuuggugaaguugaggguaaggagaggguaaggcccuccccagacccuucaagugggacagcugcagugaaccaggagaggggaggggaccggacagaacaccuggagcugacaaagcugccugggcaugccccucucuuuccccaggugugccaggagaggaaaagcagccaguacccacgcccgaccugguggaggcagaagugggcagcacagcccuucucaaguguggccccucacgggccucaggcaacuucagccaaguggacugguuuuuggugagcgccuggacuuuggagggcaguaguugugugggaagcaacugucucucuggcagguagcucaucucucagcuccuuucccucagauucacaaggagaggcagauacugauuuuccgugugcaccaaggcaagggccagcgggaaccuggugaauaugagcaccgccuuagccuccaagacucgguggcuacucuggcccugagucacgucacuccccaugaugagcgaauguuccuguguaagagcaagcgaccacggcuccaggaucacuacguugagcuucaggucuucagugagugccccccucguuucugccuucagggucguguggaccauguagcaaagaugggucuccaugucccuguucauuccccuuccacuguagaagccccagaggaaccaacuauucaagccaaugucgugggcauccauguggacaggcaagagcucagggaggugagaggcacucggucaaaugaugguggauagaggcuaagcagggacgggggugggggggggugguauguggcagacgcaaggagacucucguccuguccuccuuagguugcuaccuguguggggagaaacggcuaccccauuccucaaguccuaugguacaagaacagucugcccuugcaagaggaggagaaccgugaguaacccuuacugagaaggcucaggaggaccaucuagcauguccuuguagagcuuuuacuaaaacaaacaagcaaacaaacaaaaaccauacaggugaugcugaguaagucagacuguaggcuggacaguuagcuccaugaacaucacugguugcuuuugcagaggacccaggucaguucccaauacccacuuggugguucccaacuccacuuccagggggaucugaugccuuuuccugaccucgaccucugaggacagaaggcaugcauguggugcauauacacacgaaggcaaaacauuccugcacauuaaacaaacaaacaaacagccaggugugguagcgcacgcuuuuaaacccagcacuugggaggcagaggcaggugaguuucugaguuugaggccagccuggucuacaaagugaguuccaggacagccagggcuauauggagaaacacugucucaaaaaaaaaaaaaaacaaacaaacaaacaaaaaacuguuauaauuaaauaaagaccuggcuacaaaaucuuuuagaagaaaaauuuagacuauaaaaaaacuuaggaauuccuuucugacccaggcuucucccagaagugacuucugcuaucaacugauauuuuccuucauucuuacuucuguguccaucauguaaacaaaugcuugcagacguguagagagggcugucugcgguguuuugagacaggaagucaugcagcucgaugaccuaacugcagauccucucugccuaccccucaaagcgcugggauccaugccuguaacacuguuccuggcucaaacaaggcuuguguuuuguuuuuuguuuuguuuuuguuuuccugucuuuaaccaggagugauuuuugcauacacacuagucuggggauacuuggcagugucugugggcauuaguggaugucacaaacagggaggcugcuguugacaucugauacguagagguuagaacuacagcucagcauccuacagugcacaggaugggccccaccacaaagguuuaauuccaccccaacacaucaauagugcugagccgagaagcccugaccccaguggccaugcugggcacacaucccuuuguguaacuuucccaggucagucuguucagauagacucaccuugcuuccuagccucguauugcauaugauguggcugaguuuccacucuuccuuuagcauuuaaugucucagugucucagcaccuuggggcauuuguuuuggauucuguauugaaccuaaggccaugcacauguuaagaauuugcucuaccacucagccuuucauucaacuccauuuuucuuugucuuugggguguuccuggccccauccuuguacauaugcuaagguguaagugcuuucuaggguaaauaccaagcaauaaaagugcuaggcugaagggucgucauucuguguucggcuaugggccucuccuuuagacaucucccugcugacccccaggggaagucugagggguccugaggccaggccuugcuuccuccuucugcccaggaguucauauccagucaucacagauugucgaguccaguggcuuguacaccuugaagaguguucugagugcacgccuaguuaaggaagacaaagaugcccaguuuuacugugaacucagcuaccggcuacccagugggaaccacaugaaggaaucuaaggaggucacugucccuguuuucugugagugcugacuuccuagcgccucuggauuuuuuuugagggggggaggauuggggugggccuggugggaacuccugcuggucccucugugucaaauucggggccaccucuuggacugagagccuucuccuuugcccaaacagacccugcagaaaaaguguggguggagguagagccuguggggcugcugaaggaaggggaucaugugacaaucaggugucugacagauggcaacccucaaccccacuucacuaucaacaagaagguacagagagagcgagcgcuccaugcugggugcacggagugggcguaagggugugggcaggagguggggacaguagcuggagggcaucagcucacucucaccccuuugugcuccccccaggaccccagcacuggggagauggaagaggagagcaccgaugaaaaugggcuccuguccuuggagccugccgaaaagcaccauagcgggcucuaccagugucagagucuggaccuggaaacuaccaucacacugucaagugacccccuggagcugcuggugaacugugagacccugggauggaugcaggcuccaucugggcaaagagggaacuggcucguccugucaggcugacauuuuuuugcuaugccuccagaugugucugauguucaagugaauccaacugccccugaaguccaggaaggugagagccucacgcugaccugcgaggcagaaaguaaccaggaccuugaguuugaguggcugagagacaagguacccagacaccuuugagacugggggagaggggggacaaugagagcuugcuccuuuucagacccccugacccaccucucaccccuagacaggccagcugcugggaaagggucccguccuccagcuaaacaacgugagacgggaagcagggggacgguaucucugcauggcaucuguccccagaguuccuggcuugaaucguacccagcuggucagcgugggcauuuuuggugaggcccuuuguacagugaccaggucacccugaguugugugguuuugagcuguuggccagcuuguacugugggagcugagcggggagcaggcuauuugguauuuggggggucuaacccuucccugcccccaaggguccccauggauggcauuaaaggagaggaaggugugggugcaagagaaugcagugcugaaucugucuugugaggcuucaggacauccucagcccaccaucuccuggaaugucaaugguucggugagccggcuugcuucaucuccccauucucuuaaucccugccuaggccuugaggccauggccagagaugcuuccgcccucugagaggcccauuuacuucuaggcaacugaauggaacccagauccacagacaguagugagcaccuugaauguccuugugacgccagagcuucuggagacaggugcagaguguacagccuccaacucccugggcucaaacaccaccaccauuguucugaagcugggugagagcggacucccugcagaggcuggcaggggcaugcccaggcacaggcauuaacuugugcuacuaaccccccaacuccuucugccuccuagucacuuuaaccacccucauaccugacuccagccaaaccacuggccucagcacccucacagucaguccucacaccagagccaacagcaccuccacagguaagccgggccugcgcagugguacccagucagucuccccuuuugagaaaguuaacggcccaucugucccccugggcuggagaggguggggcagcaacagcaauuuggcagccaggagcagggaaugacuacaagugucuuuguuugacagagaaaaagcugccacagccagagagcaaagguguggucaucguggcugugauaguguguaccuuggugcuugcugugcugggugcugcucucuauuucuucuacaagaagggcaagcugccauguggacgcucgggaaaacaggagauguaagccaggcuuaugcccuccucccaccccacccccauuuuuggcugcccagcuugcugucuuauaagggcccugccuacccagugcccauuacccuggagagcagaaacuggaccuguuuuuauuguccacuaccaaacugccaccaaccacaccaucuuccccaauucucccuuccugagccggccccaaagcaccagaguauccauuccuaaaaggucccccccuccccagccucccccagcccccgaguugccaaccucucaccucccuucucccagcacgcugcccccgacucguaagagugaauuuguaguugaaguuaagucagauaagcucccagaagagauggcucuccuucagggcagcaacggugacaagagggcuccaggagaccagguaggaggcaguuccugaggccagggcucuauuuucaggaauuggggguagugggguaaugcuacuuguuccugaacacuaacucuuucuguccuucauccuugguuagagauggggagcagaccucucuugccuuaacauuacuacagguggcaggaugagggaaacgguggagggacccuagagaaagacaacgccccagccaccuucuguuaaacguagagacuuagcugggggacuucugucuuuuccucccccaccccauuccugcugcuugcuuuaaggauguugcagcccaucagcuuuugcuucggccuuuucugucugguggucacgcuguaaaccuugcuggcucuccauguucuggugacuucucuguauccauuuucagggagagaaauacaucgaucugaggcauuagauggcucccauugcacugcucgcagcucccugcucagacuucaccccaagcugaagccuccagagggacagcagggacgagccacacucaacccccccccugcacaucaggucugagagcuaggagcugggacaggagucgucugcaggagcucaguuggcuacagaggccugguuuuagagaccaagcccuccucuguguccaguaaauaaugcuuaucccaaggggcccgucucccagggcauuucccccucccgugcacagccauugguggcaaauccuucugccaucagcugugugggcuugccucuuugagcucaucuccccucacaggcugucuucaugaugcaggaccugggcacauggucacauuauuccguucacauugguccuugugagaaccucacagucuggaggcggcugcuuuuguaccuuccugccugcuacuaauucagggucucauuuggaacauuuuuccuuuggguaguggucaggaacugguguaaguccuccagacacaucccuguguaaggaagccaggcacuguuucucugaguuuuguuguuuuguuuucuuugaaggcuacugagcccaagcuucccgcauucccuuaguaacaagagacaggacagagagaaggucuacuguucauggggauuaggcuuauaggaauguuaguaccaaauuucuacaugugagcuuugggggccagguccuagagagcccaagugggagaaugguauuuaggagaugaaaaaccuggccuagcaagagcuuuugagguguguguguguguguguguauacauauauguguguauauauauauauauauauaugguuuugucuguaaauuugcaaauuuuuccuuuuauauguguguuagaaaaauaaaguguuauuguuccaaaagcau

SEQ ID NO: 5047 - RNA, 4720 nt, Mus musculus
acaggacaaccuggacugucuacuggccaagcugagaguggucaagccucacugggaugcaaaugugcugagacuccacaccagacucaaggagcaacugcggcaauuuggucucaacccccuggaucuuugaaaccgcuggccucuaaucccuaagcccuaucaauaaagcaacuugauguagaauucaauagaacuauggauuauggccuuuggcagugaggacaucuauguucuggguugacccauuguccuaaacacugagugguaagaaguagacaauguucuaaacccuuuccugcagaaacuagaucccauucccuuaagccuggaguacuuuuggucccuuuaaacuaucuuggcuuaaaugggcacggcggugcauaccuuuaauucacacaauugggaggcagaggcgggcggauuucugaguucaaggccagccuggucuacagugaguuccaggauagccagggcuguacagagaaacccugucuugaaaaaccaaaccaaucuugguuuuuuuuccugaccaauaaaacacaaauccugugugugugucuguauacauauacauacauuuacuuauuuauuuggacaguagcguauguauacuaaagugcucacaaagaggucagagggcaaauuccaggagcugguucucuucuucuaccgugugguucuggugagucaacuccgguugccaggcuuagaagccagcaccuuuaccuuuuaagcuaucucaccagccagcugggaaaggcuguaccaggacauuacaauagccaagaaccagcucccaagacucuaagguauccacaguagaaggaagauacaccuccaaucaauccuucugccagaugacaacagagccacaucuaaccuauguucuccauggcuucaauccucgguggcuccacagcgucaucuucuugagcagaacugcaucuuuggcgcacagcuccccaaaauguccacauauagcauccuguggcgucucaggcucccuguggagcccgccuucggucucuguccacaccccucugcuggagguaggcucaugagaaaggagaaggucccuggcaguccugugauuggugguuucugaauccuccagcucccaauuccaacuucaagagauuguucccagcucccuccaccucagggugcagagcgagggcaggagaacuacuaggcaagucuaugcugguaagcuaggcugaacagggauguccuauagcaacucugaagccagaguccaguccuacauacggagagaacaaggggagucagucucaaaccagaagaguucacuuuccugccccaacaugcucugcucaggaauaggacuuuguccuccaauccuucuguccccaccuccuaugaccaacgguucccuccugcacaucucacacagcucgacccguuagcccuccucucugcccuucucauaauuccauuugucucuuugacuucaccucuccagacuccaaggaaauccaggcuucuaagcccugcggauuccuagcuccuagcuucaggcagagggguggcucagccucagucaguugcugaagccuguccaguucacugucuccgcccacaggauauccguucaccuccaaaacuguaucucccacuugcagcccugcccgggcagcugagccuccuggggucaccuggcaguguaaggggauacacaaaaguauugguuagguguucuacggcugggcagacuggggggcagagaaagguagguggugaaugauggguagauuccaaggcacauggugcaucagucaccugggagaugaaaagacaaggcccacuggccacacagcagagucugaauccauagccaccuccaggccccggguacaagaagcauuggcaggagccagcaaggccagaaggcucaacugugucuucaaccggaagauccuuggucucugccagaggaggagcagcaaucucaguguucuccaagaagaggaggggagacaggcguaccuggggagguacgguggggggagaaaaaccuguggcaccugagcccugcuccauuucugcccucuccccaacccagucacauaccaugcugaagaagcggucagccucaggaucgacgacaaugagagagacacaagagcccugugcccggauucuagacacuguuuccucauggcccagcccauccacgcuuuccccggccacagccaccaggcggucuccagccuucaucccagccuugucagcugguaguccuggauccacgucccacaagaacugcccugggacagagacaucuucacugcucuccccugacucacgcccaugcucucccaggaacuaacucuacagugcauggaaagcugccgcugggggcuguggggcaucgcucauggaugcugagaagcacaauugaauguguauggccagccuaucguccagcuuccuaccaacccccagagcugccacucaccaagucggccauccaggcccuucuccucccggagcaggaacccaaagccuucagguccuuucucuauguuuagacaucggggcuuggcgggcaaugcccagcccucugccaggggugcagcaagaggcauuccuaguuggugacacuguuccucuaccuccagcccugccaccagcagagucaccugaucuccacucugccaaagcugugagggcagagcaagaauguaagcaugggacaucugugugggacagaaaggcaggcaucuagcuccucccggggacccggaaugagggcaagccucaugcaaacuagagggaaaagaagaggguaaggagggagaguucauguagggagucaccgcaggaagcccuaccuuccuauugagcugguuguaugugagcuucuccacacuggccccauucacuuccagcagccuggcuccagggggcaccccugcccucucagcagcuccuccugcacugagcaccaaccagaaaggaccucgacuuccuaaaggcagaaaaaguaagucccagccugcugccuaccuagaaccgaagcuaagcuccccaacccugcccacccauagcaggcccuaagcucaccgugggugacgcugaagccaaagccgccuucaucuuuuacuacauggcacaaccggggccugacccccgaggguaggguaggacagaggaaagcgucacuccccugcagaacacgcgccacaucaugcacguguugugccaagacugucagcaauacccggggaccgcuggcccggauguagcgcacuaccuauaaaaggggacacaggagaaaaagguuggcccucugaaaucccaggauccccuagaacgugcguuuucacugugaaacccacgucuguaguugccuucacucaaucuuucucccuagguaccuccaaaucauggggucugaggagagugaggcuuggcccaugaagugcuauggaauguucuuuuguaccacgaggagucccagcccagccucaccaccgcgugguccucaugugccacaauauuauuguucaccgcuaggauccgaucuccuucccggagacccuggcgcugggcugaggugcccggaucgacccugcacaccacauggucagccuugccuagaugcugcugcaaauggaacccaaaagucuuuuccuccuccuugcucaacagacaaaagcgaggccggugcagguuccagggaucuggaggaggagacagguagcagaaaaaaaaaaaagaaggagggggcacagcccugguacaggggcaucaaaagacuggcagacccugcuuuccugugagagcgcuggucagcuuccagccagugagagggcgggcuuuauagcugaaugaacucugcgugggcugggaggcuaaagcaaagggaugucuucccccucuacuucugcuuaguuacugauaucagagggaggcaguuagcaguuaccaaggagauaggaggcuguguggcacccuagugucucuagggaaaggaaacaguugccaagggugaggggguuaccagauugguccuggucuucagcgagggagaggacaggauugucaaugcccagccuuggauuaaacuuaaacuuccuauaaggaggcaggagaggcaaauaagaggugcugggagcuggacuugggucccagauucuacuuuaggugcugcugccagcugagagucgucccccccacccccuucaguuguucuucuccagcccucagacuacuuacagaguuaacaaggccgugucccgaagaucugcgggacaaaggagagugagaggagagacacacuccccaccccacccagagacgggacucucgugauaaaaaaccaaaaagguuuaggagaaacccaaccccuuuccauucugcuucucugucuucacacacacacacacacacacacacacacacacacacacacacacacacacacacacacgggugcugacuccccuguauuuuccucccccaguacuguggaacauaaaucugagccuaucagcagaaggugugggccaggaagauagaucuauaagcccaccucauuccuauuccuauagggcuccaagccccgauagcaaguguguucuagacccagagauuccaaaucugcccccucugccgccaccccaaaguccccuuucaaggauaucgccuuacuuccuaccugcagcugccuccauaguuggaucacugaccc

SEQ ID NO: 5048 - RNA, 15624 nt, Mus musculus
cucgggguagauggugugagguggguggggcgcugggcaaaccagcggcgcuggcaggugaguggaggcuugcggcucccguaccuuggcggcuaaagcggcucucuccggagccugcggaaggccgggcuuccuggagccgcucgguguggcguccgugccggcccuuagccuccgcgcccucgggcuagggggucucugcggcuggacucccucggcaccacgcuugacgccggggaucccgggaagcucucccggaugggcuacuuccucugaguucuagcuaccuauccuccggccucagcgcccaggcgaggcugcccaccggccuuuucgugucccgaucucccugguccugcgccuuggauugguugcgggguucagccgucagauccuggucugugaguccuuguuuaggaccugggccuuucuucuggauuguggcucagaguucauuggugccuggcgauagaguauauacucuccugauaauuguugaugggaugguuuuguacuuugacuagugaugaaaugucagguaaggauccuggggggguuggaugcuucuccauccccuaauuaacacucagaaacaaggcuagauguagcaaacccuuagugagccucaguagugcauuaggcccauauggcuuaaguaauuuaagaucacaaaacuaaggaguuucguuuuauuuuccuucuccauccuucugacuuccucuucagacagauacacccuuagacauaaugugauguccgugguggcuuucuuuuuugugagaccaucuuaacuuuguggcucuggcuguccugaaauucucaagagauccugucucaaagacuggcaacgccacccuguuccccaccacuugauuaguggugugagcauaugugagugaauggugguggugggguuccuggggucauauucagguugucaggcuagugugacaagagcugcuuucccccacugagccaucucacuucugcagaauugucccuuuaaugucccuccuagaaauuuugcaucaaccuuucacuuuguucucguucuuuuaaacuacauacuuauuauauacuuuuguuuuguuuuguuuuuagagacaggguuugucuguguagcccuggcuguccuggaacucacuuuguagaccaggcuagccuuaaacucagaaauccgccugccucugccucccgagugcugggauuaaaggcgugcaccaccacgcccagcuuauuauauucuuaaaaauguuuaguaaaguauagacacuggaguguaaacagggcuccuucagucaaauggaaucuacauuuuaacguuaaaggaguagugggaucuaguauugugugggcaaagcaaagacaaauuaugguauugaaugccugacggaaaauuuaacguaauccaguaaggaguagaaugcuucagggucauguaggcuauaugaaauaagaauaugaacuuugggcucagcuucagcuuaucuauaaaugagguuuaaaugaugccugccucauaguguuacuaauaacaugaugcaaauaaaaugcuuaauaugaggcuagagguggcucaguaaaguacuugcuucacaaaccucgggaggcccuugguuugaucugcagagcccacauuaaaaaagcaaagaguccaauggcugggagugguggcacaggcauuuaauccuagcauuugaaaagcagagauggaugggucaaggccagcguggucuacauagcuugcuucaaggcagccagagagaccccaucuuguaaaaaggcccaugaauguuugugauccuguugggaaguagagacaggagucuccucggagcucacuggucagccuacucagugagcuccagggcaaggagagacucuaucaaaagcaaacaaagcccucagaugguugauucuugaggaaccaugggucccuuccaguugacuuccaaacacacacacacacacacacacacacacacacacacacacacacacacagaguguuuaccauggcugagugugguggcucaaacuuguaauuucagcuacuugggagucugaggcaggaggauugcagcacaguagacagaccucagaguaaguuuaaggcccaccugggucaauuagggaaacccugucccaaauacuauuuauaagguccuagauuccguccucaguaccaaaaauaaccaaaacaagaacaaaauaguauuuuugugagggcuuuuuaaaaaacuugaucauuuuuuuuucuuucccaugcaaugguguuuuucacgaacaaaagucugugugagaauauuggauccucuggaguuggaauuacagacaguuguaagcuacuauaugggagcugggaacugaacccacauucucuggaagagcagccagagcucuuaaccacugagucauaucuccagccccuugagauuuauuuuuacuuuaauguguauggguguuuuaccuguauggaggucacauaacaugccugcagugcucucagggcagaaaaauguguuucaucuccuggagcugguguuauagaugguuguagcagccauaugguuguuggcagucuaaccuagaucccuuagaagaguugucugggcuccuaaccagagccuucucuccaucuccauucaacaaaauagugcuauauauacaguaagugugauauuccaaacaaaaaguuuuguuauccccaauuuggccaagaccucacaugcgguaggcgguaggcagugggaucugggauuuaacuuuggugccuuucuuugaaacugagcauuguucugucucccaugggaauaugcucagaagcuauaugagaaaaugucuguuaacauccuuagcuuagugcuuggcccacgcucaguauuauucucucuuuccaggaagccagacagccuguagagcuugagaaacugcugguccaucccuacugaaaaacaaaacaaacccaaaaacucgagauaccgaaaaauaccugcuggcucucagugggcugcucgccugcgucugccuccagcagcccuggaauacagucuuacaacucuggauuucuuccucuuccucuaagguaaaggccaugucgccuccuggaaaaguuccccggaaggagaaccuggggcuccagugugaguggggguccugcuccuuugugugcucggccauggaggaguucuucgaccaugucacucagcaccugcagcagcacaugcauggcucuaaggaagaagaggaagaggacccacuugguaaggggcaggaaggagcuuaagggaggugugacuccgaccgaccgcuagagaaaggacaguugagggaacagucgugagucauccccguccccaacccccauuuuucuuuuucaagacaggguuucucuguguagccuugguuguccuggaacucauuuuguagaccaggcuggccucaaacucugaggugcacuugccucugucuccugagcucagggauuaaaggagugcauaccauaccuggcuuuuuuuuuuuuuuuuuaaguuuauuuuauuuauuuuuuacuucaugugcauuggcguuugccugcguuugugucuguaugagggugugggaucccccggagcugggguuacagagaguagugagcugccauaugagugcuaggaauggaaccuagguccucuggaagagcagccaucuuaaccucuaagccaucucucuagcccucugaggcuuauuuucuuaauuauacuuucuucguucauaaaaauauuaggaagucaucucuagagaagucagucagcaaggguguaaagaaugauuacgagcagaaggagcgugugacuuuuguguguauaugugucugcacaugcaugccauggauggaguguggacaucacaggaccccugaugggaguaggcuccgagucaucgggcuugauacaagcuccuuuaccugcuaaaucgucuugcuggaccucuucccuuaaacauucuuuauggaagugggaacacauauuuauauauguauguguguggugugugagcuugccauggaauauguuuggggucagaggacaacuguggagcccacccuuuucugccacuguguggguucugggguuuacuaggcuugggaauaaguaccuuucccugcugagcugucucucucccacccacccacccuuuuuuauuuuuuauuuuauuuuauuuuauugagacaggacuuacuuugaauccuuuaguggcuuagauuucauucuguagagcaugcuugccuugaauucacagagaucugagugaauuacagguguccgccggccugugccucccagguacugggacuaaagguucaugucaccaugcccagccucccuuuucccuuuuuauuaacuuacuuacauuuuuuguuuagauuuauuuauuuuguuuuauuuaucuuaucuucaugugugugcaccaugagugcccagugucuacagaggccaggaaaggauguuggagucccuugaacuggaugguuguaaaccaucaugugggaacccaacccaggucgucugcaagagcaacaaguagucuuaacugcugagcaaucuccugucccuuuuuacuucugagacagaucuuauuaauccagguuagccucauacccccugaaguucuccugcuguggccucacaaaugcuggaauuacuaccaugagccaccauacagaguuuggagcacauuuauaucauaacuacucaccauagcugagaagaaagcugaacaguuguauucaggacacucagaaaugcgccucuuucuguuuacucguuuucccguucuuugauagucuccugauugaccuuaaacuuauuauguagcuaagguugaacuucaagucugagucugcugaggaugcugggauuauaguuacacgccacaccuguuugcaaaaucaaauaauacacaaaaaugaaaugaaaggauuuuuuucccugaauuuucagucuuuuaaaauaagcaauccuggggggaggggcagaaaaaaagagcaaaacagaaagaagcaaucguguuaaaaguugacgcuguggugcuuagaggugcaggagagauaggaagugggaugaugggccugucuuuuacauugacucuuaacagagggacucuuaaacuucagucagcaucaaguuacuucuguuuaacaguuuauagcagggucuuacucuguaguucagguuggccucaaaaucauggccauuuagcugggcagugguggcgcacgccuuuaaucucagcacuugggaggcagaggcaggcggauuucuaaguuugagaccagccuggucuacagagugaguuccaggacagccagggcuacacagaaaaguccugucucauaaaaaccaaaaaaaaaaaaaaaaaaaaaaaaaaaaagggcaguuugccagccuaauacucuugagucuugguauuauagauaaaagccagcauagcuagcucuggguaauguuugccugguaccacauaccuuaccccagaucccuugccacuagcugcaguuauguagaugugcuuacuuaaccucugacugaagguccugugaagacagugguggcgcacgccuuuaaucccagcacuugggaggcagaggcagguggaucucuaaguucaagaccaaccuggucuauagagugaguuccaggacagccagggcuacacagagaaacccugucuugaaaaaaaacaaaacaaaccaaaacaaacaaaaguuacuagauaagauuacaugguggaugagcuccugguggguucaucccuggucagaguccugcuuaauguuugaaauggaaaguaaacugagcuuggaaaguaucagacuauuccuucuaacccuuucugcagaggaagaauucuccugcuuguggcaggaauguggcuuuugcucucuggacaguucugccgaccucauccgccaugucuacuuccacugcuaccacaccaagcuaaaacagugggggcugcaagccuuacaaagccaggcugaccucagccccugcauccuggacuuucagagccggaacgucaucccugacaccccugaccauuuccugugccugugggaacauugcgaggucagcagauagugccagacaugggguggaaggaagcugggaaccuugacucuuucuggggugccuuauauuucugagacucgugcuaguauaucucaucuauucuuguguaaguccuuugucuuaaaacuugguuguucccacaaguuaauuugggggagagcaagaggccccuuuggacaugggugagagucccuguaaccauucucaguccucaccccaaguugccccggcacagagugucuucgacaauccugagugguucuaucggcauguggaugcgcacagccugugcugugaauaccaagcugucagcaaggacaaccauguggugcaguguggcuggaaagguagggucacgccucugcucuggccucugcuuaaaaaaccccuggagguguaaaggucuagaggagccagggaugggacuaguuccugcaagacuagcagacuacuggcuggagaaacuuggggguaccaaagccaaguuggggaaggguauuuaaggauggaagaugaucagaucuuccuucccaggcuguaccuguaccuucaaggaccgguguaagcuucgagaacaccuccgcagccacacccaggagaaggugguggccugucccaccugugggggcauguuugccaacaacaccaaguucuuagaucacauccgucgccagaccucauuggaucguaagaaguuggagcagagagggggagugugggcuaucuauccuacuugaagugaggacaaggguauuuucccaggggagguggcucugcugagaucugugcccugcacucuuccuuccccuuugggaucaggcacuuccuagcuuucacuuagacaaugaucagcacuuacuguuuuagcaucaguuaucucaggaauccucacaacagccccaugagguaggcuucuuauuccccuuuuuacagaugaggaaacugaggcucagagagcuuaaaucacuuaccugagaucacacagcuaguaaguggugaagcugggguuuuaacucagguggacuccagaucccgucuguagcuucccuuggcuccucggguggcucccuuguauuugggguggcuccccucuccucugcccuucacuguuaucuucaguccccuuuguucuguccacuccaccccagagcagcgauuccaguguucccacuguuccaagagauuugccacagagaggcucuugcgugaccacaugcggaaccauggugaguggccuaugcccaagccuuccugccuucuuaagguuccgugaguccauaacucauggccuuuuggccucuucucugcuccucagugaaucacuauaaaugcccuuugugugacaugaccugcccacugccuucuucccuccggaaucacaugcgcuuucgacacagugaggaccgacccuauaaaugugacuguugugacuacagguaaggggacccugggguacaaaaauacaaggcucaaguuucaggguucccuaugucccccaaccccuccugauuucucuuugcagcuguaagaauuugauugaccuccggaagcaccuagacacccacagcaaggagucagccuacaggugugacuuugagaacugcaauuucagugcgaggucacucagcucugucaagucccaucaccgcaaagugcaugaagugagugaguggcuggcugguggggaagggccggcaggaguaugggugaggagcugaccucauguccucccuucucgucagggagacucagagccaagguacaaaugucaugucugugacaaaugcuucacacguggcaacaaccucacugugcaccuucgcaagaagcaccaguucaaguggcccucaggacacccucgcuuucgguaggagucuuuccccacagaucucuacuccuuguuuuguuuauuguuguguauauggggggugcagcuugauuaccugugugguuaagauacugaacuuagaucaucaggcauguguggcaagcauuuuagaccccuggccuugaauucacagagauccaccugccucucugccucugaugagaugaaaggcgugcacuaccaugcagggcugagacuucuaauguaaaguguagcuucagacucagcaagugaugcuagaguuccugagcuggagccagaguuaaaggccaagccaggguccugaccucagcucugcggccuucuccuaaacguuugaugcugucuuguuacagagcugaucagucucuguacuguguggggcuucagcauuacuuuuucaauuuugaguccuuucuucugaaccuuuuuuaaaaaaagauuuauuuauuuauuuuucuguauaugaguacacuguagcuauacagaugguucugagccaucaugugguugcugggaauugaacucaggaccucugcuugcuccagcccugcucgcuccggcccaaagauucauuuauuguuauacauuaguacacuguagcugucuucagacacaccagaagaggacagcagaucucauuacggaugguugugaaccaccaugugguugcugggauuugaacucaggaccucuggaagagcagucaauggggcuggugagauggcucaguggguaagagcacccgacugcucuuccgaagguccagaguucaaaucccagcaaccacaugguggcucacaaccauccguaacaagaucugacucccucuucuggagugugugaagacagcuacaguguauuuacauaaaauaauaaaauaaaucuuaaaaaaaaaaaaaaaagagcagucaagugcucuuaaccacugagccaucucuccagccugccucugaaccuugaugcuacagauuccauuaaaagccuuuucuuaaucuuuaguucuaucacauagaauccuaagauuucuuccagauggcauauuuguaucuucacccucugauucuaggcaauuuuuccauccucugcugauguacugccuucuccuccagguacaaggaacaugaagauggcuacaugcgacugcagcuaguucgguaugagaguguggagcugacacagcaguugcugcagcaguuacaagaaggaucagauccgggauuggcacugaaugagagcagccugcagggcauuguucuggaaacagugcuaggggggccaggaccugaggaagagacagaagaggaagguaggguuguugagggaacagcucucucagcuucucaggacaaccccagcucagccauucauauggucagucagacagacacccaaggccagcgagacauugucuacuguguacugucugaaggcccaggagagcccccgccagucuccgaaacccucaagagagauggaaaagcucgaggaaccugaggagccgggguccaggugggcugaggcugcagagucuggccgguccugcuccacaucuugaaguuugagcugggcaggaagcggugccccaggggucagccuuuguucuuggaugccuuuagaaguggugcugagaacaguguguuccccucugacucagaaggcaucauucuauagacucuggggaguuggauucauugaggaaauccuacauguauguucuuauuagaggagcuguuaccagguuuaaguguacucccuuggcaugcuagacaguaaguauuuagucuacauccauuccaauuuccagggauccaucgauccauugacccagggaugagggacuguucuuuccaagggcuguuuccucacuguuaguuacgcauugagaaccaggugccauuucucucaagguuuccuuuuacauuccagggacacuuguuaucuucagggacacgauuauagauacuguguauguguggcaguugucuuuuggggaauaaaagaaacacuugggcuguuacuuauuucuuaaguuugauggcaguuagccaaguaacagauacagcugcuuagaaguagagcugaauaauuagacuucucccuuuagugcucaggacgguuccuuuaacugugguguacccauuuagaggaggaguccacuuccuccagagcaucuuccacuucuguggaaggaagcuccauggacuucaccaugaaugagugcuagcaguguuacaagguuaauacaaauggcuccuggacaguacccuccguucuaauuagaacccugugccucugugguagguuggggugugggacugcaaaggaaacagaaauggagguaggucaggaagugacccuagagaaugccaaauacucaagggccaggaaucaagcuagaaaaucuauacaguuuccuacagaguggaucuauuuugauaagcuuaugucacauauaugaucauguguguguguguguguguuuugccuuuauguauguaaguauaucauagucaagcaguguccaugcagguaaaaagggugaccaauccucuggaacugaaguuaaagacaggugggugcuggaaacugaaugugguucucugcaagagcaacaagugcucucgccugcuuagccaucucuccagccucuuuuguuguauucuugaaguugaaauuccucaaaagaauuaacucuuuuuuuuucuuuauuuuuaaagauuuuauuuauuuuguuuaugaguauacugucacuguucucagacacaaagaggacaucagauucccauugcugugguugugagccaccaugugguugcugggaauugaacugaggaccucuggaagaacaguuagugcucuuaaccacugagccaucucuccagcccccaccccacccuuuuuuuuccccaauugaaaaacauuagacauaguggcacuuaccuuuaauccugacacuuaaggagacagaggcgggcauuggagguuaaggccagucuggucuacagagugaguucuagaauagccagggcuacauggagaaauccugucucaaaaaaacuuaaaaaaaaaaaguguaguauaugugugagugucugucccuggguacaugguaugugcacucucaccuguuuucucgacuaaccagugagcucuggggauuugccuuucucugccccugauaccaugcuggguagagcuuuuaccuaaguguugggugucugggcucagauccuuguguuuguagagcaagcacuuacugaccgagccauccccaugcauauugcccuuuuguuggcucucuuaguccguguaaagggaguauucuuggggaccuuagauccuuagauagcugcauagaaggauuucugaacuuuagcaucuucaggacgaagccuuccuaaacuguccaggaacugugucugcuucaccaccaccagcaccaccugugugaggcaggaucucccugagcucguuugacuugggucuucugucuugugcuuuguaaacaaggcccuggcuuuccuucccagcuuugcuaaaaagaaaacgaaaaggagcuagauggugguggugcacccuuuuaaucccagcacuuaaaagacauccauguagaucucuaugaguucaaggauagccuggucuauugagagaguuccaggauagccagggcuacacagaaauccugucuuggggugagaguaggggaugaugaggacuguuuuuuuuucuuuuaaauuuugcuuugagaggcaggcuucagaucuuuugguucucuucucuaacccgcuuccuggcugcugggauuacaaguauguaccaccauacucagcuccugauuucuuacugcaaaaacugccuauuacagaaguguagugguacacaccuaauaccagcauucaggagaguccagcagaucccuugaauuggaggcaagucuggucuauguuccaggacauucagggcuaugcagagagagccugucucagaaauagauggccuuuguaaagaaaaaacaaaaggcuauaucaauuucuauugagucuuugcuauagcuuaggcagauuacguguagaaguucgggaagacugcaggaagaggcuuccuccuaagcaguaacacaaagaaggcagcccuagaaggauugcaguguuugaaggguuuggugcgauggggauaccagggaacccaggaguugggaacuaguguggcugcuucucagaagagcacucaaauaugaaaugaaugaauaaacugcucaggacuggaauaaaugaagagcaugguccuuucauguaguguagcaggaagggguaaagaaaucguuucuagaccaugcugggaauugaacucagguccucuggaggcaaaacggaugagccaaaggguguuacaagacuucaaguucuacugagggaagguagauaaagaaagagacuuugguuaagaccagcccuauaguauuuaccuaacaaaggcauaaguucaguuuccaguugugacaguuaauuugccaacuugacguaaucuagagucaccugcaaagagagucucauugagggacugucuagaucucgcugacccauugugagcaugucugugugggauuaucuugauuguguugagguaagaagauccacccacuguggguggcacuauuuucugggcaggcagauccuuaguguagagacagcugaacacuggcaggcauguguguauuuguucucugcucuugacugugauaugugucaaguuccugacaccuugacuccccaguagucuguaacuuuggaauuacgagcauaauaacccuuugucccuuaaagugcuuuuagcaggauauuugucacagcaacagaaaaugaaacuaauacacaguaacauguguggacuggagaggugacacagugguuaagagcacuugcuguucuuccagaggauucagguucagguaugaguacccacagguagcucaaggccaucuauaacucccaguuccaggagaucugaugcccucugcuggccucugugagcaugaaacgugcaugugguacacagacauacaugcaggcaaaacacucauccacauaaguaauccuaaaagacaaaaaggcuuugguagagaacuuggcauucacuuccuaucaaaggaacuaucauguaacaggagagaaagacgcggcucuaggggccaugaauguagcucaaugguagaacacuuguuuaaaugcuugauuaaauuauuuuaugucagacuugagugugguggugccuuuaaucccaguagagcucugacuggucuacacaguaaauuccaggacagucagggcuacacagagauacccagucucaaacaacuaacauuauuuuauauucuauguuagucucuuucgcuauaacaaaaacaaagaaaccuaugagguauacaaggcaaaaagaauuuauuuuggcuuuuuuuuuuuuaaagagguuucaggccaugccuauaguuguuucugggccuacaaugagaaaucguggggggagaaugugggggacgggaacugcucagcugugguggcuagggaauaggaggacagggacaagauacucuuuaaaagcaagacucucgccagggcagugguggugcauaccuuuaaucccagcacucgggagguagaggcagguggauuucugaguucgaggccaaccuggucuacagagugaguuccaggacagccaaggguacacagagaaauccugucucaaaaaaacaaaagcaagaaagacucucugaagaucaucaugccagaguucagaacgguuaccacuuacuugccuguguuugggagccaagaaagagaggaugaacuuugcugcuguacuguagaagcgaggaagcucucuccuuuuugagcacccccuuuccaucccgagcagcaccucccaaauguccagcagagacucuucuucuugacagacuuacagguuuagaguugagccaguuggugggcaagagagaucacacuggacaaagacucggggugcugggaacaacuggaccaguucccaaaucuccagucuaaauccuuuuuggaucccacaggaccccaccacacuccuuucccccccauaaagcuuaucaacuacucacacaaauccuuguccagagcagccuguugcuuagauuaucgccuagcacuaagcugagaugagaauuaucaaccguugcaugucuggccauaggaaaucuuccguggaaauaaacugcuuggauggagguagugggaagggcuagguaggaaugggaggauucucucggggaacaaaaaagauaaaucuuagggaauaggcagauauguauuuggagaagcgggggagaucuggacauuaagaaaagucugucacaagaugacuuagaagaugaggucuauacuaagcaaagacccacucuagauacuaagucagaaaccuuaggaguggaacccagcacauaagucuuuagccuuucagaggauuuggggugaacacuaaagugugacaaccacuguugguaagguacaaggucuaucuaggauaaguguggcuucuccuuugccaagaagugggguaucguucuggagaaagaaaaugauccugaaucaugggcagcauuucccccuccccgugcuggcaccccuacccccagggcugcauggucucugagaaucacaaggcuacccuugaccucaagguccuccucauucagugccaggacuaugacaugugccuccaugcccgaccaguuaugcugugcguuugccaucuccauguuccugaugaggcgaagagaugaggaaccugcucaagagaagacuccgugggguugaggugguggggguggggagaggucagcaggcacagugugcaauaguaaaagcuuucgugugcggugcugaggguugaaccacugaguuguacccucagcccugggaaaaccauuucugauguguuauaacggugggcuaacugugggugccagugauuggauacuucaaaaaagcuaguagguuggauauauccaacagaaagaagugauaaauaugugagaagauaauauauacuauuacucaagugugaggguuucaauaagaauuaugccccccucauauauuugaaugcuuagucaccaggaaguggcacuguuuaagaaggauuaggagguguggccuuguugaaagaggaaugucacuggggauggucuuggagguuucaaaaagcucauaggagacccagagugaugugaugguggagaucucucucucucuugcucucucgcucucucgcucucucgcucucucucucugguuguggaucaggauguaucucucagcacuucuccagcaccacaccugccugcuuccuuccccccucccaacacccgugcccucugcugugaugauaauggacuaagccucugaaacuguaaggaagucccuaauuaaaugcuuucuuuuauaagaguugccuuggucauggugucuguucacagcaauggaagagugacuaagacaucugguaagaugaguacacaucggaauacugggcuguugagcugugcaagccugguagccugcauaucugaucugauccuugaaacucaaaacggagaaauaaaauuuaaau

SEQ ID NO: 5049 - RNA, 11095 nt, Mus musculus
cggugagggcgcggcuccuuuaagggcgggugggggcggggcgccggcgguguugucagugucaguucugcgcacgcagcccucccggagccggugccggcccgcgagccccgguaucucugcaggcuggucccugcccggguccggcggggccccacgccgugggaggaaucgggugauagcuggaaccuagcuggggucacaccgccgguguuagggauccagaucucuggcuacggagacagagcucgagcgucgcgaccccggaggaccucuucuccauccguggcacccacugguccuggaaucucggcggcgccggagagccccggagcccgcgcgcucagccccgggggagcucgcccacgccccacgguccauccgggccaugcucccccggggcagcggcugaacccgagccgggacccgagcccgcgggagcauggauccggacugggggcagcgggaugugggcugggcggcccugcugguucucuucgccgccucgcugaucacgguauugggcuggaugcugcaguaugcccgggguuuguggcugucgcgagccgaugggggccgagacucccgaccugccucagcugcugagcccggggguucacugcgcgagcuggguguguggcguucgcugcugcguuugcgggcgacccggaccagcacccccgaggaagccggcguacggggccuccuggcuucgcucuuugccuucaagucuuuccgggagaacuggcaacgggcuugggugcgagccuugaaugagcaggccugcagggacggggugaguugcacugagccccugugucgucccuucagcuuugccuucuagggaagagcuugcucauguuaggagggcuggauuagagcuggggaucaacuggagaacccuccagcuuucucuuucagaucagagaagagcgugcagguuagacuggggcuuguaaagaaguccaguuauauaccaaauuuucuauuuuugugagcaagguacucugguucuaaacccagcacaaguuacuguucucauagcaacgcuaauccgugugccuuagggcacuuccgccuagacuggccugguugggccaagggagacaggugcaccugcagaaggaauuugccugguccucaugccaccacacccaguuaagauuucaggcucccaaacccugguggucagguagagcccccacgguaacugaaucaucucuccauauuuuaguaauuucacuacuacaguccuccaggcuggccugcaguguaguguuaaaggaaaguaguuuaguuaaagggcauauugauaaccugcguccuuucuaaugcaugaacuugggcugccccuucagggucgcucauaaaccagagcagccagccaccuccacccguugcacccugggcaucuggccucccaggaagugggcaggaaucagagucaugagacugagguuggguggaaggcagaggucucccauuucuggaccauuucccuuccuggccaucagacuaucagcuccuuguggaaacaggucuuucucuguuuccagccauaagagcuuggaggcuuugcccuauuaauccagaugccuagagacugaaguggcccccaagaaguucuccuguuuccucuugucagcuggccagcugaaagccagaugacaucugucaguuuauacauugacccuaccccuccaaccuggcucuuccuguaccuugucccugggacagcugacucagcuggacauuggccucuccugcagggggaggagagaggggaacuaagcacucaucuccccaacuggcaugacuuuugaagaagaaagcugccaccgcagggaaguuugcuagggaaagugaaugagcucugugcauuuuguuuucucuaucucaagccugcaggacauacccagcccaggcugugcccccuuccucagguaguucuucuacccugcuuuccacugcuguagaagaauuagggaguggcucuuucgagagcuaagcuaaucggcuuuccgcucccuaauacuccugcuguccacccuaaggaauuaucuaggcuugggaccccugagcccucccucugagcuugcuucucuuccuagcacuucugaugggguuuccuggagacaugauaaguuagucuuuauuucuaagaacuuaagcagcgugauaggauaccauugaccauucacauccuguuuguuuggggaaaggcuuagccuuauuucuucaucuuauuuuauagcacaugacacaaccauuucacuucagccuugcccagcagugaccaugucacucucuuguugucauugucacuuaccucuauuugugauuacagugaaugaugagguggaggggugaagagggaaacagggaguacagagagguuccagggauuugaagaauuacccaagguucaaaggcaagcuggccucuaagguagccucuggaagcugcagaucccuggagacaguggggcugcaggggaaaccuucugcccuaagcuguugagccaagaaggggccagaggccagccuggagccgaggccucugcagugcuagaaucaagccagcaauugggcagaccagcccugcaggggacagcuccagagacuugaucuugugcccacauuacuuccucagagcuccauccaaaucgccuuugaagagauaccccaacucccaccaagagccagcaucagucaugugaccugcguugaccaaucagagcgcaccaugguaagggucuggugggcacuacaagauggggcagaccccaagguucccuuuaguaugaggggucuuaauuuggaguuucugugugucuuaaggaccuaaggauuuguuucaggaggucugagaaccucacugacgugauaggcaaaguaaguguguguguaugugggggucuguuucuagggagagaagaguuuuugucuuuguuuugagacaggauuuuacuguguaggucugccuguccuggaacucacucuguagaccaggaaaucugccugccucugccuccagaguacugggauuaaaggcgugcgccaccaccaccuggcugagauuuuugcuuuugucuaauucauugagaagcuuagggcccccaaaaggacaucaucccaaggaugauagaaguggggaagggcagagccagguggguguccuccgcagugccugacacuguucccuguuucaggugcugcauugccagcucucugcugaggaggugcgcuuccccaucucugugacccagcagucccccgcugccgucuccauggagaccuaccacgucacucugacacugccaccaacacagguggagggaaaugggggaaacugaguugggcagagggcaguugaguuggcccagcauuuucucccugcuuccucucuaccguuggauucgggaaggaaggguccgaguaguuagcaggguggggggaugggguccugaagaaugggguagaucacaguaauccuuccguucuugucucuaguuggaagucagccuggaggaaaucccugaugaggggcuccugguguccugggccuucacugaccgcccagaacucagccuaaaggugcuucccaaguugcagacuagggagguaagaagggggcagcagaggagagacugaacuggcgcaauggagcagggcggaggcuccaccucuucuccucucugcagagagaugaggaacaaccagagcucucaacaguugaggaacugaucaaggacgcuauagucagcacucagcccgccaugauggucaaccucagggccugcucugccccaggaggccuggugaguggacacccaaagggaagguuugcguguaucccaccuccagguuacuauaucgggauuauuucucuuuuuacucccuuuugcucuuagguacccagugagaagccacccacgaugucccaggcccagccauccauccccagaccuacccgauuauucuuacggcagcuucgagcaucucaccugggaagugagcuaggaggugagaauuccgcugcccaggacauagcuucucuauuccgcggacuugguuucuuccgucugagcauccucuaagcucugcuuccugacagguacugaggaacugugcugugccgcugagcuugacaaccccaugcaacaaaaguggaccaaacccaugagggcgggccccgagguggaauggaccgaggaccuagcucuguaagucacacucugcuccuccccucuguccccaugggcagucaggaugaagaaacuuuuccaggcuagcccuggcaugaggaagccagccuuguuuucaguagccuguaguguggaccuccacuguaugccaggcccuggggacacagacuaggaguagauacagcccuaccucuggguggaucacagacccgaagcagagacacauagggaagaaaggacaaaguugccaguugagauuggugcacagcaugccguggaggcgcuucaguaggggagaugacgaauucucaaaacggacuaaagaacugaugaaaugucauggaagaagucuauuuaaaccacgccuucaagcaaggguagcaccgcaacagaaugugaaagucuucuugacagugggaacugccugagaaaaaacaaaaccaaaaacuaaaacaggacggaaggcagcuccagcccgagauagacgucagguggaagcggguuggggaugugcacaccuggcugcagaaaguaauuuccacucauggcugcguccauaguucccggaagguggacauuuuggagcucuggcgcuaucuuacuaacccacaucucugucucuagccuuugacuggcucaggggcuccguucacuaugcuccuuaccugaccuauccauccucuuucggccuucagggaucuggguccccagagccgggagcugacccucaaagugcuccggagcagcagcuguggagauggugagcgggggacagaagggacacuuuggagugggugcugagcaggucaugcuucuggacccggcucaccgcgucacucuugucucuagcugaacuccuuggccaagccacacugccugugggcucacccucuagaccgaugucacgaagacaggugugcccacugacuccagggcccgggaaaucccugagcccggcagccaccgugacagcggaggugagaagguggccacuguggggaaagggauaggccuagaugggacagucucugagauccugaccccucguucucuccucacacucuggcagcuacauuaugagcaggguuccccucggaaucugggcacgcccaccuccuccaccccucgccccagcaucacacccaccaagaagauugaguuggaccggaccaucaugcccgacggcacagucgucaccacugucacuaccguccagucccgcccccguguagauggcaaacuagguaaaaaggagagucucacaguagcacccauugccuuaagagggaaggaaagccuagaugccuagaugcccgcacaucuucuuccuaauguccuguuuugauccgucugcaucuucuucauccuuguugcuccuuuccagccguccucucacccuucggcccuuuggaaucuucucuccuccccucuugcucuacauuguuuucucucuuuccauggaucucuuuccuucuuugacccuagccccaauuggcuaauugucccacaucgcaguggucccuggccucuucuggcaaacccagugucuuuuguggcauuuuucuacucccaguggccuuacaucacugguccaucucuagggaucccagggccauuuaucuaucuccagggucccccuaaacauucuccauccaugcuugguaucucccuauacccucaagugggccccauggcacuuucccgcacugucaucgguuccugucgaaucuucucauucagccucuucuuaaucacccugugauuaaucccccuuaaucaucuuugcccucugagucaaccaaaggcugcaucuccauaaagauagggguggggccucccagcucacugacccucccccaccccgcagacucccccucccgcuccccguccaagguggaggugacugagaagaugacaaccgugcugagugagagcagcggccccagcaaugccucccacagcagcagccgugaguagggaagggaaaugagcaagccucgguggcuguagucccuguagucaagaacuacucuggguggugcaagagggguuugagcccgagaaggagccagguggaaaguggagccaccgaucuucuauaucccccagcaggggagagccaccuuuccaauggcuuggauccaguagcagagacagccauucgccagcugacugagcccagugggcgggcagccaagaagacacccaccaagaggagcacgcucaucaucucugguguuuccaagguaacagagcucuggggagagagcuaaaauggggagcaagcccucauaggucauucuugcccauuaaaaccugucccuucuggcaggugcccaucgcccaggacgaguuggcucucuccuuggguuacgcggcaucucuggaagccucgaugcaagaugaugcaggaaccaguggugguccuucgucaccucccucagaccccucagccacauccccaggaccuguugaugcccucuccagucccacaaguguccaggaggcagaugagacaacacguucagacaucucugagaggccgucuguggaugauguugagucagaaacaggguccacuggugcccuggagaccagaagccucaaggaucacaaagguggggagcaauggacaagucacccccaugacugcuuugugagggggcagggcugagacagaaucuggccuggaaugcauuguauagcccaggcuagcuucacauuuccaguaauucuuuugccuugguuucccaagugcuaaauucuaggaaugggccuccacacgcagcuguugauugcuuuuuugaacuguauuguaaccucagaccuacuagacaacuuggagaugugguaggcuuagcuaacuugcuuucaaaagucaagcaaacgccaguagauggggaaaucuggugccucgguuccuagcuuggaugugacaggcuggagugacagcaagaggauucaccauauuucccuuccuuccugaggguuuguuuucguucacuguuuuugguguuugaagacaauaucuuauguaguccaggcuggcucaaacuugcuuuacauccagaguuggcuauaaaugucugauugucaagccugugccucccaguugugaggauuagagauacguaacaacaugcuccgccguuuaaaacauuuauuacauuuauuugugugugugugugugugugugugugugcgcgcgcacacauguguaacagaagacaauuuguaggaguugguuuuuccuuccaccaugugggucccagggacugaacugaaguugucauguuuggggcagcaaacacguuuaccuguugagacaucuuucuaaauugugcaugaguguuugccuacaugggcaucacaugggugccuguugcccaaggaaguggaaagagauugauggagcccuuuuuaacuagaauuauagacaucuacaaaccaccguguggaugcugggaaucaaacccugauccuguggacgagcagcaagugcuccuaaccacugagcuaccugcccagccuccugcugagauaaugcuaacucuuggcuuagguuuugguuuaguuuggggacaggguuucacacuauauccaaaguuggcuuagaacucacuggccgccucuucuucuucuucuucuucuucuucuucuucuucuucuucuucuucuucuucuucuucuucuccuccuccuccuccuccuccuccuccuccuccuccuccuccuuuuuuuucuuuuuuccucuucuacucugugcccccaguugcauggauaaugagaaauucuacuccaugccaaucuuaacauuguuccccugagcugggcaugguggugcacaccuuucaucccagcacucaagaaggcagagacagguagaucugugaguucaaagccagccuggugaaagccaguuucaaaaaagaaaagaaaagauuauucuuuugagcugggcagcaauaccugaauccccagcacuuaggaggcugaggcaggguuuugaguugaaggccaguuuacaggucacauuuugagacucucacggaaggagggacaggaggaagcaugucauucccucucuggcugugacucagguugcaaacagcuuuccuaacuucaaaggacaaagaguuugcugucuuacaucucacccguugaccaaugacccugucggcugggaucuauuuaugauuuaaaagcuggugcugcaaucucaagacuugagagacuguggcaagagguaggcugugaguuuaagaucagcuuggguuauguaaugaguucaaagccagcccaggcuacgaauccagauucugccucaaacaaaacuaacagaaaagaaucuugaccuguggcucgcaucgcuugagagaauggagucugugaguccgaagccugcugcgugagaaccuucuucucucugugccccauagucacgucuuugagguuucuagacuccccacugcucacacccuggaauguaguguguuaauccaccuuuccuuuuaugauuuauaggcuuuaaggaacacccucugugcagucuuugucuuuucagugaaaggaggcucaguccgcugagaguccucccagagcggcagucccuacccuuguuauuccuccaggggauguggucagaggcgcacagaucccucccccuaggacuguguuccuuccucaggaugggugaagcucgcgugcgcuuccaccgccuuuccugagaaaggcaggcauuagggaagagacagaguacagucgucaucuucuguauuaacuuccuaagucuuuucuccacccucaucccagaccugugccccuccguccaccucaguuucccuucuucccuacagugaguuuccugcgcaguggcacaaagcucaucuuccgccggaggccccgacagaaggaagcuggucugagccagucacacgaugaccuguccaacacgacggccacaccuagcguccggaagaaggcuggcagcuuuucccgucgccuuaucaagcguuuuuccuucaaauccaaacccaaggccaauggcaacccuagcccccagcucugaaagcccccgagcuaggagagaucaagaguucucuuagucugucccccacauccccuucuguaccccuuccuggauccccacugcuggggccaggaaagcccucggguuauagggagccccagcacacugggcuguggggugagcgggaagggugucugacaugggaggcaucugggaggcaacaguuguugcgugagcguagaggagaguuuggcagcugagagucaggggcaagcucugucuugggcguguggacacucaucagaagccucugcugguacugccgccagaggggagcccagaguacucucucaucagcagguccuucucccuuauuuauucucguuucuauuuauauguguggucuagaacccuuggcaaacagaugauagagggcaucucucccaggugacccuuuucugucccaggaggguaaggcaauucccaggacggguuucuaccccucccuugggaguccucucuuagaccagcaccaaugucugccuucagaagacauuggcagaucacaggaagccgggcuagggcccgggauggggggcaggcacuccccaccucccuaccucccacaucgcuccuugucucuccuuccccuuuauuaccauuuuguacuugaugccuucuccaugagcaguggcucaguuggaaggagggagccaggaagcugggaggaagccuucccuagagagccagcuuuaggaguuuuaaagacaguacgaucauagagcaagguugcaccucuguauguugggagaugaugauguccauugcugugugauggccuggaauuuaauuuauuuaauuaaaaucaaauuggaguuuauaaacgggaguggcugguuauccuuugaaaagcaaacaggccuaaaggcugugguguugauagagugggcaggcgggcucacugacuaugaccuaggcagucagguggcacaggugcccuugaacacagauacaaguagagagguuugagugaugauacucugaaaagucaaguugcugcaaagaagccaccccucccccacaggcuguucuuucugggcuguaacacgauuuagaguguggacucugaggcugcacuguucugaccugagacccagcuccacugaccuuugugaccuuuguuaccuuugugaccguggacaaauauggggccucaguuguuuugguuuguuuuugauccagagccucaccuauguuguccuagcuggcuuagaacuccuuaaguagaccagguuggccuugaacucagagauagccugguuucuuccuccugagugcuaggacaccacaccugguuguguacucaguuuuuuucuucugucaaaugggggcuagggacuggggauguagcucaaagguagaguucugccuuagcauacccaaagcccugggguuugucucuagcaauauuucauagagaggaugaagccaggugugguggcuaacacaaaccuuuaauuucaguaccugggaacucugugaguuucaggcuagucaggacuauauagugagacccuguccaaaacaaacaaacaaacaaaagcacuauuccuaacauaggugaguuuuagauaccuacagauaugucucuguuuccuguccuuugggauauuacacaggauugaaccagguaagcugcuauaggagguuaggcaaaaugcaggaccaauaggcaggaaacuaagugugccaccaauaucucuaucuggcccaagcugcuacucuuucuggacuccaguuucuucaccucuaaaauaaaugaaaguggccugggauaaucaggucauuucugaacucca

SEQ ID NO: 5050 - RNA, 1502 nt, Mus musculus
ucaccgaaggguuaauugcaaccaaccagagguggguauuaaaaaaggaaccaaucaggaggaagcgggggcguguccagggaguuuauaaggccgggcuuggccggccaggcgaccguugacugcggcgguugguaguucguggucucucagcguuguucgcagcucuucuaccucguacacuauguccggacgcggcaagaccggcggcaaggcccgcgccaaggccaagucgcgcucuucacgcgccggccuucaguucccuguaggccgcguacaccggcugcugcggaaaggccacuacgccgagcgcgugggcgcaggcgcgccgguguaccuggcagcggugcucgaguaccucacugccgagauccuggagcuggcgggcaacgcggcccgcgacaacaagaagacgcgcaucaucccgcgccaccugcagcuggccauccgcaacgacgaggagcucaacaagcugcugggcggcgugaccaucgcgcagggcggcguccugcccaacauccaggccgugcugcugcccaagaagagcagcgccaccguggggcccaaggcgccggcggucggcaagaaggccucgcaggccucucaggaguacugagggggcccgcgccgaggccgcccagcccuccccacaccuccacaaaggcccuuuuaagggccaccaccucccucacagaaagagcugagccacuucgggcugcggcggcuugccgcguccccauccuuucucuuucccuccucuccccuccccgcccucgcgccacucuuccccuuaccccgcacggccuccgguucugccacggaggacgcgggcgccgcggcaccugcccaucccggagcucgugacaucgcuucgccguucucgguuguggacgacggcuccgugcggagaggcugcggcgccuucccggagucucggccccucgcucagacguccggccgcggugggcuugaagguuagucccuccgcagcuacagccccggcgucuuugcuucagcuuggugcuuagcccucgccuggaccuuugaaaagugacuugauugccgggcuuagaggaggagaaauggaucacauuguuuccuucggugucaccguugcuggccucauaccaguugacccugucgccauucguaggccagugugguguggcggggccaaaaaugguuguaaugugaacccaguuucucuaggaauaccucccggcaagggucagagagacgcuuaccggccuguggacaagaguucuauaccugccgcaggcgacuggcagccgggccuagccauccauccccucuuccccagcgacucaacuacaacccaaacaccuagauaccagcacaagccggugaaucccugucuggacugagccucuggcuucugaacuggaacuuuugcagcuauuacaaguuuagaaccuuaaguggggagauuuaaugggcuaauuuuauuaaaggaucguuugguuuuguuuuuuuaaaaaagu

SEQ ID NO: 5051 - RNA, 1999 nt, Mus musculus
uuuuuuuuuuugagaacaugaggcaaaucacagcguguuuuacaacagaaaggucucagacucaauucaaguuuaaaagggcuuuggguuuauucauaucuuccccaacucuaucagaagaaccacauucuaaacugguuuauuagugguauugguuacauucaaagauuggcauggacuuucucuaaagagaugaagcccccaacuacugagggaaaggcagauauggaggccccaaggugaggcauaucuuccaaaguggaagucucaacaaccccgugguucaauuuccugggauaaucacaucccuagggauggagcacagggcacuuggaagccagaaguaggcaguggaguggcagccaggguuccugugcccuacagaccaguuagcgcacaucauuaagcugccgugcaacauccaggauguucuuggcuccuuuguugagcagcaagcuggccaggcugaugcccagguucucagcagcuagcugggcuccucuuggaauguuacgggcagugauuccaaccaguugugggucaucuucuggaccaucuucuugcuggaugacagguuacaauuuugguaagaggaagauuacaagcaguucuauuuauuccuuccucaucucccagucaauaccugaacagggaccuggaugguggccugcauagucucuugcaugcuaucugagccaucuagacuccagacuccaccagucagguacagcuaggaaauaaaauguuuguaccaggauauuuaaagaaaguuacuuagauguuucggugcacauggaaaugacagucccuccccucauccauuucccuggcuuacuugcccaucuuucaucacuguaugcacugcuacgggcacgcugcagccuccuuccugcaaugauauguuccuuugagcucuaagggccuuuaacaccacuuuugaccacagaccucaaggggccagaucaagguccucuccauacauacaaaacauuacauacugaguacuugacaaaucucucucccuacugcccuuccugguuuccccacaacaccaugggaggagcccaucuuaccaggugccucagaaaagcccuuucagcaaugcagcgaagcagaguuucaggaucgugcaacacacucacuagguccaagauauccugguccuuggcucggacuuccacggcuagggcucccuaaagaacaacaggccugaucuucucuaguaauagagcuaagcaugagaaacacaccucuaccugcuucccugggucuuaugcauaacaaccaaaccugucccucucuaaacaucuuauuugauggauagcaggugccaaagguuaugaaccagguucucuccaggcaaaccuaccugacccacagcauacaugcauucuucugggugcaaaaucuguggagagagacaagauggugggauaggggauguucaaaggcagugagcuaggguuugccaaucuaggaagccuggggaaggcacagguaggaaguccagcaaugagucccaauaucccuagccugggcuucugguuguaguguuguuggcagaauggucaggaagaaaucaaggcaggagagaggcagauucaaugggaagcagaacagggcagcuccuaccuggcccacccgguucugccagcccaugcgcuguaggccagccacagccaggacgauggcacugaauuccugcagcucauccagcuuccggaggcggguguugagguuuccccgcuguggagcguugcuaaggagaagucaagaccuacccagugcacccucugccccacagucucuuuuccccccucuagcuaacuuuuaaaaaacuuuuguuuuuguugaguggugguguauacaccuuuaaaucccagcacuggaggcagauacagaucuccaugaauucaaggcuaaaucuggucuacagagagaguuccaggacaggcugggcuauacagaaaaagccugucuagaaaaaugguagaaauga

SEQ ID NO: 5052 - RNA, 1999 nt, Mus musculus
ucauuucuaccauuuuucuagacaggcuuuuucuguauagcccagccuguccuggaacucucucuguagaccagauuuagccuugaauucauggagaucuguaucugccuccagugcugggauuuaaagguguauacaccaccacucaacaaaaacaaaaguuuuuuaaaaguuagcuagaggggggaaaagagacuguggggcagagggugcacuggguaggucuugacuucuccuuagcaacgcuccacagcggggaaaccucaacacccgccuccggaagcuggaugagcugcaggaauucagugccaucguccuggcuguggcuggccuacagcgcaugggcuggcagaaccgggugggccagguaggagcugcccuguucugcuucccauugaaucugccucucuccugccuugauuucuuccugaccauucugccaacaacacuacaaccagaagcccaggcuagggauauugggacucauugcuggacuuccuaccugugccuuccccaggcuuccuagauuggcaaacccuagcucacugccuuugaacauccccuaucccaccaucuugucucucuccacagauuuugcacccagaagaaugcauguaugcugugggucagguagguuugccuggagagaaccugguucauaaccuuuggcaccugcuauccaucaaauaagauguuuagagagggacagguuugguuguuaugcauaagacccagggaagcagguagagguguguuucucaugcuuagcucuauuacuagagaagaucaggccuguuguucuuuagggagcccuagccguggaaguccgagccaaggaccaggauaucuuggaccuagugaguguguugcacgauccugaaacucugcuucgcugcauugcugaaagggcuuuucugaggcaccugguaagaugggcuccucccaugguguuguggggaaaccaggaagggcaguagggagagagauuugucaaguacucaguauguaauguuuuguauguauggagaggaccuugaucuggccccuugaggucuguggucaaaagugguguuaaaggcccuuagagcucaaaggaacauaucauugcaggaaggaggcugcagcgugcccguagcagugcauacagugaugaaagaugggcaaguaagccagggaaauggaugaggggagggacugucauuuccaugugcaccgaaacaucuaaguaacuuucuuuaaauauccugguacaaacauuuuauuuccuagcuguaccugacugguggagucuggagucuagauggcucagauagcaugcaagagacuaugcaggccaccauccaggucccuguucagguauugacugggagaugaggaaggaauaaauagaacugcuuguaaucuuccucuuaccaaaauuguaaccugucauccagcaagaagaugguccagaagaugacccacaacugguuggaaucacugcccguaacauuccaagaggagcccagcuagcugcugagaaccugggcaucagccuggccagcuugcugcucaacaaaggagccaagaacauccuggauguugcacggcagcuuaaugaugugcgcuaacuggucuguagggcacaggaacccuggcugccacuccacugccuacuucuggcuuccaagugcccugugcuccaucccuagggaugugauuaucccaggaaauugaaccacgggguuguugagacuuccacuuuggaagauaugccucaccuuggggccuccauaucugccuuucccucaguaguugggggcuucaucucuuuagagaaaguccaugccaaucuuugaauguaaccaauaccacuaauaaaccaguuuagaaugugguucuucugauagaguuggggaagauaugaauaaacccaaagcccuuuuaaacuugaauugagucugagaccuuucuguuguaaaacacgcugugauuugccucauguucucaaaaaaaaaaa

SEQ ID NO: 5053 - RNA, 4106 nt, Mus musculus
agagggacgggguuuucguuuuucucucucucuugcuucgcucucuugcuucucucucuugcuucucucucuugcuucgcucucucuugcuucgcucucuugcuuuucucucucucuugcuuuuucgcucucuugcuucucgcucucucuugcuucuugcucucuugcuucuugcacucuguuccugaagauguaagaauaaagcuuugccgcagaagauucuggucugugguguucuuccuggccggucgugagaacgcgucuaauaaauaauagguauugguaugcuguguuucagcauuugguucugaagugugagcucacuaacuuccuuccccaacccccagcaacagcgaugaaccuagggccacuuccauacaaggaaagagcuccaccacagauacaucuuuagccuuuuaaaacuacuuucaggggguuggagaguuggcucagugguuaagagcacuggcugcucuuccagaggacccugguucaagucccagcacccacauggcagcucacaacugucuauaccuucaguucuaaugacucuggcacccucacuuagacauacaugcagggaaaacaccaaugcacacaaaaauaaaaacaaacuauuuaauaauauuuuuugguuuauuuuuuuguguauaugaauguuuuucuugcauauauguuuguguaccacagguguuccuggagaccuuggaugucagaagaggcuucuuugcaagaggaccugggucccugggucugugucccugcguuccacauacuggcucacaacugucuguaacugcaguuccaggagcuccagcgcccucuucuggccuuuguggcacugcauuaacacagugcaucuauguccaggccgaacaucauacacauaaaagaauaaaauagaaaauguuuaaguuauauugauucuugaauucuuucaagacugaaauucucaguagacaaaacuguuacugaaucugugcacauaguucuuuccugguuauguuccuugccugacugacuuuacuagagucagacagguagaacuaauagacaauccugguuuguguucugacaaguguaccuuuggccucgugccccagaaaaauauauaauuaaagaucaggcaaaugaagagcucuuguuuuauuuuuaaauaacuuugauguuuucuggccagaggaucaccuuuccccuaggauaauuauaccucuuuuugcaccugggugcuacaaggacuugaugagaagcaaaaccacuguuagguaucauuuccuacaugaaauuggggguugauuccugccucuuuuuuguuuugagacagucucuuagacuagccuugaacucauggcaacuuuccccacccuagccuuucaaauuacaggcacgaggcaccgucccuggcuacugucugcugugaggcaccgucccuggcuauugccugcuguuaaugccuguucucuagggcgguggucaaggaccacaguuugcuccuuacccuuuugggcauuuaguacaguuccaguaguggguaguacagaaaauguauuuguggagaagugaaaagcaaacuaguagguggagagaggagcuguggguggcucugguaggccaguuugugccuuagugucacgcaucaauaagacccuauagguacagguagggccggaugcagacaucagaggaagaaagacugccauguggcaguggcaggaggaggagcacgagguggcaugcuugcauaugcuauucucucuuauuuuguuugaagacaagaucucauuauguaucccugacuugccuggcaucacaguacuuguugagagcauguuuggagguucuagcaggggaggucagcuacuuguauguuugaacugagaaaugguccuccucuguccuggaaggacagggucuucgacagaacaugcuacaggaaggccacagucacacacagaguggugagagaagggacaucugccuagauaacaaaauucacuaaaucagucucagugaacaagaugucaccuugauaucauugucacuuucuucacaaugcuucuuuugacacaaacuucaugguucccccugacacacaaacaggacacaggacacagagcuguuucuacacagagccgguuggacagcuauggaagaccuugacuuauuaaaaucacucuacucucaaagcugccacucccuggucuuugcuugccucuuccucuauaggaaggauaagaagguuaacagggucuuaggaguugcauuuugcaccucagcaaacauggauuggguguaugagaaguuauacacucugaagcagaacagaauauaauacacaagguugauucaaacugugucgggggcaggaccaaacuuuuuuuaaauuuuuuccagcaguugaaaaaccgguuucauauacuugcuuucuuccauuuaugaccuaaaauaucucugacagguuuaaaaacaaacaaacaaacuuaagcacagcaagcuagaauucacaaaaugugugaaauccucaucagugacugagcauuuuauugauuugucugucccccauugucaccacaaacaaacaaaaaccucaagacuuucuugguuagaguaaacuuucugacugguauacagugguggauuuucuauagagaucugcacagaaaguacauacuguccaucuagcugcuucuuuuuuguuuuuguuuuuguuuuuguuuuuuucgagacaguguuucucuguguagcccuggcuguccuggaacucacucugucuguagaccaggcuggucucgaacucagaaaucugccugucucugccucccaagugcugggauuaaaggcgugcgccaccaccacccggcucuaguugcuucuugauagcauaauuuuacuuauaaaguuuuguuuaguauuauaucuaaguacacuguagcugucuucagacacaccagaagagggcaucagaucccauuacagaugguugugagccaccaugugguugcuaggauuugaacucgggacuuucagaagagcagucagugcucuuaaccgcugagcuaucucuucagcccuauaaaguuuuuuuuguuuuguuuuguuuuuuuaauuuauuuauuauauguaaguacacuguagcugucuucagacacaccagaagagggcgucagaucuuauuacagaugguugugagccaccaugugguugcugggaauugaacucgggaccuuuggaagagcagucagugcucuuaaccucugagccaucucuccagcccuuguuuuguuuuuuuaagauauauuuauuuacccaauguauaugaguacacuauagcugucuucucacacaccagaagagggcgucagaucucauuacagaugguugugagccaccaugugguugcugggaauugaacucaggaccucuggaagagcagucggugcucuuaaccacugagccaucucuccagcccccuauaaaguuuuauacaucuaaaaagcuuuggauuugaucgggcagucuauuaacuacuuuuaaaaagguggcacuuaauuacagcuuuauuuugcaaaauuaaaaagcugaugaauuagauagcuucccaaaacauuauucucugcaucgaacagaguauugaguuuugagacaccgccucucuguggagggcaugcggaccucgaaucgcgccaccacucucuugaaggacguugucaguccuaacaagaucaaaagagcauuaaggagcuacggagcacgccccaccucucagucccgagcagcaagccuuuugugcgcaugcuccccacugucacaugacucgccuuucgguucacgugauuucgcuuccggaggcgggggccuucggcaagauggcggccuaccugcaguggcggcguuucguuuucuucgagaaggagcuggugaaggagccgcuggguaaugauggggcugcucccggugccgcgccugugucgggauccgcugcuuccaaguuccuuugccucccuccuggcaucacugucugcgacucaggccgcgggagccuggucuuuggagauauccuucuuucggagguguuucuuuccucagcgcacgccggacgaguuucu

SEQ ID NO: 5054 - RNA, 12882 nt, Mus musculus
gggucucgugggcggugcuaagugcgcggcgcagggccgagcggcaggggcgccaaugagcgugcgccgcguccggggccggcuggugcgcgagacgccgcugagagguugguggccacuguaacaguuugcaaacgaaggggaguugugaagggcccgggguuggggucgugcugcuggccguguggguacguccucgccgccuugaucccggagcgaaggacacaggagcugaaggccagagggagcgggggugaggauggagcagccgucgggccgcggcuccuaggggaggcagcgugcuagcuucgggggcgggccgguagccggagcgagggccgcacggacaccggucccuucgguccugaaguucaggcgcugagcugcccccucgcgcucagggugggccugaauccauuucugggagugggaucuuccaccuucgucaggugagguuuaggugaacauccacccggcuuguaaccuuagccugcacaacgucugcguaggcagcguggcccaggagugggaugggcaaggagggugggcuggacaaugcucagggaauucagagaaggggacaaacccuucugugccagccauccccaacgucaucaccuuccaguuccugcccaagcucaaccuggcuuucccggccacccgggaaccccaggugugagguauuugagccgauuucgaggguccuggccaagcuccaggugucugacagguacagugcuguggugugccgauugcuuaccuguacguagaccgaaaaaaggucaacucuuauuugucuaaguaagugguggagggcccuuuugcuucggcccgaaugugagacacuugggaggauguuuaaaaugauugaaacuccucaggaaggaagagaagaggucgagcugcugugcuuuuuugccaaagugcaacagauaagaaucuuugagcuugucuguucugggaugugguucuguuuccuucuucauucagcauccaguuacaaguguuuuuccuuucccauuagggucacaauggcagccacaguaagaaggcagaggccaaggaggcuacucuguugggccuugguggcuguccucuuggcagaccuguuggcacugagcgguauguaccuggcuaagguguuaaagaagaauggaaggauaagagggcacaaggugccuacucgaguuugggguugcuggaucuagccuuuuucuuugucuuugccauggaaagcaggcugcuuccauugauuugccuuaggaaggcaggagggugugggaagcagagaacugacagagaaaccuacauucugucuucccuucagacacauuggcugugaugucuguagaccugggcagugaauccaugaagguggccauugucaagccuggagugcccauggagauuguauugaacaaguaagaguagaucugggucagggguguguuuauaauuuauagugcccacuucagacugugauggcugagcccccguaugagaucugguggcgucuggcuucauagucugcugcaggcagcugggcuaaugcugcuuuuucuuagggaaucucggaggaaaacuccagugacugugaccuugaaagaaaaugaaagguuuuuaggugauagugcagccggcauggugaguaacagcccuagccagauucguucccucagaggcuagccuuuuaucuagcuggaugaaguagaggcaagguaagguagguuugggccuaagaauuggcugggucuccuccuuucaggccaucaagaacccaaaggcuacgcuccguuauuuccagcaccuccuuggaaaacaggcggauaacccucauguggcccuuuaccggucccguuucccagaacaugagcuaauuguugacccacagaggcagacugugcgcuuccagaucaguccgugaguguccagagugggaaggaagccccuuguuggcgcauguguccgugguuauugggcuugguguuugccuuccuggaccucaccuccuccuccuccccucaggcagcugcaguucucucccgaggagguacugggcaugguucugaacuacucccguuccuuggcugaagauuuugcuggugagcaucaagguggugcugguggcagugggacuucccaaauguacagugaauagcaagcagagccucuuugauuucuuauugaaaauuggaccauaccggaagacauguuugguugucacaagcucgggacgggcuccuggcaucuaguauguagaggauagggaggcccgguaagagucagugguacuguguuggacauccuggucugauguuugggguugcugagauccugcucuuuguccuuguagaacaacccauuaaggaugcagugaucaccgugccagccuuuuucaaccaggcugagcgccgagcugugcugcaggcugcucggauggcuggccucaaggugcugcagcucaucaaugacaacacugccacagcccucagcuacggugucuuccgccggaaagauaucaauuccacugcacaggugagccacugaauacauacaacaccgaguaugaggguggaggauccuugacccauuuuugcaucuuuuuugcauggccaucccuugacaaauugugacaaauagcugccuuucaguacccauuggaggugguuaguuuuuugaagagugacagcuuuuuauuuucaggcagacaaguagacaggcauccugcauuugauaaacuaucucuuuguuuuauuauuuuuguguggggugggugagagggguaagacagguuucucugugugaccucgcuguccuauaacucacuguguaagccaggcuggccuggaacucagagauccaccugccccugccucccgagcacggaaugacagaugugcaccaccacgccuagcuuggcuuccacauuagguuccucugacaguauccuuggugucuccacagaacgucauguucuaugacaugggcucgggcagcacugugugcaccaucgucaccuaccagacagugaagacuaaggaggcugggaugcaaccacagcugcagauccggggcgugggguagguuccugagaccucagggagaggugucuccugcauuucaggugccuuuucugauucuugagggaacacuuccuggauacagcauggguuucuggaagggcugcucccaaagaagacaugaaagcaggagaggcaguuugcuccugacacauuauagcagugacauugucugucuuucuuccccucuuuuguuuuuguuuugaugucucgagacaggguuucucuguguagcccuggcuuuccugaaccucacucuguagaccaggcuggccuugagcucacagagaucuaguugccucucugccucccgagugcuaggguuaaaagcacaugcugcaccaacaucaccuaccaguucuuuguuuuuacugaggccgaaucuagagucucacacacgccauacaaacauucugcuacuaaacuguauaacccuggaacuuacugcgauguucagguuggucagagacuucuggcaguccuaccucugucuugucaccuacagaauuuaaaaaauaacaaagcccuuccuaaacaagguauugggauauaauccuagcgcugggguagaaaugcaaacuccaucuguagcuacauauagaguacuagugcaguagaauaugugagacccuuuauggaaaaaaauaaaaaaucuuuucagcuccucacuguucagcuaggagguucucguaagauauugacugguguacagaaaguagcuuuguauugggaucuugccuaguauucaugggccccagacucaccaguaaagagagaaaugccaguauaacaguacuccauucuccacugcucuccuuacaccuguuugagccgugccugcugcagcuguaucugagcucuuugacuguuuuguuuuuauuuuuuggagcucuuuccauguaguccuggcugucauagaccaggcuggccuagaacucagagauucaccugccagugcccccaagugcuggauguaaaacaugaacugcauggagaugaagcaaacauggcuggcuccucuuauucuuaaagaaucucauccauugcagcuuugacuguacucuccuacucucuccccugaggucuuuagaaaaacuguugcuucugucuagaaggugcuucgcucucuccgcugacuacucuuugaguaguuuggacuuccuaugugcuuuccgcuagccuuuucugcuuguuuugagagagggucucacuguguaaccuggcuggcccgggcgucuguauguagagcagacuagccucaaacuuacagaugcugggugcguguuuuuuaugauguguaugauuuuacguuuaggacguuauucuucuauuagauuauaaauucuaauagagcugucuccucuccugcuccuuuugucacuuacauucaaguacuuaauacucaguaauaugcugagugacugggcagaugaacugcuccugaauugcugugugugcuguaggguugugggcagagcaccggugacucguaugccggagggaagguccuuacgcuguacuuguuccuuuccuugaacagauuugaccgcacccuggguggccuggagauggagcuucggcuucgagaacaccuggcuaagcucuucaaugagcagcgcaagggccagaaagccaaggauguucgggaaaacccccgggccauggccaaacugcuucgggaagccaaccggcuuaaaaccguccugagugccaacgcugaucacauggcacagguaaccacaugggaccuuguagagagcaggcuuguggcuccuguccucccauuguccuguccuguucucuugaaguccaucuucuuuugcccagagagcagaccugaccagagccucuuacuccucuucccgcagauugagggcuugauggaugauguggacuucaaggccaaaguaacucggguggaauucgaggagcugugugcagauuuguuugaccgugugccuggaccugugcagcaggccuugcagagugcagagaugagcuuggugagggaugagggggacagagcagagcacacccacagagugucagagggaaagggcuuaacuccugcaccucaccuuccccuuccgcaggaucaaauugagcaggugauccuggugggcggggccacucguguucccaaaguucaagaagugcugcucaaggccgugggcaagugaguacgauguuggagccgggcauggagcuggaggcuggccauuacacucccgggcagauaacgcuaaagcugugucucuuagggaggaacuaggaaagaacaucaaugcggacgaagcugcugccaugggggcuguguaccaggcagcggcgcucagcaaggccuucaaagugaagccauuuguugugcgggaugcugucauuuacccaauccugguaagcuugaccuggugacacuccacuucuccacugggaucucuguucaccucagccugucccuuuuucuuucgucugagagauccuauucccuccuaucuacuaacagaacuucccuggguuuccagugcaccuucuccuucccuguuauguagguggaguucacaagggagguggaggaggagccugggcuccgaagccugaaacacaauaagcgugugcucuucucccgaauggggcccuacccucagcgcaaagucaucaccuuuaaccgcuacagccaugauuucaacuuccacaucaacuacggugaccugggcuuccuggggccugaggaucuucggugaggggcgggggcaggaugguaccuccagggagugggaggugugccugccagaugaucuaaggauggggaggggaauucgggacuugaagggcugaagguggguuaggguuguuaugaacagccugucucagaaagaggguccaucuuucugaguccuggguagggacccugacaucucaugcuugcaggccauguggucuaaaguuagugaugggccagguggaucuccucaaacucuuuucuuuuccucucaaccaggguauuuggcucccagaaucugaccacaguaaaacuaaaaggcgugggagagagcuucaagaaauaucccgacuaugaguccaaaggcaucaaggcccacuuuaaccuggaugagaguggcgugcucaguuuagacagggugagagugaaagggaacccuaucuggguaggggugaacccuggaccaccagccucucugaguggguucacaggauaccauaaaacauuucggaagcagauagaaugaaucuugguuucuuugugaccagcacauacuauagucacuguaacuugcuuagagggaaauacacauuuaaaaacaaggggcuggagagauggcucagugguuaagagcaccaacugcucuucugaaggucaugaguucaaaucacaaccauccauaaugagagccgauccucucuuaugguaugucugaagacagcugcagugugcuuacauauaauaaauaaguaaaucuuuuaaaaacaaaaaacaaaauucaaaccauguguaggucuaugucugcaccauuuauuguaccuggugcccaugagggcuaaacuuggaucuaggauccccuagaacuggaguuaauaaauggauguggaugcugggaguuggacccauugcuaugccaucucuacagcccauuaagauuuuuuugaguauguguguauauaauggggaugggaugcaagcaugccacagcagaugcagagccaggugaacaggaaaacuaguggguuucugucucccuuuggugagaguaaguaccuuuaccugcugagccaucuugccagcccagagaaucccuucuuuaauucaguuuaaaauaaaaugugugcaaaugguuugccugcacaugucugcaucauauguaugucugaugccucaggagaccagaagagggagucagauccccuggcgcuguagugagagaugguugugagccaccaugucaauguugagcaucauaccuggguucuacugaaaaccaguccauguucuuuccuacagagccaucucuucaguccccaaaagaguaauuuugagccaggugugguggugcagcacuuaggagacagaggccacucucugaguuugaggccagccuggucuacaaaaugacucuaggacagccagggcucugugauauugagagaacugucuccaaaaaaaaaaaaaaaaaaaaguuuuucacuuagaauuuucuggcccacgggaaaaaugguuuauuguauugccaaguggagaccuagaggacucuauggagaggagugggagccuguccugagagaacuggcacuuaaaaggaggauuggccaucuaggagucucagaaaaggagggugagagaguagauccuaacaggugcaagucauuuuguauuccuaguguaugcauaagcagcacacuuguggacaacaugggucaugugauuuuuuuuuuaacccauuucaaaauagguggaguccguauuugagacccugguggaggauagcccagaggaagaaucuacucuuaccaguaagaugaauaugggcuccugugugcaugcaagugugugccagcaggcaagagucagcacacacgccugcuugaggaggugaugguguugaugugggguaggagguggagcggcugccugauucccucaugaaccucucugcugcuuuccuccuagaacuuggcaacaccauauccagccuguuuggaggugguaccucaucagaugccaaagagaaugguacugaugcuguacagguaagggcagagaggcagacuaucaaguggcuggggcugggggauguagacagaggcagagucuggcgggacucccagcugccuggacuuuaucccucgucaguggcaggcugcccugcuccugcuucgguggauuugagccacuaccagaacccagggcugcuuguuuucauuaccaccugcccucccuuuguucuccuguaucuggaaucccaacagcccaugugccuaccagugucaucugcuugacccaggcuuuaugcugagcaguguucccuuuccaaacagaggagcugauauggucagaggcucagcuaacaauguauauaacuuuuggggucccuguaaugucuaccaggaggaagaggagagccccgcugaggggagcaaggaugagccugcagagcagggggaacucaaggaagaagcugaacccccagcagaggagaccucucagccuccacccucugagccuaagggggaugcagcccgugagggagagaaaccugaugaaaaagagaguggggacaagccugaggcccaggugagcugccugcaggggaagaggguagaguccacgggcugacacugaggggaagcaagccgcuuccuucaugccuuuagaggaggagacagcuaaugguuuuccuuauuacaucacugcucuuucuaccagaagcccaaugagaaggggcaagcagggccugagggugcugcuccagcuccugaggaggacaaaaagccgaaaccugcccggaagcagaaaaugguggaggagauagguguggagcuggcugucuuggaccugccugacuugccagaggaugagcuggcccguucugugcagaaguaagugcuggccguguggaagaugagccggguguggaaaggugauccuggaaggcccccaguuccagccucaccucuuccuaccuucucaucccacagacuugaagaacugacccugcgcgaccuagagaagcaggagagggagaaagcugccaacagcuuggaggcuuucaucuuugagacccaggugagcaggcaagggcagcaagcaugcccugccuccccagagcuuccacuuagggacauguggcucugacccuugccccaaagacugcugccugcauggauugguguccuugacaggacaagcuguaccagccugaguaccaggaaguguccacugaggaacagcgggaggagaucucggggaaacucagcgccacuucuaccuggcuggaggaugagggauuuggagccaccacuguggugaggagccuucugagauguggcaggcagaugggagugcugcccguguccccagccccucaucccacccccgcuuccagggccagagugagaagagcuggggugucaggaugaagcaagaugcagggcuggguccaggaugcuccugcugcacuucagcccuccucuuccuccucauguccgucagaugcugaaggacaagcuggcugagcugagaaagcugugccaagggcuguuuuuucggguggaagaacgcaggaaauggccagagcggcuuucagcucuggauaaucuccucaaccauuccagcauuuuccucaagugaguguucuuugcucccuuccuucuuuguguaguccugcugagaccaugguucuccuuucugccagcuucucaucugcccuaggcugaucuuuuccucuuuggcuccuaggggugcccggcucaucccggagauggaccaggucuucacugaaguggagaugacgacauuagagaaagucaucaaugacaccuggguaagcucuugucauuuguaacuggacacuuuagcugguacccugggaugaugagagugaagcugccacauccagggcuaguucugagucuucuggcuucauccccaggccuggaagaaugcaacucuggccgaacaagccaagcuuccugccacagagaagccugugcugcuuucaaaagacauugaggccaaaaugauggcccuggaccgggagguacaguaucuacucaauaaggccaaguuuaccaagccacggccacggcccaaagacaagaauggcacccgggcagaaccuccccucaaugccagugcuggugaccaagaggagaaggucauuccaccugcaggugaggagagaugcuuggcuggagcaacgauugguccugugagcagucagagcgccaccugccucucucucguaggacugcaucuaacuuuugguuucccucuaggccagacugaagaggcgaaacccauuuuagaaccugacaaagaagagacuggugaguuggggaccuggggaaugagacauuucauuagucuaggggcaggcaaauuggcaaguaugcucuauuucaggucggugaaugugguggccuuuaguuuuuagaagcauugcguuuucuuuggaaaaaaaacaagggcaaagacaggcuggggagauggcucagugguaagugcuuaauugcacagugugaggcuaagaguugagauccccagcacccuuguaaaugccaugcagccaggcugcccauuuacuaugccagguggaagagaaagguggcuaaagcagguguguuagcuuaucuagaugaaguaccaacuccagauucaagugagagaccuuccccaaauauauaagaaaguaagcaacgagccgggugugauggcgcacaccuuuaaucccagcacuugggaggcagaggcaggucuugucuacaaagugaguuccaggacagcuggggcuauacagagaaacccugucucggggcgggggggggggcggggaagaaagcaagcaagcaacgaggaagaaacccugcaucaaccucuggccuccacaugcaugggcaaaacauauacuuuuuuguuguuguuuuguuuuuguuuuuugagauagggcuucucuguguguaauccugauugaccuggaacuugcuuuguagaccaggcuggccuugaacucaauagauucaccugacucugccucucaagggcugguauaaaggcauacacuaccacaccuggcuuauauauucuuuuuuucuuucuuccuuccuuuucuuucuuucuuucuuucuuucuuucuuucuuucuuucuuucuuucuuuucuuucugacuguuucuuucuauagcccuagaccagagaaauguaaaaauuugugggagaaaggucuggagagaugacucaaugcuuaagaguuccggcuccucuucagugaagucaguuucuguuuucagcuuguagcugauggcucacaacugucuguaacuccaguuccagaggaccugauucccuauucuggccucccaaggcacauauauagugcacaggcauaugugcaagcacaacacccauaaacauuaaauaaaaauuuaaaaaagaaaaaagggagacaccccagauguggcucacacaucuucuauguguaccacuggauuuguaggucucacuuguuuagugacuggccuuuuccuucuaaaaugcagguacggaaccagcagacucggagccucuggaauuaggagguccuggagcugguaagagaggagccuggggcauuggcagcuuguuaggguuggagggaaagaagaggcuguugagccuuacacugcuauucuccuccccucccccuccaacaggaccugaacaggaagagcagucagcaggacagaagcggccuucaaagaacgaugaacuauaaccccagcuccugccuuccgacuuggcuccagccccuucuccuaccaccucuauuuauuauacaucaggguuggaguggggguuggucccucaggggcucaaguuccuucucucagcugggacaggagguggcugcucaguccuagaguagcucuaugggugaaaccggcucuaguucuguccccagccccacccucuggucuccuacucucuggcccuguguuugggaaaaaucacuauuaugucuuaauucuuugccuguggguaagugagagaauggcugccaguaguuguuggagaccugguagugggaaggauguuaugggucacuggaaaguggccagucuucacagcauccuuucaucuuuuccucuuccacaaaaucaguguccuguuugggccagugucuacagagccucagucccacuugguuucugagugccucuuuucucuucugugucuucucuucccuuguccuuccuccuuggcucuucuguccuuuccuucccugugcagacaggacuauggucuucuugcccaaagacuuucaucuggacugucuauagaguaaauaugcucucaugguucaugcgaccccugguggcuggaguaagcggggagcaggcaagaagggaaagcccuguagcccugaauggguuguuggacccaggacaguacagguccggagaguggcuggcaaggaugcaaguauacugcaggcacucgacauccuugucagccccaguuccugugacaccuaccccuucaugcucuuuccuccuucccccugggcugaccaaaaaugugcuaucuacugugagccccuuucccaagacccugggggacggagagaccauggagugaauguaaaaaugccaccucacucucaggcaagcuuuguggguaaagacgaggggucaggguucaacuugacaguguacuucgcuaggaaggagaggcccuugccugcuauaaccaugccuagagugccuguccuccaguauugcaccuguagccggagcuagggccaccccagugcaggggcaaagcaaaccugaugucagucguuuugucuuuucuaccccaaccucacccucucacccuacuuuccaccccccaccccgccuuuuuuuuuuuuuuuuuuuuuuuuuugugccacauuggcagaggggccuauagguccuucacuguucccuccuguguguuggaguucuuuaguuagcaguucaggcugguuggacagguuugaaucaaauuguacuuuguuccauuguuaauugagaaacuguuucaauaaaauauucuuuucuauagguuguau

SEQ ID NO: 5055 - RNA, 12882 nt, Mus musculus
auacaaccuauagaaaagaauauuuuauugaaacaguuucucaauuaacaauggaacaaaguacaauuugauucaaaccuguccaaccagccugaacugcuaacuaaagaacuccaacacacaggagggaacagugaaggaccuauaggccccucugccaauguggcacaaaaaaaaaaaaaaaaaaaaaaaaaaggcggggugggggguggaaaguagggugagagggugagguugggguagaaaagacaaaacgacugacaucagguuugcuuugccccugcacugggguggcccuagcuccggcuacaggugcaauacuggaggacaggcacucuaggcaugguuauagcaggcaagggccucuccuuccuagcgaaguacacugucaaguugaacccugaccccucgucuuuacccacaaagcuugccugagagugagguggcauuuuuacauucacuccauggucucuccgucccccagggucuugggaaaggggcucacaguagauagcacauuuuuggucagcccagggggaaggaggaaagagcaugaagggguaggugucacaggaacuggggcugacaaggaugucgagugccugcaguauacuugcauccuugccagccacucuccggaccuguacuguccuggguccaacaacccauucagggcuacagggcuuucccuucuugccugcuccccgcuuacuccagccaccaggggucgcaugaaccaugagagcauauuuacucuauagacaguccagaugaaagucuuugggcaagaagaccauaguccugucugcacagggaaggaaaggacagaagagccaaggaggaaggacaagggaagagaagacacagaagagaaaagaggcacucagaaaccaagugggacugaggcucuguagacacuggcccaaacaggacacugauuuuguggaagaggaaaagaugaaaggaugcugugaagacuggccacuuuccagugacccauaacauccuucccacuaccaggucuccaacaacuacuggcagccauucucucacuuacccacaggcaaagaauuaagacauaauagugauuuuucccaaacacagggccagagaguaggagaccagaggguggggcuggggacagaacuagagccgguuucacccauagagcuacucuaggacugagcagccaccuccugucccagcugagagaaggaacuugagccccugagggaccaacccccacuccaacccugauguauaauaaauagaggugguaggagaaggggcuggagccaagucggaaggcaggagcugggguuauaguucaucguucuuugaaggccgcuucuguccugcugacugcucuuccuguucagguccuguuggagggggaggggaggagaauagcaguguaaggcucaacagccucuucuuucccuccaacccuaacaagcugccaaugccccaggcuccucucuuaccagcuccaggaccuccuaauuccagaggcuccgagucugcugguuccguaccugcauuuuagaaggaaaaggccagucacuaaacaagugagaccuacaaauccagugguacacauagaagaugugugagccacaucuggggugucucccuuuuuucuuuuuuaaauuuuuauuuaauguuuauggguguugugcuugcacauaugccugugcacuauauaugugccuugggaggccagaauagggaaucagguccucuggaacuggaguuacagacaguugugagccaucagcuacaagcugaaaacagaaacugacuucacugaagaggagccggaacucuuaagcauugagucaucucuccagaccuuucucccacaaauuuuuacauuucucuggucuagggcuauagaaagaaacagucagaaagaaaagaaagaaagaaagaaagaaagaaagaaagaaagaaagaaagaaagaaaaggaaggaagaaagaaaaaaagaauauauaagccaggugugguaguguaugccuuuauaccagcccuugagaggcagagucaggugaaucuauugaguucaaggccagccuggucuacaaagcaaguuccaggucaaucaggauuacacacagagaagcccuaucucaaaaaacaaaaacaaaacaacaacaaaaaaguauauguuuugcccaugcauguggaggccagagguugaugcaggguuucuuccucguugcuugcuugcuuucuuccccgcccccccccccgccccgagacaggguuucucuguauagccccagcuguccuggaacucacuuuguagacaagaccugccucugccucccaagugcugggauuaaaggugugcgccaucacacccggcucguugcuuacuuucuuauauauuuggggaaggucucucacuugaaucuggaguugguacuucaucuagauaagcuaacacaccugcuuuagccaccuuucucuuccaccuggcauaguaaaugggcagccuggcugcauggcauuuacaagggugcuggggaucucaacucuuagccucacacugugcaauuaagcacuuaccacugagccaucuccccagccugucuuugcccuuguuuuuuuuccaaagaaaacgcaaugcuucuaaaaacuaaaggccaccacauucaccgaccugaaauagagcauacuugccaauuugccugccccuagacuaaugaaaugucucauuccccagguccccaacucaccagucucuucuuugucagguucuaaaauggguuucgccucuucagucuggccuagagggaaaccaaaaguuagaugcaguccuacgagagagaggcagguggcgcucugacugcucacaggaccaaucguugcuccagccaagcaucucuccucaccugcagguggaaugaccuucuccucuuggucaccagcacuggcauugaggggagguucugcccgggugccauucuugucuuugggccguggccguggcuugguaaacuuggccuuauugaguagauacuguaccucccgguccagggccaucauuuuggccucaaugucuuuugaaagcagcacaggcuucucuguggcaggaagcuuggcuuguucggccagaguugcauucuuccaggccuggggaugaagccagaagacucagaacuagcccuggauguggcagcuucacucucaucaucccaggguaccagcuaaaguguccaguuacaaaugacaagagcuuacccaggugucauugaugacuuucucuaaugucgucaucuccacuucagugaagaccugguccaucuccgggaugagccgggcaccccuaggagccaaagaggaaaagaucagccuagggcagaugagaagcuggcagaaaggagaaccauggucucagcaggacuacacaaagaaggaagggagcaaagaacacucacuugaggaaaaugcuggaaugguugaggagauuauccagagcugaaagccgcucuggccauuuccugcguucuuccacccgaaaaaacagcccuuggcacagcuuucucagcucagccagcuuguccuucagcaucugacggacaugaggaggaagaggagggcugaagugcagcaggagcauccuggacccagcccugcaucuugcuucauccugacaccccagcucuucucacucuggcccuggaagcgggggugggaugaggggcuggggacacgggcagcacucccaucugccugccacaucucagaaggcuccucaccacagugguggcuccaaaucccucauccuccagccagguagaaguggcgcugaguuuccccgagaucuccucccgcuguuccucaguggacacuuccugguacucaggcugguacagcuuguccugucaaggacaccaauccaugcaggcagcagucuuuggggcaagggucagagccacaugucccuaaguggaagcucuggggaggcagggcaugcuugcugcccuugccugcucaccugggucucaaagaugaaagccuccaagcuguuggcagcuuucucccucuccugcuucucuaggucgcgcagggucaguucuucaagucugugggaugagaagguaggaagaggugaggcuggaacugggggccuuccaggaucaccuuuccacacccggcucaucuuccacacggccagcacuuacuucugcacagaacgggccagcucauccucuggcaagucaggcagguccaagacagccagcuccacaccuaucuccuccaccauuuucugcuuccgggcagguuucggcuuuuuguccuccucaggagcuggagcagcacccucaggcccugcuugccccuucucauugggcuucugguagaaagagcagugauguaauaaggaaaaccauuagcugucuccuccucuaaaggcaugaaggaagcggcuugcuuccccucagugucagcccguggacucuacccucuuccccugcaggcagcucaccugggccucaggcuuguccccacucucuuuuucaucagguuucucucccucacgggcugcaucccccuuaggcucagaggguggaggcugagaggucuccucugcuggggguucagcuucuuccuugaguucccccugcucugcaggcucauccuugcuccccucagcggggcucuccucuuccuccugguagacauuacagggaccccaaaaguuauauacauuguuagcugagccucugaccauaucagcuccucuguuuggaaagggaacacugcucagcauaaagccugggucaagcagaugacacugguaggcacaugggcuguugggauuccagauacaggagaacaaagggagggcaggugguaaugaaaacaagcagcccuggguucugguaguggcucaaauccaccgaagcaggagcagggcagccugccacugacgagggauaaaguccaggcagcugggagucccgccagacucugccucugucuacaucccccagccccagccacuugauagucugccucucugcccuuaccuguacagcaucaguaccauucucuuuggcaucugaugagguaccaccuccaaacaggcuggauaugguguugccaaguucuaggaggaaagcagcagagagguucaugagggaaucaggcagccgcuccaccuccuaccccacaucaacaccaucaccuccucaagcaggcgugugugcugacucuugccugcuggcacacacuugcaugcacacaggagcccauauucaucuuacugguaagaguagauucuuccucugggcuauccuccaccagggucucaaauacggacuccaccuauuuugaaauggguuaaaaaaaaaaucacaugacccauguuguccacaagugugcugcuuaugcauacacuaggaauacaaaaugacuugcaccuguuaggaucuacucucucacccuccuuuucugagacuccuagauggccaauccuccuuuuaagugccaguucucucaggacaggcucccacuccucuccauagaguccucuaggucuccacuuggcaauacaauaaaccauuuuucccgugggccagaaaauucuaagugaaaaacuuuuuuuuuuuuuuuuuuuuggagacaguucucucaauaucacagagcccuggcuguccuagagucauuuuguagaccaggcuggccucaaacucagagaguggccucugucuccuaagugcugcaccaccacaccuggcucaaaauuacucuuuuggggacugaagagauggcucuguaggaaagaacauggacugguuuucaguagaacccagguaugaugcucaacauugacaugguggcucacaaccaucucucacuacagcgccaggggaucugacucccucuucuggucuccugaggcaucagacauacauaugaugcagacaugugcaggcaaaccauuugcacacauuuuauuuuaaacugaauuaaagaagggauucucugggcuggcaagauggcucagcagguaaagguacuuacucucaccaaagggagacagaaacccacuaguuuuccuguucaccuggcucugcaucugcuguggcaugcuugcaucccauccccauuauauacacacauacucaaaaaaaucuuaaugggcuguagagauggcauagcaauggguccaacucccagcauccacauccauuuauuaacuccaguucuaggggauccuagauccaaguuuagcccucaugggcaccagguacaauaaauggugcagacauagaccuacacaugguuugaauuuuguuuuuuguuuuuaaaagauuuacuuauuuauuauauguaagcacacugcagcugucuucagacauaccauaagagaggaucggcucucauuauggaugguugugauuugaacucaugaccuucagaagagcaguuggugcucuuaaccacugagccaucucuccagccccuuguuuuuaaauguguauuucccucuaagcaaguuacagugacuauaguaugugcuggucacaaagaaaccaagauucauucuaucugcuuccgaaauguuuuaugguauccugugaacccacucagagaggcuggugguccaggguucaccccuacccagauaggguucccuuucacucucacccugucuaaacugagcacgccacucucauccagguuaaagugggccuugaugccuuuggacucauagucgggauauuucuugaagcucucucccacgccuuuuaguuuuacuguggucagauucugggagccaaauacccugguugagaggaaaagaaaagaguuugaggagauccaccuggcccaucacuaacuuuagaccacauggccugcaagcaugagaugucagggucccuacccaggacucagaaagauggacccucuuucugagacaggcuguucauaacaacccuaacccaccuucagcccuucaagucccgaauuccccuccccauccuuagaucaucuggcaggcacaccucccacucccuggagguaccauccugcccccgccccucaccgaagauccucaggccccaggaagcccaggucaccguaguugauguggaaguugaaaucauggcuguagcgguuaaaggugaugacuuugcgcugaggguagggccccauucgggagaagagcacacgcuuauuguguuucaggcuucggagcccaggcuccuccuccaccucccuugugaacuccaccuacauaacagggaaggagaaggugcacuggaaacccagggaaguucuguuaguagauaggagggaauaggaucucucagacgaaagaaaaagggacaggcugaggugaacagagaucccaguggagaaguggagugucaccaggucaagcuuaccaggauuggguaaaugacagcaucccgcacaacaaauggcuucacuuugaaggccuugcugagcgccgcugccugguacacagcccccauggcagcagcuucguccgcauugauguucuuuccuaguuccucccuaagagacacagcuuuagcguuaucugcccgggaguguaauggccagccuccagcuccaugcccggcuccaacaucguacucacuugcccacggccuugagcagcacuucuugaacuuugggaacacgaguggccccgcccaccaggaucaccugcucaauuugauccugcggaaggggaaggugaggugcaggaguuaagcccuuucccucugacacucugugggugugcucugcucugucccccucaucccucaccaagcucaucucugcacucugcaaggccugcugcacagguccaggcacacggucaaacaaaucugcacacagcuccucgaauuccacccgaguuacuuuggccuugaaguccacaucauccaucaagcccucaaucugcgggaagaggaguaagaggcucuggucaggucugcucucugggcaaaagaagauggacuucaagagaacaggacaggacaaugggaggacaggagccacaagccugcucucuacaaggucccaugugguuaccugugccaugugaucagcguuggcacucaggacgguuuuaagccgguuggcuucccgaagcaguuuggccauggcccggggguuuucccgaacauccuuggcuuucuggcccuugcgcugcucauugaagagcuuagccagguguucucgaagccgaagcuccaucuccaggccacccagggugcggucaaaucuguucaaggaaaggaacaaguacagcguaaggaccuucccuccggcauacgagucaccggugcucugcccacaacccuacagcacacacagcaauucaggagcaguucaucugcccagucacucagcauauuacugaguauuaaguacuugaauguaagugacaaaaggagcaggagaggagacagcucuauuagaauuuauaaucuaauagaagaauaacguccuaaacguaaaaucauacacaucauaaaaaacacgcacccagcaucuguaaguuugaggcuagucugcucuacauacagacgcccgggccagccagguuacacagugagacccucucucaaaacaagcagaaaaggcuagcggaaagcacauaggaaguccaaacuacucaaagaguagucagcggagagagcgaagcaccuucuagacagaagcaacaguuuuucuaaagaccucaggggagagaguaggagaguacagucaaagcugcaauggaugagauucuuuaagaauaagaggagccagccauguuugcuucaucuccaugcaguucauguuuuacauccagcacuugggggcacuggcaggugaaucucugaguucuaggccagccuggucuaugacagccaggacuacauggaaagagcuccaaaaaauaaaaacaaaacagucaaagagcucagauacagcugcagcaggcacggcucaaacagguguaaggagagcaguggagaauggaguacuguuauacuggcauuucucucuuuacuggugagucuggggcccaugaauacuaggcaagaucccaauacaaagcuacuuucuguacaccagucaauaucuuacgagaaccuccuagcugaacagugaggagcugaaaagauuuuuuauuuuuuuccauaaagggucucacauauucuacugcacuaguacucuauauguagcuacagauggaguuugcauuucuaccccagcgcuaggauuauaucccaauaccuuguuuaggaagggcuuuguuauuuuuuaaauucuguaggugacaagacagagguaggacugccagaagucucugaccaaccugaacaucgcaguaaguuccaggguuauacaguuuaguagcagaauguuuguauggcgugugugagacucuagauucggccucaguaaaaacaaagaacugguaggugauguuggugcagcaugugcuuuuaacccuagcacucgggaggcagagaggcaacuagaucucugugagcucaaggccagccuggucuacagagugagguucaggaaagccagggcuacacagagaaacccugucucgagacaucaaaacaaaaacaaaagaggggaagaaagacagacaaugucacugcuauaaugugucaggagcaaacugccucuccugcuuucaugucuucuuugggagcagcccuuccagaaacccaugcuguauccaggaaguguucccucaagaaucagaaaaggcaccugaaaugcaggagacaccucucccugaggucucaggaaccuaccccacgccccggaucugcagcugugguugcaucccagccuccuuagucuucacugucugguaggugacgauggugcacacagugcugcccgagcccaugucauagaacaugacguucuguggagacaccaaggauacugucagaggaaccuaauguggaagccaagcuaggcgugguggugcacaucugucauuccgugcucgggaggcaggggcagguggaucucugaguuccaggccagccuggcuuacacagugaguuauaggacagcgaggucacacagagaaaccugucuuaccccucucacccaccccacacaaaaauaauaaaacaaagagauaguuuaucaaaugcaggaugccugucuacuugucugccugaaaauaaaaagcugucacucuucaaaaaacuaaccaccuccaauggguacugaaaggcagcuauuugucacaauuugucaagggauggccaugcaaaaaagaugcaaaaaugggucaaggauccuccacccucauacucgguguuguauguauucaguggcucaccugugcaguggaauugauaucuuuccggcggaagacaccguagcugagggcuguggcaguguugucauugaugagcugcagcaccuugaggccagccauccgagcagccugcagcacagcucggcgcucagccugguugaaaaaggcuggcacggugaucacugcauccuuaauggguuguucuacaaggacaaagagcaggaucucagcaaccccaaacaucagaccaggauguccaacacaguaccacugacucuuaccgggccucccuauccucuacauacuagaugccaggagcccgucccgagcuugugacaaccaaacaugucuuccgguaugguccaauuuucaauaagaaaucaaagaggcucugcuugcuauucacuguacauuugggaagucccacugccaccagcaccaccuugaugcucaccagcaaaaucuucagccaaggaacgggaguaguucagaaccaugcccaguaccuccucgggagagaacugcagcugccugaggggaggaggaggaggugagguccaggaaggcaaacaccaagcccaauaaccacggacacaugcgccaacaaggggcuuccuucccacucuggacacucacggacugaucuggaagcgcacagucugccucugugggucaacaauuagcucauguucugggaaacgggaccgguaaagggccacaugaggguuauccgccuguuuuccaaggaggugcuggaaauaacggagcguagccuuuggguucuugauggccugaaaggaggagacccagccaauucuuaggcccaaaccuaccuuaccuugccucuacuucauccagcuagauaaaaggcuagccucugagggaacgaaucuggcuagggcuguuacucaccaugccggcugcacuaucaccuaaaaaccuuucauuuucuuucaaggucacagucacuggaguuuuccuccgagauucccuaagaaaaagcagcauuagcccagcugccugcagcagacuaugaagccagacgccaccagaucucauacgggggcucagccaucacagucugaagugggcacuauaaauuauaaacacaccccugacccagaucuacucuuacuuguucaauacaaucuccaugggcacuccaggcuugacaauggccaccuucauggauucacugcccaggucuacagacaucacagccaaugugucugaagggaagacagaauguagguuucucugucaguucucugcuucccacacccuccugccuuccuaaggcaaaucaauggaagcagccugcuuuccauggcaaagacaaagaaaaaggcuagauccagcaaccccaaacucgaguaggcaccuugugcccucuuauccuuccauucuucuuuaacaccuuagccagguacauaccgcucagugccaacaggucugccaagaggacagccaccaaggcccaacagaguagccuccuuggccucugccuucuuacuguggcugccauugugacccuaaugggaaaggaaaaacacuuguaacuggaugcugaaugaagaaggaaacagaaccacaucccagaacagacaagcucaaagauucuuaucuguugcacuuuggcaaaaaagcacagcagcucgaccucuucucuuccuuccugaggaguuucaaucauuuuaaacauccucccaagugucucacauucgggccgaagcaaaagggcccuccaccacuuacuuagacaaauaagaguugaccuuuuuucggucuacguacagguaagcaaucggcacaccacagcacuguaccugucagacaccuggagcuuggccaggacccucgaaaucggcucaaauaccucacaccugggguucccggguggccgggaaagccagguugagcuugggcaggaacuggaaggugaugacguuggggauggcuggcacagaaggguuuguccccuucucugaauucccugagcauuguccagcccacccuccuugcccaucccacuccugggccacgcugccuacgcagacguugugcaggcuaagguuacaagccggguggauguucaccuaaaccucaccugacgaagguggaagaucccacucccagaaauggauucaggcccacccugagcgcgagggggcagcucagcgccugaacuucaggaccgaagggaccgguguccgugcggcccucgcuccggcuaccggcccgcccccgaagcuagcacgcugccuccccuaggagccgcggcccgacggcugcuccauccucacccccgcucccucuggccuucagcuccuguguccuucgcuccgggaucaaggcggcgaggacguacccacacggccagcagcacgaccccaaccccgggcccuucacaacuccccuucguuugcaaacuguuacaguggccaccaaccucucagcggcgucucgcgcaccagccggccccggacgcggcgcacgcucauuggcgccccugccgcucggcccugcgccgcgcacuuagcaccgcccacgagaccc

SEQ ID NO: 5056 - RNA, 3862 nt, Mus musculus
aaacuccgccucuugugggaugggauagggggcgugacuuccaaccugcaaacucugagacuggucguaaaauugcugcacuuugcugcgggucacccaacagccacuaauucucugcucugucacugagaaauacaguaggccaguucccagaaauguguuuguuaaagcaaugggggccuuggcuugcgcgugcgcuuuaggaggggggagggccgcaggagggagagcagaggcgaggcuaugacaccaguuccgggacuggagcgccuggaaggggcgggaucguaguacccuauccguagcacagugauggcgauuuuuagcguguacguggugaacaaagccggcggccugauuuaccagugggacagcuauucgccacgggcugaggcugagaagacuuucaguuacccgcuggaccugcugcugaaacugcacgacgaacgcgugcuggucgcuuucggccagcgcgacggcauccggggugggccgggcucgagggcggggcuggcgcugcggaagugggcuggugcggggugggagugggagugagagugaaagaaugggagugggaguaagcggggcggggaguggcccgggccaucucugauccuuagccacucuucuuguagugggccaugcaguguuggccaucaauggcauggacgugaauggcaaguacacggcugacgggaaagaagugcuggaguaucuggguaacccugcgaauuacccgguuuccauccgauucggccggccccgccuuaccucuaacgagaagcuuaugcuggccucgauguuccacucguaaguuucccuaccccuuuuaaacauuuccuccccugacuagugcaucugucucuaggccggcuaaaguguuucuuuguguacuuaaagagguacaauuacuguguaccucuuuaaguggcugaacucuuuuuaugaagaaaugucaacuauagccagguuugagguaguuugauuuuugcccagucaggucuuguccucuugacccuaguuucuucaucauuaacauaagguaauugaauuuuugaaaaaaaaaaauuugggggggauaggguuucucuucaacuucuguauuaggguuuuacugcugugaacagacaccaugaccaaggcaagucuuauaaaaaacauuuaauuggggcuggcuuacagguucagagguucaguccauuaucaucaaggugagagcauggcaguauccaggcaggcaugacgcaggaggagcugagaguucuaugucuuaauccaaaggcugcuaguggaagacuagguugucuuggaacucacucuguagaccagccuagccucaaacucagagauccacuucucucugccuuccaagcgcuggguuuaaaggcgugugccaaucaccaccaccaccacuuaauuagauaauuaaauuaaguggacauugaaauucuuucuguagccgggcguggcgcaugccuuugaucccagcacuugggaggcagaggcaggcggauuucuaaguuugaggccagccuggucuauaagggugaguuccaggacagccauggcuacacagagaaacccugucucaaaaaaaaaaaaaaaaaaaagagaaagaaagaaagucuuccugugacugccuguaguguaagguguguugacauagcaguagccaugaacuaauaagguacguauuccguagcauguuggcuuuagcuaacacguuuaguauaacauguuucaguuuggggcugaagaaaugguuugguguuugcuguucuugcagagagcuagcauccacaugguggcucacaaccaacuccuauuggaagggacgugauggcuucuucuggcuuccauagucaccaggcacauaugugguacacaugcauccaugcaggcaaaaacacucauacacuuccauaagcccauuuuuaguuuuuauugcuacauaaagcagccuacagaggcggcuagagauggagugacuucucugucaccaggugacuaagugagaugguaaauaaaaauuaaauaaaucuuagggaaacaauguuuuguagcaaaguguauaagauauaguguguacagaagggagauaaaccuaaaagaaauguugacacuccugcuagacuguucacaguauuucuccugacuggcccuggaaagugaauuccuccaaagauuggguacuugaguggaaaagguugaggacuuucccuucaugucacauggugcauucccaacuuuaccucuuuugcauacaggcucuuugccauugguucccagcuaucuccggaacagggcaguucaggcauugagaugcuggaaacagacaccuucaaacugcacugcuuccaaacacugacagguaugugccuacagaggucauagggauagauggagcacauuaguccaguauggaccaagggacugacccgagaaagcuuagguaaacaacagggauggugucagguuucccgggcacacauguacaacacacccauuuuuacaaagccacucuugguuuuuuguuuuuuucuuuuuuuguuuuuuugagacaggguuucuuucucuaugcagcccuuggcuguccugaaacuuauucuguagaccagacuggccuugaacucagaaauccaccugccucugccuccuaagugcugggacuaaaggcaugcgccaccacugcccagccccaaagccauucuuuaguccaaggcugacuuuguuugugucagccagcaugcucaacccugguugugaauugguaggcuucucacauuuuggaaggugugcguucuaaaucaaauuugaaagccaaguagacauggccuuuggauccuacuuaauugcuucacuccuugguguggauagcugaggccccagagcuuggcuucaguaauucuauuucuucagaggaacugcaagucugaaaauggcagcugaucuugaaucuggucacucugucacccagggagagugaagucaccccaucucuagccuccuuuguucgcugcuuuauguggcaauaaggacaaaguaaaaaugggcuuaugauaguaguuuauaaaacugaaggggcugcaaaaauacaggaugguuuuugaugcauucucuguccuugaguaacuguuccugacuuuucuccagggaucaaguuugugguccuggcagacccuaggcaagcuggaauagauucucuucuccgaaaaauuuaugaaauuuacucagacuuugcccucaagaauccauucuacuccuuggaaaugccuaucagguagguagccccauucaccagauucugccaaagcuuugugcuagcucccaagucauuuaaagugugaccaagcacugcuuuuagggaaagacagcagugaccagcucuguuugucuugaggacacaggguuuccguaggcuucacguucuucaagucauuccuaccgauucugccucuacccuugugguggaagucucaucccucacaguuucuugucuucugggucugaccuagaugcgagcuguuugaucaaaaccugaagcuagcucuagagguggcagagaaggcuggcacuuuuggaccugggucauaggaugaaccuggaauggacgcccuaaauucugagacgugcuccagagggcuuugcugugucuacucggugaggguccuguuguagcagccuugcuaauauacuugaaaaugguagaccacugagccuggugauggugacagauccugggcucgaaugcuguguucucugccccucuguauauauuacaguccuacucuguauagauuuauuuauggaggaaacuggcuuagcaaugcugaaauaaacauuccuuuguuuuaguguuuuc

SEQ ID NO: 5057 - RNA, 30466 nt, Mus musculus
ugggaaagcuagauaaacucucucaaacuuucccaaaggggaaagcagcccaaaggcaaagcaagcuauauccaggccaccuguaucaccuuagaugaagagaacuccauacaccucccauccuaaccagcuaaagcuaagcucagcuuuauuucuuccuggccauagggacaaccaccucugcuguggcccacagucucaucuuccuccugauuaugagcccagacucuccucccagaauguauuccaucaucuuaaagacuacuggcugccacagcuacccaccacuccuauaccacagaggaauagccagcuggcggcggcagacuauggccuuaaugugccugucucauaaauacagacuucaugccagaccuucaaccgugccuuucucuuaaccaagcagaaagcugaaaccgaucuacuuuagguagcugucugguuccaaccuaaccagcauugggucagccccauguuacuggaucuuggauuacagacugagggcaaguuccagaagguucuggaagcuagccaguauccuaagaagaguaaagggcaagccagcaggaaagaggcccaguggaaaaguggaaagacaccuuuuccaggcucuaaggaagaacaaguaaaaaucaaacccagcugucuucuccacccauuguaccaaagcuuacagacugguggggaaaugagauccagggcccucguggauucuacgcaccaauggggaaggaagccaacuugccuggggaaagcaagauagcaaagugguccuagccucaagagaggggacaccuagcuaagagaaugacgacagagguuccugucuucauuaggcagaggcaauauaagaagccaaccugggcaggcaaguccucaaaccccaggaaggcaguacccugccccugggaggguaccacucacauggaaccagaggaagcugcuccaugcauacauaggggaaguuagcaggcaauucugagcucggcuuccucccagccaccgaucugggggcguggggguaggaagcagaguugccuaguaccacucaagccaaccguacaagcucccugggggaucccacuggggaaaccaaugcuauagcuucagagacuguauccucauugcagaaccgugaagacaccuggggacccccuuuucugcucccagcauccaacaaccagcugggaagaggcaaaccgggcacagaaauaaaaaugcaagagauggcauuuuugaauuuucucuuuuuaauaaaaaggcaccuauaaaacaggucaauacaggcagagacccccggaacaagccuaaaaaguguuucaaaauaaaaacaggaagaugucuucacauauuguauuuauauauuuauauuuuauauauauauuuauauaaugguacaaaauggcugggguauggccauggauggagggagaaggcuggccuguggagaucaccuugggaagcuagugguagaggugggagacgagggcacaagaagagggcauugggcccuuuguggccggagcccucuccuuggagcagggcaggcuagacagucugggcaggguagggaugugggugggggcacaaggcccagauggaagcagggagggcagugucuggcaggaaggacagguuuccacccaccucucaacacaagagaccuuggcuauggucccugggaggagcaggggaagccaggggccugcagccagcucuggagggggcuuggugccuggccuggcugaugguggacagcaccagacugggagaagugggcacaaauucccuuuguauuacagcugccaaggcaaaaccaggcccugcaggucagaaaggcuggggacagggcccugguaaaagacacccugucuagaauggcccuuggcccuggaggcaggacaggaaaggccuuagccagggagcugcccgccaccuuacaaggcaggaaaggacgugagaaaaacagaaguaguuuacuccuggggccaaaggggacaaaacacccauuccuguauggcuugagucugaccaggggcgggugaggggcucuccugggaagucagaggagaggcaguggcugugucuggugggcauagacagaucuggugcauggcccugagcccuggacagaaggaccuugcagagaguaggcaggcagaggaggcaacaggauguucucgcucacacugccuucccucgcucugcacuagagguggagggccaacucuguaccuuccuucuuuggugagaagcaaguggugguuucuagaagaguccaugcccugaaggguuaccuggcccacggcuacugcagccagggucccagcauccuaaccccuccauagcuccauucuauggggccacacgcugccccuuccuucucgccuuuuauccuagaauggggauaaagggcuucaaguucuggcuaagauguagcagcagaggcacccaggcugggggcccuaugucacugguguggguaaacacauguacaugugcgcaccugcucucuggaaaucacucagcagcagacaggcggccgucguagagggacggggguagauucucaguccucaggggcucaccaaauggaagccuagauggucugaucucauuuuauagguggggcuuauggagggugcauaggacuguaugucucuggguccagaggaaugaagggugugaucauuugaaagaggggggaagguuuuuuuuuuuuucucaaucuuuuuuuuuucuugugugugacuucuaucaagacacagaaauacggcacacgcacaaaccggcacaaaagcccagcucuauuuacagcuccgcuggcaccugcccaccuggccagcugccugcagggggcgugggagaggaggucagccacgucaguagggaaaggaaaugaggcagaaggaaaacaggguaaaagcagagagacgggaaggcgagaaacggaccugaagcgccgccggcaaggugacaguccacgacgggucagaggauggaagacccuccucucuccccaaggacccccaaaacauagcugaaagcggggaagugcaaagacaaagggagacagaagcuccacgggaaagggggggggggcagaggaggcgcaguccuagugacagaaauggagcagagcccgauuccaacuccucacccgacacuugccgcuucccccucagcugccagcacagcagguuuccacaaacaccacuccccacacaagcccguucccacccgccacccuaccccuggacccaggccauccaucccaacacuggaggaaaaacaaaacuuuuuaaaguuaacauauuuucaguuuccccagccccagaccgaggggccugcuagaaggguagauuggccaugcugcccggcguuggcagguagcccaucuggcuguccagagacacacugcgcugacgcagagggugggacaccaugagguucugcugggguggggggcccaugagggagcccuguggggagagcauguggggaggcuggguguagaccucgccccccacaccccucugcuucaucagcauaaaauucugcugggucaugaggccuuguggaggggacaugacccccuggugcaggccauggggcaccaugcccuguugugggggcacaccuguccugcccagcaaggacaucuguccaggguggcacauggacaugcugagcccccgcuggacccccuguuggcccgggagguuggggggucgagacggggucugcucugccaucauguucugcagguucaugagaugcagauuggggggcugggccuuggggggcugguucucgcucuuggggaaguacuggagggugcugcuugguuucucagaggggaugauccuggauaagucgaacucaggaaugccgguaggggugggccggaucaccucacucagcucugggucauucaguaccgaugccaccccagggagcaccccggguggguaugcgucgcccaugcggccagucaugccuuugcccauuaggugcugcuggggggguaugggacccgguggcugggugggcagguccucggggggcagggccaugccugaaggguagugcugcugcaggccugggcccccggccccggugggggccauggcaccgugagguugcugcagccgaggagggaaggacaucaucugggaggagcugggcacagggccacaaggggcauuuagggagucugggccuccuggggccaucaucauugaguuuugagaagagcccccaguccccugugcauugggaugcaguggaauguuggaccccagaggggugggggagggcaacauaguagggggaggcucaugggacaggggcugcuggccuggcaaguucaugcccauggggcucugggcagcagcaggguucaugugcaucugguugggcugguuauugcugauaccugugggaggaaggacgaacgggacauuagaggccaugcccacccaguuuggggaggggucucccaguccuucccagcccacuaaagagcucugggcuagguuucaugaagcgaugguagucauucaaacggggccucagagcucacaccacccccaugagcagagacuauagaagcaugcagaagccagcauguccacgggggcaauuccuaagcaaacccacuguugccacucccagagagagcucugccuccucgcaccuggcccagagcccugcggugguggggguggggguagcaggggccggucaggcagcagcucgucaucugagguggcgauggucuugauggcguugugguauagcggggucgagcugggcauggcguacuuggacaucugagacaucaucagugacagaggguucugggaagggguggggucuggggaggaugugaacgguaggcugggguucaugaggccacuggaaggguuggcgggaggagcggaggagcuguuccggggugcgcuagguggaagagcaccuacagaagcggagagacagaaagagagcgggagggggggugucacuagcgagguuaacgucccccaaaucuccaccucacgucagacacacccauaucccacugaccacagguucccuguggucccuacggcccaugcuucuccaagcaguuuccccaguggggaaaguccuagcuccaaguggcacccuucaagauguuuaagaggcuccggcagagcaugccccugcaggaaccuacccgccaccaaggcucccacccaagcccaccuagaucacucacccuguuccacguugcccaggguggaggaagaguuuaugcugagagguggcugcuuguucugggagaccccaggacuaggcauggcugucuugggagaggcgacccagccuggagaaggcaccgccauggagggagacuugagccugcugggugagccagugggugaacgcacaccgagggaagagcugaggaccuggggugacuugagaggucccgguggguuggcagaaggcaaggguaccaucugggagggagucuggggugacuugagguuggcagagggugaggugaccaggggggagugcaccuggcuaagggugggugacuucagaugucccaugcccggugagcccaucugauuaauacugauggugagaucugaaggccgccugccuagcccccuguuggaggccaagugcacagacccaggaggauuggaggcagggggcagaggcauauggcugagccgggcagugcccacagugcccaugggcacugaacucugaucagggcugaacaugucuggaguguugcccauguccuggggcauggcuugguaaggucccuggcccccagagaaucccugcuggcccugguugggaaacugugaaggcaugagcaucuucugcggaccccccaucaugccacuacuguucugggcccgaacccgagccaucucuucgggacugaggcccugaggacccaucaugucuccagggccccgcaucuucugugacaucagcaucugcugcuggggcgucaucugcacauucagguucauguucauguucauguucacauucauguucauguugagguugccuggccccauaggcgggucuaccucccgcagcccagacugucccauuggagggcucaggaggccccgaccuccaccaaacucuaugcccaugggugugccggcgagaccaucuccuccagucaucugucccgggaacauggcaggguccaucugucgaugagccuguaucauccguuccauuuccaugcucugucccaugccgcuaccugccaugcccaggggacgcugcaugcccauggaccgcuucuccagcaacuggugccucagcagcuccucccggacacgaggggucaugaaucgcucugccucccccugcccaccuggguagggcacggcauucugggcaaaguugcugggucccccaauagggggcaagucuucauuccaggccaugccuggccuuacaggucucugcauggcauucauggguacuuccaugggcauacucugcauaccuccaaauccgggcacccuuugcaucugguugccugggaaacgggggccagggaagggagguccaggucggagcugcaugggaucuuggacauccauaggcccucggaguugugcacccauuccagguggccacugauccccagguuugcugugguaaggaggugggggcccccuccccaucauaccccccauucccaccauguccugcagagggcggccuccgugcaauccaaucugcuccucuuuccgccgcuucuccucguaguacucuuccugcaguuugcgccaggccaccugcucgggcgucagacuguccuggcccagccucugcaucaucauguucauuugcugucccaugucuccacccugagggugccccggcacuucaugcuccagagggggaccuccuaggcucugugucugugagaucauugacugcagaggcuccucauacuucuucagccccccaggaggggcggagggaggcgguugagcagcagagggcgcuugugccggugggccucccucaccagcuccucccgggggccccuugaggaagggcucagucuccccacugcggagcagcagccucucgaugucccgcagugucuggagggagcgcucccggugcuccagcugcucuuuggacaggcccucagagcccaccagguuccucugcccauuuccggugggcguggccucccccaauagggcggagccaggggcacugccagggucuccuccaggaggcagaggguuguuagcgguggcagccguugggguguuaggguggguacccccagucccaccaccuguacuggcagcucccacugaguugggggccagguccugacuggugucuucaggaggccccuccgggggcagagcaggaggggcacugccaggggcuggggguggcgguggcaaaggagguggcugggacugugguguaccugcugauggcguauucagggguagugguucugggguggguggcacuuuaggggccugcaggaggacaaagguaaagaauaagacagaugaggggacaucccaaagaauauuagagccuggcaggcuaccacacuuaccugauccagcuuggcccgaggcacauucugcuggugguaggcaaggauggacucugcccggcccugcagcacugccucugccgcucugcauagggaagcagccacaggcagcucagagaugggcaaaagcaagcuggcccucacccaccaaccuugcaccgcacccccacccccccuuugcucaggcuggucagacagacaaaacccucucaccccucaucucucccaaagacuuacguguuggccagauggguggugaagacauagacgaacugugacggaggcuuuccugggacgcccccacccccacccccaggaacgucuggccgaaggccuggcugggggccauguugggggccuggugcacugcucucacugaggggcaguugggcaguuuggccaggacccaacuguggggucaccauggcugggucugcuacauuacaaucuguaagaggaggaagaaaggagagcgggugagcggcccagacgugggaagaaggccaaucagccgguguuccugcccucagaugcucgcucacugccucaagcccaugcccagagggucaucugucccuacagucuccguuuaccagccuggcuuuccaguucacuuaaccuauacuaaccuuugcucaagauggccaggaugcagaaagaugaccauggagagaggugagaaaaagugacagaaaccccaaagcucugcucuaaagcucccacacucaagcacuugagaucagucaguuucucugccucucucucucucucucucuguguguguguguguguguguguguguguguguguguaugugugugaauuuacugucuaaaugacccagccaaggggaagguagggaggacauaguaguaacugaugauucaaaccacagacagauuuucaucuuaccccacgauucacuaacugugguuuuacaaaacagcauuuguuuaagccucaguuucuucaucuacaaaaugcaaacacuacucaucucccacgugcccugcccaaggacaaguccuuuuaaaaacauggguacuacgccacaaagcaaaacaucaguuucaacaagagucagaaaggcuuucacaaaugaucaacgcaagacuucggucaccucugaugaccaagaaucucacggagguguucccaucaacaacaugcauacacacggauggaugcaggugagaugaacacaguuugcaaggcacgugagaaagggcauuugcuucugcacccucucugaacacgagacaguccuuuuggauuuugcaggggaagggcauacauauugcacacauucaguuuaagggcacagggcacauauggagcucaacagagaacacuaaguguuggcucucagacuuuaucaugcacaccacguuagcuggacaaugacaaugagcuuccagagaaccuggcugcucugcuuugaaagucccaucacugggcugauuauaggcagguaccacuguaccuggcuuccuguguggguucugggaauccgaaaccuugcaaggcaaguuucucccaacugagccaccuacccagcccucuuuuuuggauuuuuacagauuaaucauuagucacauuuaauuaaaccauuagcuucaggugaucaauuugacuuucagccccacuccuuugacgaggauggaauguagggcugaaagccccaaaccucuauccugcuuugauuuucccagucaccagguuccaucuagaagcuaccucaggacugccagacacaccagucgauacagcauuaaacaaaacagaacaacaaaaaaccacuuaucccucuggagcuucccaggaaacaagagaagaccaaauauauguuucacaauaucacagacucacauacucggaacagccgaauauuccucaggagcaagacaaauuucgcuccucggucacaagccuggcauuccguucucacauagauaagacccacgacuggucuucagugguuuuaggugaggcagagauccauggucauaccaagaaaaaacaaguuaaagccuccggacuacaaacagcaagugccagcacuucccaaaaucacaagaacuugaccaagguggcagacaccagaggccuagaguauaaaucagagcacacaacaggcuccuacaggcuacggagagggaagcagaguuuaucacaagaaggaauuuucuaguacccuaacagcaauacaagcuagcacuguucaaaguaugucacaugccuggacucaacuuucuccuugugccaaaucuauaugacaaagaucacuucuauagaugagcaaucagaacuccuuucucaaguuuacagucccugggauguaaguaaaggcgccugggcucugagccugucucauugacagcuaccucagucugccuugcugugugaagaauucaguugcaugguugaaugcugcugaaugacacagugacacaagacuauaaucccagcacuugggagcuauaggcaagaggguuagaaggucaaggccagccucaucuauacaguaagccugaggcuaaucuguacuacaugaaaccuggucuucacugaauugcauuccaucuaaaagaggcuggucaagggaucuuagcuauuucuuaucgcucuguaucuuucaaaguuucuccaaugacacgggauaauguuacagacacaaauucggggagacaggaggguucuggucccaggaagcagugacagauucuaccacucaagcauccauacugagacugaacauagcucauacagcacuaguuagucacauggggccuuggcagucccagccaguuguagagacuucuuacaggacacuggucaguagggucuccucauucccucuugcugacuguuuccuccacugugacagucaucauuacacuuucuucaugggcagcugugaggacuaaacucaguagcaaauguaucuuucuucuccuuuccuuaacuccugccuguaagcagcacacaauuuaagcucuggcuagcuucucacaugcuuaguuagguuggaagcaccaaggaugucucgggccucaagcacagaaggauggauuggaaugagagaaauggcuaugaauccuagaaaugcaucaugagcauuuucugagugucauuuagagacuggagaaaggaaccagggacacaauuaagggucaguucacaccuaggcuuagcaaggcuuugcaaagccaagcuaacagauucccaucuuccugcccauccuccacugaccgguagguggcagcauaggccaugaaaucuguuagauguguaggugaguuguccggaaaagggauuaccugagagaccuucgacagagggagggagaggggaagggaaagagagagggaggguggcgagggugugagcagcacucacacuauagauaaggaaaaaguccaaaguagggcugaagaagagccugggcuccuaguccuugccauuucuugaacaauccccuaaagcccaagguaagcucccucaggacggacacacacacacacacacacacauaccaggggaagggcaccaugaggcacagcaucaaugggcacucacugugggcggccgcaaugggcuugucguccuccucgcugucuggcccagagcaccauucguccccacuguacggcugcuuccgcuccagcacacaccuccguuuacuccggggugccaccucugcccaggcaggauacaggcaggcagaguaagaaaguauggcaauguggccuaguccuuccacaugcagaggcccucccagaccauucuccagagugccccacccgaaagggcacugcccagaccacggugggcacuuugccaguccuugguccccaccacaccaccauuuguuucugauuucuuuuucuaacccuggcugccugucuccccuccccccccacccagcacagcauagucccaaccacaacugguucuaauuagggcugggggggggggggcagggaggagccacugugacucuuccaggccccagugccuguucccaaaaggcucccaccagccaggacaucaggaagcuuuagggaugauguggguaggggguggaucuucaccccagacaccucccucuucaaugugggggcuacaggaguauuaucacucugcugucaggcccuucucugagugccacucuagccagccccgcucuggaaugaacugguugacugauggguagacguaagagaaaguuacuacaaacaauacauguuggguggcaacacaaggaugagacucgaguaagggcuggucucugagcaguuugggucucgcucacucggggcuguagaugauguugaagucuagaggugagggaauacaguauacaguaccuuuggccucugaaucgagggauggagucccagcuucccgcugcucuccagaguccacagacacacuccucucgcgcuucaccuugcccuugagugagcugaaaggagacacuccugccuggggguucuucagacuugaguugcuaggugagaucugguuggccuuggccccauggcuccccgcccccacgcccuuggagcccagguugcagguggguccuugguucacauucuggugcugggauugggccccuccauucccugucuugccaugauuggucaguuuauuuucugggugcauuggcuuggcuggggcaggggggcaguggccccgaggggacagcgguggacucccuggagccucucuccuccuggggugggguaaccuggggaaagggaggagaaacaggaaagauuaauccugcaaggcaucaggcaugccuggacuuuagcucucuccuaacaaugcaggggguggugaggugcuaucuggagaccaccugcuauucccuaccucugugcaguuccucagauaagagcagagcucuguccaccugggggaguggcgauggaacaguguuccuuaucuucuaggcucaacucaaauggaaacccugggcuuugacuuggcagaaucuaucuaccuucagccccaggauccagcgcuuccacuaaagcccuuucucccuagcaucugauggauucuucgcaccuucuaggguuuaagacuccuuuccaaggccccagaccucaacuacgcugugcccugacaacuagcugagaagggccacaggaccugugagucacugcucaagcccgagcccuauucccuaggguacuagggaaagcauaaccgagagugguacccacagguccagaagacuccccagagccuaaguggggaaggccugaagagggugggccaguaggcccugucagcaggcagggauugggggggggggcaugucaagcagacaagaguacagcuugaagccauggauuccugcagccuaggcugcgggcccuuuaagcuccagcccgcuccccccaccgccucccccuccccggagaccuauuaauagccgcuggaaagaucacaucacgggagaggauauuuauccccccucauuccacaccagcucagauuuauuucagcucugcuguccugcugccgccgccuggcccugucugcccgcuucuccuggggaggagggaggcaggcaccacccccacuccagcuccuacccccgacuagacugaggcuggagggcgccaucacacccccaacacuaggguaggaugagggucuguucuaacgguuuuagaagggaagaagggaccagaagcaggcaaagcuagcugccagucuccucugcccccugggcccaggcgcuaaggcuggcugccagcuccugccuggggccagacuuuaccaugcuacuucccuucaacccacugguggccaggaaaccaggugcccgaagggcuccucuccaaacagcuuggccccaucaucaugggcccuucccuuccccacucuccauacacacauauaucccacccuccgugacacccacacaccuugucuuguuagccaggauccucauggcucccacacacaguggggcuacgaccccugugcgugcccagggcccagccagguacucgguacuggagcagggacugcagcaacaagccccaaagagaaaacuugugacuuagggagggggugugugaaggggagggaaagggagaacccaacgccccgggacuaaggaacuggauaggguaggauaggauuggagagagaggacuucucaauccuaaagaccaguccaguccccaucccuuccacaccuuguccacggggagcuugcaguaucgugcaagccccccacccuaggcaccccccuccaagggcuguagagucagaauucacuaauaggcuuggucgcaaaagugacgcguggggcggcugcgaggucugcucuggcccacugggggacucccgcuccgagacacgccccucgcccaggauucgggaaucccucacgccccgccccagcacugcgcccuguccccgggcgcugcagccucccaggggccggggugggcgcacugcccugccccgcccccagcuccaggccuagcccgugcccaucccggcaggcccgggcgggcagcgagaggccuggcggggccccgaggcugcagcugggcucuuuuggagaccaguaacgcuggcucagauuccuccccgaccgcaagaaugcaggagccuccccuccccccucccuugcacccccccuaccccgcccccuucggcaaagcccgaguguagagacagagcgagcuuggagcaagagagccagcgaggcagcgagcgagguugagggaagcggacaggacugcagcguggaucucccggguccacuggagggcgcgcagacagacacauggacaaguccuccagggacuaaaagggcgcuagccgguugggcagacugggcgcacagagcugggacuuaagagacccacaagcaccucucugugacucacacgcacacuuacaucucacacguggacagggagacaaagacacgcacggagcccaggaaacuagagacgcucacggccagccgacggaggugugcccgagggacugggcagcgcgaaccagccggagucgccgggcagccuggggcacacagauaccccggccacccagcagagggauagccgguggacucauugaacagaugugaagacugagacccagacacaagggagccauagaaaguugagcccgacagucacaaagaauacacagagggccacagagacaccaacaagcugacuuacacaaacacagacaccucaagcaaccgcccccugcucuguccccuuuccccgcccccagcagagaucccgguagaaggugggggagggaaggggaggagucuugagcccuagaggcucuucccgcgacagguccagcuagacacacccguguacacuccagcucccggcucagcugcuggaagccgggcuggaaccuccaagcaagggggaaaccucccagguacuuugcagccgucuaaccccuauagaacacugggcuuccccacuccaacucugucucugaaaaagaucccaaaguccuaggaccuaguuugcagcacacacacacacacacacacacacacacacacacacacaccacaaccaggaaagaacagaaaggcagaagucacugaggaguccuggggaaaucaccuuggucaauagaggaccugcuguuuaaguucucaccuccaucccugguugauucucaaagcuaucuccccagucucacaaggaggaacugagguuccagaaaagcugugugcucuugggucacaugacagcaugggcgacccaggacccccacuccagguacuuugggccccugacuauucaucucagucuaaaucaagucagugggcuuuucacacaugagcccccagaacuuaucaccuguuaugagggauggggacgggcuaucuagaacuuucuguugagggaucucaaaaacuggaacccuaaucuuggcauagugacucacugcuguaacccucgcccuuggggggcuaaggcaggagaucacaaauuuaagcccaaccugugaguuccaggauggcuuaaacuaccuagcaagauuucaaaaccuucccccaauaagcuacgggugggagggggagggccacuacuauaacaauccagggaggggcuguuaggaaacugguccucuucaguaguuccagcgaaucugaaaagugcccccuaggacuccgccuccugcucccacccagcugcaaggcgagcugagguaaggacagaugagucagggcuuucccauccagcaucucucugucugcccuucaggacuuggccccagcucccagagaccccucuuccucucugcucggucccagaugacaccugaaaucuguagccuugagaagccaaugguuggcagggaaaugcuuuagcacugaaccagcaaguugccucccuagcaccgggagccccuggagauguggugugugugagauguggcgugucgggggaggcuggacuuuggggacgccacacuggcgaagggugacauaagcucacaaacagggagcaggugcaagucaccugagugaaagaaaggccagaagcaaacccaggagcuugugccuggggcaaagcugccgcugagacaaagaagccagacccaggccuggugggcagaggucuaugaucccagcccuugggcggcugagauaggacccaggccagcuuugggaugcuuguugagcuucugaaacaaaaagccugaagcggggucacuggccuccacuguguuaaaauaaggguaggccccaggugaaggguuagggagagcaaucccaggaggaggggggagacaaggaaggccauggccagagccuucggguguuuugugucagcccuguucaacacaacuguuccccaguugggcaagcauccacauacccaugcaaucugcccgucuccaggcugcgagccugcuugaccagcccagacaucccacuagucucccaaccgucucgggggaagccaggaacuguggcucagcccuagagucucagcgcucaggaagcugaggcaggaagaugucuguggauucaagaucagcccaagcuacacagugcguuccagaagauucuuuguacaaaauaaauucuuauuuaugcuugugguggcuuacaccuucaacccgaucaacuccggagguaaaaugaggcuggcuuucucauuuguaggcuaucccaggcuacauaccagauuccgggccaucuaggucuguguagugagaugcuaucacacacacacacacacacacacacacacacacgcagauguacacaugcaacaacuauggugacgacaacaaccaaaauacauuucacuucaaggccaaugaugucaucaguaaaauaaauacuucaucggagaaccuaugcacuaugucugcgaggccagggaaaccccgggaacagugagaaaugcuugggugggccaugucccucacgugcagugagcagagacaucuagagaaaaaaaaugugggauucauagggagcagguucugggccgagggagauucaguucccaagacaaugucccaaguccccuuucuccugguguccccuggaucucagaagcuuccuuguagcacucagauaaguuucccugagguggugacucagcuaggagguuggggauucagaaccuagcucaaagagaggacccaagguguuauuuuaguggggacccucuagguggggacuuccaggcuuggggguggggugggguccugccccccuuccuagcuacaacuccccucccaggaguccaugcaaauaaaccaguuuugcuuaggaggcuucaccugggaguuuccagccugccccaccuauagccccaggguaaggucauacaauccuaacccugcaggaccgucaagucugcugauccuagaccuuugcaaugcaggaucuuuaaacagaaugccugugggagauuaguucuacucuugcuggaccacugucccucuggagccuguggggacaaauggccuugccaggacaggccuaaguucaccucacuucuuuuggcucuuucagccauuaccagugaguccagaccucaggaaguaaucaugcccuggcaguagggugcccccaaaagacugaugcccaaucccuaguuacucccucccccuagggagagggguggggaggggggagagcacuaggaaacaagacagggcaggaagcccaggcaggcagcgggcacucugggccaggcacaaacagccaacacaggaaaccacagcccacccccgcccaccccacccgcccaaggcucugggagagaggagugccuaguacccugacugaggcccgggccagggguuagcccagggcaaaugaggugcucaaaggccucuaggccucucuaggccucagaccccaccuggggagggggaaggaagccaagcuggcagagaugggcugccucuuuaaauccaccgaaauccugagcugggcccaacccagcucugguuucacaggaaggaaaggagugcagaagccagcggagccaacggugguggcuggaauuagccccaccgcccagauauaucuggacugcacugccacccuacuggcacuuccugcccccuggcaccuguacuagagugggggcaggggagggucuaggugcuaccucuuccugaugggugaccccagugucaggagguggccugcugcuguaugcacguggguaaggaaugacaccucaagcuucccuucaacaggggaaaacugagccagguagcuuccugggaccuucaccugguccgagucucccaagggguuaaucuggccccuauuuagggggggcaugggugaccgaggaaccuccuccaaacugccuggcuacuggaaacaauggggccauugugggaggaguggagugcgggcaggcuacuggcacagccagcgcaccacgggugggaccucgcccagagacugccugccacacucugcucucucccccagguacugccagaggcagacacauccuccaucccuugccuugccggccuggcccaagcucuuggcaccggcagcaccugaguagccacgagcuccucugucuacguugacaugcagacagccaugacccuccaggaagcaggggcuugugggccagggcuaguggggguggggugaugagacaggaugugugccugugaucuccugcagggcagacaggaaggccaaacuggguuucuagugucaguccuggcacccucgggcaagaaggacuuacaggaccuacaggacagugaaagcagugacaagcaggguccccugcucuaaggccuccuuucucacauccacuccauaaacuuucccgugacaaguucuguugccuacaguagccuugaccaugcauccuggcaugcaugggguuacaaaagaauaaucuguaguugggcagggcgagugccagucccauggagccucuucuaaacugcugaaccuuguccaccucuucaucccucugagccucgguucccucacaggcaaaaucacaaagugaggucauuaccagaaacuaccuaaaaaugucuacgacacauuagcccucaaccaaaucccuugggcacccucucuuuccugacauaguucccaagaacgcggcaugucaggaaggugcauuuguaaugagaagaaccaucuagagaguugccuugugaguauucaggcaagcagggcuuaugggcaucauccccgugcagagaaggcauggcuuucucugcacucugugaagaagcuuguucacucuacuaacaggcauccauccuugagcaccccugagcucucugagggucuccgacccagaauguguggaugcagagagcagccaucugaagcucccucagccucaggucuuacccagggggguaagugaaggauacuucucuuucagugaucugcagcccucccccagucugaccccuuugggaaacacaugcaguguggagccaugguacucucuaaagagaaggucuuagauagaaagggcagcugauacacagaacuagaggggaagccugaggacgaagcccugcucuuuucucaaccagaaagggcaauaccucucaggguggccccacagagccccaaaggguuaauaagguccuaaaaauaacccuguucccagcaggacccacugaucagaacccucuagccaucugucccugcuuucuccuguucacguuggaacaucugaaaccggccccagagccccagcccaaucccaaaaauagccccagccugcccaaggaacaggcaggcccagaggcugggcacaggaggcacggccagcuuaacagcuaagcaccauggugcaggcacaugagcucucgugagcucucucgccucccgagcccauagaaaagaggaaguucucucugucccaggagguggugggcagcacagcuucagccucuagcccauccccccuaggccaagacaauggaagguaccugguagcccagcccaggccucagacccaggacccuguuacuccguaauccacagaagauccuaaugaccugccgacauagauucuuccuucuuguaggcaacccggcccuaccaucuaccucguggucccucacccagaaguucccgcacuccaucccuacgaucccaguccuagcucaggaccuuugugagucccaguggcucacauggaccccugcccugagacacacuggacuuucuucaacgcucgcucgcucguagguagggaaggauuccagggguaccccacuggaucccaggggugcugacaugcugggugugcuuagcucaucucucaggcacugcccuuccauagccagaaaauguucaagacgguacccuacgaccugaagcaggugugaccacuaccaucgcccucacagccccacacugccuauuucuucccaaggaaggccccugacuccuagaccaggaaggccauuggagccauuugaggacaguuuccucuggucuggugacagaacagagcagggggcaguguuagaaggaugguggaaggcuccaaaacuaagucaagcaagcagaugggggacggcguugggggggggggggggcagaaaugaagggcaaggacaaaggaauggggggcggguccuuggaaacucaaguccuucucuagguccagggcaacuacaaaacuugcaaucacaguaucgaucagcaccaacaguggggaaacugaggcaacaagguuugucuugucagcugugguaccucaugacuuaaucccaaaacaaggaggcaagcaaagcucugugaguucaaggccagccuggucugccucaaaauacaacagcaaggugauucuggaagggcauuagagucugaagaccuggauggguucuuacuccaagcccuaaacucucuaccuuaggccaaugccccaggauaaaccuccugcgaggagcucagauuaacaauaaagccaagcaccucucaugucugccgaaccccugcaagcucacuguauguuucaccuacucuaaccuucagaacgacuauaagaaguugggugucuuuuuuuuuuuuuguccccuggucccgggauggaauccggggucuugagucugcuaggcaaacuacaucacuaccuaaaaguuuucuucccgagacaggcucucccugugaagacgaggcuggccucgagugugcagcagucuuccugccucagcccaggggucuaaggaagcgcgaagaugcucagcuuuuucagggucuccuuuuucagggagucuuccaguucacugugcagcuaagaauguccuuggacuccuugaucuuccuguuucuaccuucagggagccggguuccaggcacgugccuccaugccugcuuuauggccagccugcuuuacggccagcuccugucauccgaagcuggaacguggaguuccgugcaugaaagcaagcauucuaucaaccgaagcacagcccuagggauagccuuuucuuauuuuuugagauaagagccuguuguguuucuuaggcuggccuugaacuccugagggcggggugccucccucagccacuaaaacaguuggaacuacaggcaggcuccugccaccacagccagccuuagaaaagacuuuauuuugauagucuagggguguuugggguuugcugguuugucugucuauuugcgacuggauauuauuacucugugauccagaaugaccucagaccugacggggacccuccugccucuucucaguugcuggaauucccaugccuagccuagaaagcccuuuuauuacucccucuuugcaaguuaagaagaguuaaguagcuugcccaaaauucaucuagcccaccaucgcaagaccgggacuggaagcucaacacgccagcaccggguucuuagccacugcccuaugcaguggcagcaaggugucagccccucacgggggucaggccuggccuucauccaugcacccuuccacccuccuucuaggccugauggacaccgggcccugcacuaaaggccacaccguuccugccuggggaaaagaucaaagagagcccugaacccuguggccucucuacaggugcccugcugagccaggccugagaucucaaagagcaaaguucuagggcccagcuagcuccacccacccccaguccguuaccuccucgccuacccaggucccuaacaugguccccaagacagguuucuagugcucuagcacagucuucugcugcaaugcccagggcuaggaggaguccugguggccucccuccaagccccaggugggagucaaaggucaaguggggcuuuccagagaaggcaggagccugagcccugcggucggcccaccugucccuccucuuccuacuuuuuuuuuuuuucacuaccagaguuagaagcaggagagcuuccucugggaagauaguggccuccaacagggaaaguugggggguugggggguuggaggauuagauggaggagcuagaagcuccuccucccaaggaccguccaggaaaaagaggcaccuccccccuucccuuccucaggcuugcccaagucagacaggagccugcaggacugcaggaguguuuguugugaauguagaguuguugcuaaguaaggagagagggaggagggaagcugugugcuugccucuguguguguguguguguguguguguguguguguguguguguguaugugugugugcgcgcgcgcucgcgcgcgugugcauguguggugaguguguacacgccuguagagccagggcagcagaaaccaaacuuaaggugguggcugguggccaguggcaccggccagugggcacccuggauuugacucaaccucuagaagucaaagccaaggaaggaggacgaguaauugagacagccauaaaaaaucuaccuccucgcccuccagguagacacaguucugagucucccaccucccaccaggagaagaggcuuagaauuugcaguggccaccagcuuuaacccuuuccuguccgggguaagcgugagcgcgcucucgagcacacgcacaugcgcgcaugcgcgcacacacacacacacacacacacacacacacacacacacacacacacacaccagcaguauugcccacccagagacagaggagaaugcaaguaggggcagaaagccaggaggcgggagcugacagaaagcgccaagcgggauggugcggccacugcagacaggauggggaggccaaaauagcagcacaaaacacacgggcccgcucaccucugaggaaugugugucagguucaggcucagggguguggucugggaugggggcucccuguggagaaauggucacagcuaaaagucccuggccagcgaucugugccccugauccucccccagaagcccaacccccagcccccuccccagcccccuccccagccccaaaccuguacaauuuacagauagccuacagcucuaggaagucucagagcugcucagacacagacacacagacacacagacacacagacacacacacacacacacacucgugcacguggacuucuguggacuggccaggagccaggccugaccccgcugcccaccacaccaccccccuucccuguccuggaagcaggaaggagaaggcacugggagggagaccucagacuuaguucccugagagccuggccccacagagagagggaggguggaggacucccacgaccuggccugagguccuggggggaggggcagcugaagcccagagacccagcuucagaaccagucagucauccccaggucagcuuguggcaaggguaaggauuuaaguuccuguguaccuauguggucuccuuggcuauaacacccugguccccuaaagacaacgaguccugggcaccuggucuccguaccagggccuggggcaaagaagguuuagcaguuuaguagcacugggugaagcucccacagcaggagggagggaggcugguggcugggcucaguuuguacugggggucaaaggggaguucuuuuccgaagaauucugggagagacgccaacuagagcaagcugcuaaccaccccuccucccucucucuugcugcacugggggggggggggugucccugccaaccagacuuaacccucugcagccuguguugcucuuggcucaagauggggcuguuagaagggggcccugacugcacccaacuuccagagacaggagacagaaagcacaacgugcccccgcccaaaaaaggcugucucccuuaugauuccaagcacaccgcccuacccuaccaccaccuaggugacuuuucuagacucaacucccagaggugucugcagugacgugcccgugugcaugucucagagacagagauugagaaacaaacugaaaauuccuugccaaggcccuccuccugcugggucacugagcccuguaccaacaggggccuguacuacuccuuucuucccacuguacuggggaccaaaggaaacgucggggaaagaagccuagccuaggcccaccuccagagggagggaggucuccaccggccccucacucacagcaacacccccugcccaucuuccuccucucugaccucugcauguacuugcagaaaagcauucaguuacugccuaagauccuaagauagaaagcugaguccuagcacggacucugagcaucccaguguauauggccaaccagcuuaaacauacuaccaaugcuuaggcuuuagccagaguaaacaaaaaccaaaacacucauggcugccucucaccccagugcagaaccucacugguaguaggaaggaaucgagggagacaucaguaagacuucccuggaccagggcugcaaugguccaucccagacgccugcauuccaggcaccucugccuuuugcuugggauuagauuuugagcuuguucuguuaagcaacuaacuguaaguggagaagucaaguuuucugaaccugaaacucaccaccacacuccuagguaaauugugaccgacuguuccuggucuccagugaaggaggugacugcagaggugaaaggaacaugucccuuuagucccuaugcucccucuaucagccaucacuacacccucaggacacaggcuugccuggugccgcugagcauacaaggccagagaaagagaggaccaggcccuggcaacagcuuaucuaggcgucuccccaacuccaccacucuuucuccaaggccucagagcugccaggagcuugggccucacuccaggaaaccuccuaucaaagggcagaggacuccacgucccagggagcugcagaccugugacuacaccccccagacacguucccaggguggaggaggaggcggaacagaugcaaagcaaacguaagcacacaucagagacacaccuccagccuccagcgcacuccucagaaagaacccccccacccccagacacacacaagugagaggcaagcagacacacuuucaagguaccuccuuaaauagcccaaacuuuccuucagacccacgagaguggcaaauucagaggcaaccaaaagaaugcucaggaaacugccagccaucauuagccagucacacagaaaucugacacagacacacccacuccgggacacacgcagagccaccgcauacauaguaguacgguuuguauccaugugcaagcacacacacucagauggauuaccucaagugcagcccagcgaaaagucagauuggaagacagugagcugugagugaggaggggagucagagggggcggcggggaagcacucaggauuucaaaacaauccugguuucgaaacgcuggaaaugcuggauucagggccauuccugaagcuugggggagggaggggggggguggacacagaacaauguggagcuaccaggacaaggaggaagaaagggccagacagaggugguucagccaguggagaaggggacccggaaagggcuaccaacuuaggaggagcagcuggccuagaaccaagaagggagggcccugccugcuggacgcaggcaaaggaaaggucuccaguggcuuuugccacugacaggagacgugcggaggcaaagggagccuccacucccuucaagacugaaaguuagaagccaccacaccccuuaccuacacacagaacaaggugagcaucccuguucuccggaagauggccucggcucugguucccuagcuaguaagagucaugagacagugaggggcaaauguccccacauucaggacuggcuaagggaacauguccccuagaagucuucaugagcaaucaccucaguuuccccccaaguaccccacacccaggaagucaccuuucccugguagccagaauguucucacugccccuccuccaaccuccagggaaaguagacagagggagggagggagagagggagggagggggaaggagggagggaggggaggucaggccaggcugggggguggggcuuuggaggccuggcccuggcacccggcaggaaauuccaggccauaacuccaggcugccuucagggccacccauccaagugacaagcugcaaguagcucuucaugacuagggccaucuccacgucccccucagcuccugguccugaccaccccacccggcccuccagcuccagcucuggaacucagagguccagacuugggaaaauuuaguaaucccuggaagagaugcccaguccuggaaggagcccuacuaagcuccuuggacuaaccugagccucucugcucggaucccuaggggcaguguacacaguguggcuaugggugggcagcugaugccaagcuauggcagccaggcguucaacagguugagucagucccuggaagagaugcccaguccuggaagaaguccuacuaagcuccuuggacuaaccugagccucucugcuuggaucccuaggggcaguguacacaguguggcuaugggugggcagcuguuggggcuggcaagcaggggcacagaugccaagcuacggcagccaggcguucaacagguugagccagucccuggaacagccagccccaccccagggagagcgggccuggcagaggcucccugccuggggcacccagccuguaccgcuuugcucccacgucugcccacuuucccacggugccaucccccucuauccccuccccccaccaggucagcacccgggcagugcccagggccuugguacaaggaagcaagggaugccaugucccuguuauccuugggugcccgggcuguucagguaccucacuaucagcaauggagacgcucagggaaaguaaacauugcaucggggcugcaucaguacccuacccccaccuccuaccggcucccuuugaucccgggaagacuggacacagacacucuggcucccuagagcugccccagagcucugggacaaaaccucagccugaggcagcgccagaggcagggugagggugcccucagccacucaucuaagguucccuggaggagagaggcugcagggugacuuuugaccccccccuacuuacuccaaagcuucugcugccugcaacucugguggcgccugcaccuccagcucacuccaggacuccgugguggaauacaguccuagcugcuucccccgccucaagcaggcacccccacuucguaacacauuucuuuucacguaaagcaggugccaggcauucuggcccuugcugaguggacacugccucucugccacccacuaggucucuguccagcaggcuccuggccucccugguuguugaagcugaacccaccagccuaaggcuucugcugaauccagguaccaggaacuugcaagccagaguugugagugcucuguguacuuugaacaagcgagcucacuaagcuucaauuagcauggaugcuuuaaccccagauuucugugaaccaccagcccuucuuuagucuucacucuucccuucaugaaccccuccaccuuaucccaaguaugagugacauggcuuagaaaagaaacucuggcagggaugccugcagccagaaccauagucuuuugaggccaagauagguagaucacuugagauugcuuuccuuccugguaccagaguucugcuugccuuccugcgucucaccuuccucggccauucucacccuauccugaggcucccaacuguggggccugagcugacuuggagcacucuucucuucccuuggagccaugagaucauggucuuggcccgagaaggcagccaaguucaugggggggugggggacggggaacagcagaggaacuguccuagggaagagucugaccccuggagaggcugaggagucagggagaaggaaguauagagacauuggcauugguggugguguagcagcuauaauacagacagcauucccaggggaaacagaacaccacgcaguuccgugggagggagagagguggagcagaagaucaaggggggcugcagacccucacacacaccuuucccagggcucaggcaaacaccaaguccccuccuagcucagaaaugacacucuuucuccuaaagcagagguucccccagacaugacaugaacacacacacacacacacacacaccaagcagcagacagaacagaaggaggagggaggaagguagugucagaaaaacccggaaggaaggaagcuggacagacagacagacagaagcuaauccuugcuccaaagagacacucuugacucccagacuuugagggacguucuauuucucugccuccaaaggaggggcugcgggggaccuccggauccucugaaaccaaauuccagcagcccucggaguaggaccauacuccagcagcccucggaguaggaccauacuccagcuaugcagaaggccuaagucuuacuucucuucauaucucccucccagugaucaagccaggagccaccuuuccauggcagugcagagaaaccuccaaggaacuguaugacugccccacccccagccaagcccacaccacucagaauccuuggcaagggaggcuccucaggcuccuauggcucagaggcagugccugggggcagaugacccaaccucucacuccagucccaacccuccuccccaggaggcucccacgaaucaggggaggagugcaagggugcuugguccuaagaguuagugagucugagaaggggacuacaucucccagaagcccccagggcagaguucccugcuccagcuggcccaaggccggccuuguucucugcgcuaaggugguagggucuccuggcugccacuaagcccuucuuauagugcuccgagagugccagcucggcugaggaccuaagaauauccucugaugacccuagaggagucccccgcuuccuaaacagccuggggugcgagcuagaacgcaagagacaaucagacugcgcuuccccuccccaauuuaaacuggaucucgcuuggcgcgcaccagcuggccuggcaugacuuuagcccucugccccaaaccaacccucaccucgcaccgcucggggguccucacgccaggccggagcuggacgccauaaccaggucaggguccuuggguggacugggauccuccagcaggacgguggagacgcggagaaggcaggcaggcgguggucuuuuugauccuggacgccuugaucuuaauaccagcccggcccgcgagcagguauccgggaggcgcugguugccuggguuccugccucccaaccgcggagcaugguccugggcaccggcagcagcgggagagcuagcgcaccgccgugccggggcuccgggcuggggucucggcccaaaccucucggcuccggcugcugccgcuccugcuccuccuccucccuuccuuccuuccuuccuuccuucgccuccuccuuucacuuuccccgaggcccgcggggacggcgggcgcggggcggggagggggcugucuaggcgcuuauuguuggucggaugccgaggguccagaucgcagcccccgggcggcgcggcgccaggggacccaggcgugcgggcguccggccggcuggcuccgggcggcggcggugcugcagcggccccggauccggggcauguccggccacuggcuccgccgcgcgccgccgccuccccgggauccccugcgcugccggagccuagcucgccccuccacuccgcuccucuccccagccugaauaagcaucggggcucucuggcugccuccuucugccuucauaccagagccgggagaggccccugucaaaauaagagcucccccaucucgcccgacuccucgcccaacccggcucccccagccucccaguggucugacucg

SEQ ID NO: 5058 - RNA, 33691 nt, Mus musculus
agcucagcccggcggcggcgacaucgggggcgccggcacagcgggcgccggccgagguagugcgggguggcggcggcggcggcggcggcgagcugcgcgggcagcgagcgucgcggcgggggcggggcggggcggcgggcgucgcggcgaggggccgggugggggcgggcggagguuuccgaggaggaaggagccgccgccauuuugggagcuucgagucaacaauaaaggaccgagggugcggagcgggaguggccucggugguaggacucgggcccgagccgcggggcguggggugaggcggcguggucggggucggcaggauccugaggguaucagggagcccccuucgggcagaagcccgaggcccaggccuggcccgggaggacgggcggguggccgcugagaagagcgggggcggcggagaggaguggaaccgaggaauguggcgugugcgggguauggaggaggagcggcggggagcucuggacgagcggugcgguagacgggagcggggacggaacaccggccgggacacccgagugagguugggagugcgaggcagggcagcccugcgggggguggcagggcugugcuggccggggacucggcugggagaggagccgcggcugcucgcuugcaaguaggccuugcagguugguggggacagaggguuugggggagacucggcggcguaagaggggaggagaggcgguccaguuucgggguucucuuccgggccuucugaggggggggagucccuauuguuucccacucgcagagcugguuccggcucuuguggcgcagauaggauugcagggcagaaacccuuuugcuuuuugauccgagggagcuggguuugaagcgagggaaguugggggagggggcgaggaauuauugccuuacgguuaccggacuccgauucuuggcuuaggguuuucccuucgccauagccccccuuuaccuucguaagaaccccaaucacuccuacuuccuguugaggcguauagaaaucgcccuguauuugcaaacaaaagcccuuguuggagcuuaugggacuguuuuaggugugaaaacugucaauugcuaaccacggucugggcccugcuguaauuaacucugccaggggcuccucccaacuaagucuuauguuccuucgugguuuuguuuuaggaauauaacuugcaaaucuaaauugggaagggguaggacgaaaaauuucccacugagccauaaagcugcagugcagguauccguuucuggagggagcaguuaucgaagucucuggguuuaaggcgcuaggagguuuuacugugcuugauugacaguacugauggugucgguuaggauucagagguugcccccuucauccucuuagugcuguacaaacaguaagccuuccuguuugacggaccugauacuguugaucguaugcugucaauacagaaaauaccuauugagauaacaaauaaacaauuuaaugugauagaagcauuugugagcaaguugauguauuuaacuugagauaucuuuugacuucuaaauuauggauuugggauacuugguuugaggcaaagauaaccaguacuaauuaagcuaguguuucgggugccagugaaauguaaggggguuacaaaauaaaacugaaggaguuggacuuauacuuacaaguccuuaguaauauuuuauuuaccaaauuuugagaauuccauuuggggaacaauuuaaaguagaggagguugaccaacucuuucuuaaaauaacuguuaauuagacgcuguauucuaggugauuugggagaauuuuauuaaaccuguaaguuuaacucucugguauuucuuucccccuuaacuacaggacuccccgcccccaccuuugaacuuuauuuugaaaaguguuguauuaaaaggcagcacuaacagcuuucaacuuuuuuuuugaaaagucuucucguuuuaagguuuuugguuucugucagaaauagaaaaaaaguuaauaacuugucuuggucaaaucuagauguacauuaaguaaauugagugauauuucaagucuuaaugcaauuaaacguaaugacuuuuaaagguggcaggacuucgaauucaucaggggcgauuggagaacagauuguuauuugagagugaauuugaauuuuaucaauaguaucuuucugccucacuuucucuaaguuucuuugaucuuggaauuuuaaauguuugagguuagauuuuuuuuuuuuuuuuuuuuuuuuuuuguagauuggguuuuuuaaggcaguucuucgaugugucuuucuuaucucaaguagugauuuggccugaguguggcuguuagugguucucuagaaggugagcauucuaaaggagcucuuuaaaagggaacaauuuucccccaacuuuguugucugcuaauuuaauuuuuucuuuguuucagauugaagugagugaauucagauauaauucaagcuuguuagagggcuuuaaaaaaaaaaguugauucggugcaugaaagcaaguuaacuacugcugcucaccguugagagacuuacaggugcuugccugaacugcaauaaaggacucauauuauugagcaggacuuauuuaucucuucauuuuggagagccucauaaacuguuauuacaguuucucuacugacuuugaaaaguuugaaguuuggaagagacaccugugcagcuaacaaagcaugagcacggccagaacagagaacccuguuaucaugggucuguccagucagaacggccagcugaggggcccugugaaggccagugcuggcccuggaggagggggcacacagccacagccacagcugaaccaguugaagaacaccagcacaaucaauaauggcacuccacagcaagcccagagcauggccgccacuauuaaguaaguggaagaagaccuuggggacccgcaguuucugguuauuucuguuguugacuacuuuaugccuuacauuaacuguuuugauugcaguuggaggauagaucauuuugucauggcccaguagguauuuguaaucaaguagugugugaccugccauuguaaucgacccagcaaauaaggaacauagacgucuauaaauuaguguguuaagaaauaaaugugcugguguuaguucaguguagaagguaauaccagguucugcgaauaaaauuaucccauucuguuugcuuuugagcaggcuuacuugguagccaaagcugaccuggaaccuguggcaaucuuccuguuuaaaucuacaaaguacuaagguuacaccugugagccaccaccuccgacacguuuguuuguuuguuuguuuuuugcuucuaguguuaccacugcaacuuacccugguuuucacaacaguuaaggaucacuugaaauuuugaaaaagaaauuuuacuuaaaauuuuuuuaaagguuuuaugugucuggacauuucaccuguauguguguuucuuuacuauaugcaugucugguguucauaaaggccagaagaguuuguugaagccacugagcuuauguuauaaaugauggggagucuuuuagugggugcugggaauugaaccugggccagcguucuuaaccaauaaaccauuucuccagccuucccuguaaaggaaaguguaaagauucaaacguuaagacaggcucuccaggcugugguggugcgugcccugguuuccagucucagggaggcagaggcagguggauccaggacagccaaggcuacacagagaaacccugucugaacuuuauuuccuucuaccccaagacagacagaggcucuuuuuuuuuuuuuuucuuuuuuuuuuuuuuuuuuuuuuuuuuuuuuguuuuuuuguuuuuugagacaggguuucagggcuucucuguguaguccucuguauaccaggcuggccuugaacucacagagauuggacucccugguguuggacuaaaggugugccuuaggggcucauuuuguaacccuggcugcuggccuggaacuagguguguaaagcaggcuggcuuugaacuucuuuguggcuaagaauggucucagacuuuugaguacuagaauauagguauauaccacucacuauacccacuuaacaagccuucugagcuccaaggauacucacucacacuucacccauaccuuguuuuguuuauagaauugacuuuucagccagguguggugacuaggauuggaagauugccuggaguuauacaguguguauaaggccuagaauguuuuacauaguaaggcauuaugucagcccaguccuucugccaagaaaauguuucuccucugaggauauauacaaaaucauagaaauuuagaauuuugaauucuugggaaugugguuuuuuauuugaggaagucuuaaauauguuagacuuaaaauucuagagcugucaucuuauuguauuuggguguuuuacuuguucauuuuguuuguuuuugagauaaggucuugcuaugaagaaguucagcuuagccuugagcugugugacccaaacuggccuuaaacuugugauccauuuaucucgagaccucucagguggugagauuuguagccuuaucucacaacagaauauuuuuuaaagcagaauuuguagguuaccaucuuuaagugcuuggguauuaguggcccgugucuucaaucacagcacuggggagguagaggcagguggaucucuguuggaggacacucaaggugacacagagaaacucaaaaagaaagaaacuguugccaggcugugguggcccaugccuuuaaacccaacacuugggaagcagaggcagguagauuucugaguacagccuggucuagggcuacacagagaaacccugucucaaaaaaaaaaaaaaaaaaaagauagaaaaugucacucuaaagauugauuuauaaagaauuaacaucaaaaacuuuacccccauggaaguugggcuucuauuaaaaauaaagacuuucauaaaaugauuuagcauuuaccaaucuuguuauuuguuuuuuuuuuuuuuuuuagauggggucuuuguagcacuccccugguugaauguugggauuauaggugugugucgucauucugaguuugagcugcauuagaguuuuguaaccuggacuuuucuaggcaaaacuugucuucccugggugcuagaauguauagauuauugcuaugccauuuaguauuaaucucuaagaguucccacuuuuuuguuguuaauguuuugagacaggaccaacacacuauuaauccuggcuaaccuggaaccauccauauaugaagaccagguuggucuuagccuaccugccugccugugccucccauuugcuaguauuagaagcauagugggauugguuuuaacuaauauagaaaugaagaauacuuucuaaguuguaguuucuuuuaacacugacaaauaggcaagcaaaauuuaggcuccuuucauucccaaaggcagauauuucauuaugaaaguguuguucaguuagaauuuuugauuugagauauaguuuuucuucugggauuagugguuucuuuccaguucuguugucuuuuucugcaccuuaguguguugucucuuugaagcagucugaauuuuuucagcuguuuuagaacucaauacaucucucuauugccuauuuucucacuuagauuuuucuuuucuuuucuuuuuguuuuauuuuugaggagcgaucuuuuauugggggaggguucaucaauccuccuuggccgccgccuuccucauggcugccagcacgucgcucagcuccuccagcucucucuuggcgcagaugugcgugcccauccucuucuugaugaacuugaguacgcacuuguccuuggacacuuugagcaacuccauggcgcgccacucgcucgaagggugcggagccgcacaccucccggaucauguccacaggaacuuggcgugcuuggugaggcgcccgcgucgccggcugugugucggcuugcugauguuuuuuucucaccuuguggcccuuguugaggcccacggucaugagguagcgcagagccauggcuugcugcucuccgauggggacaggaagaguagauuuuucauuuuuaagauuuuaaugauucuggggcuggaaagguggcucagugguaaggaguacuggcugcucuuugagaggaucuggguucaauucccaacacccacauggcagcucacuacugucuguaacuccacuucaguggaucugacaccaucacauagacacaugcagacaaaacaccauugcacauaaaaauaacuguuuuuaaaaaagauauaguuggccgggcgcggugguggugcacgccuuuaaucccagcacuugggaggcagaggcaggcggauuucugaguucgaggccagccuggucuacagagugaguuccaggacagccaggacuacacagagaaacccugucucaaaaaaacaaaaaacaacaaaaaaauaaguuuaauuuguggaucaguuuuuguacuacauguuauguauuaugcauuguucaauuugacaguggcaagcuguuuuacuagguuguuaucuacucuuauuuaaauaaaagaaagaaagguaccuguguuagaauguuugcacuuuauaugcaggcucuagcuuuagauaaucaagcuucugccaaagaguuuccaggugaaaugacugagauggucuuauuuugaaucuuuuuuuuuuuuuuaaagauuuauuuaucuauuauauguaaguacauuguagcugucuucagacacuccagaagagggauucagaucucguuacggaugguugugagccaccaugugguugcugggauuugaacucuggaccuucggaagagcagucgggugcucuaaccuacugagccaucucaccagcccgagauggucuuauuuuguuaagcauaguacuaacugcuuuucaaaauuaccuuuuugcuuuuugagacaucacuucauguaaacaggacuggccucccaagaggcuguguagccaaggguaaccuucaacuucuaaaccuucuaccucccaagugcuggaauuaucugaugcgugccauugggcuaccuuuauauagauuauugaugaaauuauuagacacccaguuuguauuugagagaauagagguuugggggaguaauuggaacaacaucacagaaggaauaggaaucaaauggagaaacuucaggucuuugugugcguuuguguuuggagucaaggucuuuuuguucagaugagccuggggcuuccaggcucaggcugucuuucugccucguucucguagguagcuaagacuacagauacucuugguucuaacaagaauuguuuaguuacuguaaguuacagccuugguugacuauaggguacugcgccaaacuagaagguacuuacuguugaaagggaucaccuguugauuuuaaguucugguuacuagguagucuacuggaaacucccuaguuuguccagugaccugaguucaguuucuuagcauuaccaaaaaaaagggaaaaaaauguaguuacuaagguuuaccacacuguuacuguacuagaauuugaaacauuaugugucucccugaagugcuguggauugaauuuagcaguuuguuuguuuuuuuuaaauccagaaucugagucuuuuuuuuuuuuuuuaagauuuauuuuuuauuuauuauauacacuauagcugucuucagacacaccagagagggcaucggaucacauuacagaugguugugaguuaccauguaauugcugagaauugaacucagaaccuuucgaaaagcagucagugcucuuaaccccugagccaucucuccagccccagaaucggagucuuuacaugaaauuuagguguuaaguguuugcugcuaaaaaaaaaaaugaaaacuauauggaugaaauaaaacauguuuugacaaacacuuggcuccuccagcccuuguguuaagucuuuaucguccuuaaugauuucucaagaacacgucccugaaguugaugcccuuguuaguuguguugagugccugaguacauuaaacacuguguuagagggaugguaauaguugagauguuuccuuugcguuguuaaagaggaagcuaugaauugugauaacuucacguuuacuauguucucucuagaccuggugaugacuggaaaaagacauuaaaacucccuccaaaggaucuaagaaucaaaacuucgguaaguugggguauagauuucaaauggaagaacugaacaauuaccaguaaagaauugugugaaaugacgcugcaugugucggcuuuuguuuuauuuugagauaauaucuuauauaguccaggguuacuacacacucuagguucuccuuccauagccucauuagugcugggaguauaguuaggugugugcuaucaggcuagcacauagguuuuuauuuuuauuuuuuuauuuuuuuuagaaacauuuucuuuuacagauuuauuuauuuauuacauguaaguacacuguagcugucuucagacacuccagaagagggagucagaucucauuacgggugguugugagccaccaugugguugcugggauuugaacuuuggaccuuuggaaaagcagucaggugcucuuacccacugagccaucucaccagcccagguuuuuauuuuugagcagauaggguuucacuauuuagcugaggcucuguguauugaaauaguugaaacuguauaguuaauagauacuggguugccaaaauuuuacuaacagucuuuggugggauuacauaguagggguaacauauuaaguaaugugugugugugugcaugcauaucuugguuauuuuguuuucuuuuuccagacaggguuuuccuguguagcccugguuguccugaaacuagcucuguagaccaggcugacuuggaacacacagagauccaccugccucucugccucugccuucagccuagcugcauaucauaaccuuauuuucucaauuuuucucagccuuucagggagauauacaggcuagguauuauaacuacuauguaugaguauguaagaacagaaguucuuuuauuucaauauccucaaccaagggugacuuuuuuuuccuuuuuuuuuuggugaccaagggaacauuaaauaauagcuagagauccuuauagaguagccucaaaucagugaucugaccacagaugucaaagcagugugcuugagaaaccugaacgucgcagagauguugguagcugugaguggggagaacuugggcuugauuuuacaucuuguaacuaauugaauguuauuuauguagaaauacucuaacuagacuauggucauaugugguuuugccuaaaguuccauuuuuaaaguaguguuuauuuguugaagguagaguaguuauuccucagggcaguuuaaauagggauuaaagcaguaguaguaaaguguguguuuagacugaaguggggaaagagcucagccugucagggugcuuuuuaagcacgcuaacuguaaaagaaccuugaauguguuuuguuugauuaggaugugaccuccacaaaaggaaaugaguuugaagauuacuguuugaaacgagaguugcuaaugggaauuuuugaaaugggcugggaaaaaccaucuccuauccagguauguucauccuuuuuguuauaugaagguuauguaucaugcauuauacacuucaaacauuuuaaaaaauacagcugggugugguggcauauaccuuuaaucccagaacucagggggugaugccaggcagauuucugugaguucaaggccagccuggucuacagaguaaguuccgggacaguuaggaccacagagauccugucuuagaaaacaaaacuaaauuaauuagguaauaauaaauuucacauguaugggguguuuuaucugcuuauaugucugguaucaagcaagaagaggaccucagagacucuggaacuagaguuaggagccauaguguaacaugguaacguguccuugugugugugugugugagagagagagagagagagagagagagagacagacagacagacagauagacagacagacagacagacagacaggguuugcucuaauccacacuagccuuggauuugaacuguagucgaaaguggucuuugagcucuugccucacccucccaaaccuagaauuauaggcaaacgucaccauuccaccguucuucuugaacuuuuaaaggcuaagucacagaauccaucccuuuacuuaugagucucuugguguuuauuucccaagaauagggguuaugugucuguaggguucuuuauugucauugguugaugguuucaauauuucuuuuuuuauauuuaaaauuuuauuuuuaugugauuguuuugccugcguguauguucauguaccacauguguucggugccugaggaggccaggcaaggauguuggaucccuuggaacuggaaucuuaaguggucuuguacugccaugcggauucugagaaucaaacuugaacucucuggaaaaguagccaguguuuuugacugcugagccaucuguucagcuccuggauuuuauuuuaacauuuuguggaugugcagaggucagacacguacaggagucaguucucuuucuacuguagauucuggggaacagacucaggguguuguacuuuuaucuaccaagccaucuaacuggcccuguuguuuuuugagacagggucucauguuucccagcuggccucaaacucuuuguaucuaaaggugaccuuaaacuuguaacccuuguguagaauugugcugggauuacaggccuguaaagucuugucugguuuauauagugcuggauggagauggaagucaggguuuugugccugccaggagaauacucuaccaauugagcuacgucuccaggcucuuccauuuauuuuuugaaacagacauuucugaugaauccuugugauuuggcuuaagucauguuuucucagcaaaauacugcaaagcagauuucucuagguauugaguuugaagauacauauagccugucuggugacgucauuaauuuggauucucuuguugcaauccaaguuuugucugauguuuuccuccauaauguauggcgucuacuacuuuuugccccucuuaaagcuaaucuuaacauucuagagaagauuuaaaaccaaguaaguagccucugucugucaagcuuuacugguuauuaugauaaucuccuaauuaccaucuuuagucuuccuugauuccauuggucuggguuauagugaguuucagcuuaauugguccuuucauauuugguccuuguaaagaggaaccugcccuuguauguaaaaaaaaguagcaacaaaguagcaacagaaauaauuuuuugauugggagucaccacaacuuuuuuuuucuuuugguuuuucgagacaggguuucucuguguaucccuggcuguccuggaacucacucuguagaccaggcuggccucgaacucagaaaucugccugccucugccucccaagugcugggaccaaaggugugcaccaccaugcccggcggaucaccacaacuuaaggcacuguauuaaagggucauagcauuagaaagguugagagccacuguucuaaggaaauacagcuagugauuccccaaaggugaggaaggaagugaaguguuuuguucuuguuuugacccagucucacuguauauuucugucuguccuggaaaucacucuguaaaccaggcuggcuauagagaaccaacugcuucugccuccccaguacuggaauuaaaacaguagacuaccacaccugccucugugugugugugugugugugugugugugugugugugugugugugugugguguuuuuaaacaaaaggggccuuguuuaccucuggcuggcuuugaguucccuguguagcugagaaugaccuuaaaccucacaccuaauucaugcaguacugagcaucagaccuaugaaaagcauaaaauagugauucuuagaaucacucaagagucuagauccaaaaagagauuuacaauuuaccuggaacaaaaugagccucagcauaggcugcccuccgcucuuauucuucgggcagaauuuugcuauguagcuaagcugacucgcaacucuaaaaaucuucuggccuuaaccuccccaagugcuagaauuguagacaugggccagcaaaccugccuuuuaucuacuuaccuucucuccuuaucccuucucuuuucuuggcuuuucaacacaggguuuccucuauguaacccuggcuauacuagaacuugcuguguaaaccaagcuagcuucaaacucagaucugucugcuuucugcuaggauuaaaaguaugagacacugccuagcuguuuguuacccauuuucuuaaaaaugauccaucaucuuuuucaguauuuaaaacuacaggguuuuuguuuguuauguguuugcccuuauguccacaagugcaccaugugugugccuggugcuggcugaggcaguaagaggccccugcauccccuggaacuggaguuauagacagcuaguuggaaggugccauugggugcugggaauuaagacuagucgcucuagaggagcucuuagccacugagcugucuccagcccugagauuauagcuugaaaggacaugauuuuuuagauuuuuuuuuaauuguguguguuuugccugcaccaugugcaggccuguuccuggaagagaucugaagagaguguccaaucuaggauuagagauauauauaaauucugagaacugaaccuggaucuucugcagguacucuuaacugcuaagcaauuuaauggauauuaagaaaaaaaaauuaaagccuucuugauuagauguuuaagcuguacacauuugaauuguguguguuuuguuuuucaguguugcugguuuuuuacuauuguuguuucauguguguuuguguuugcagauagggccuuauuuuguagcucaugcuagccuggaacucacucuauagcccagguuguccuugaaguugcagcaauccuccuggcucagcuucccaaguacuggguuacagguaugaguuuucaguucucagcugaacuuugagugguguguguauguauauggcaggucagaggaugaccucaggugguguuaucagucaccagucacuacagagccuagacugaaucucaggggucuguuugucuuuguuucccaaagguugggauuucacaccccugcugucaugacuggcuuuuuuuuaaccucagugcugggaaucaaauuuaaguuguggugcuauugaagcaagaacagugccaaaugagcuauuucucucgcccugagcaacuucugagaggugauauuuaguugugauuugguuguuagcuuauuggaaaaugaggcauaugaaauugcuuucucaaaagagguuuuacagcgacaacuuggaacuagacacaaccaauugugccuguacgucucuccagauguagccaucuguauuggguacucagugagagugacuucauucuaaagguagcguguagcauguacuccuugggagggggggagggcgggccugggaaucuucuuuucucuaguaaccauuguacuaacuuuggauucuguuugugagguggcagcucuauuuuuuuuuuuucagauuuauuuauuuauuuuguguauaugaguauacuguagcugucuucagacacaccagaagagggcaucagaucccauuacagaugguugugagccaccaugugguugcugggaauugaauuuuuaagaccucugcuugcuccgguuagcccugcuuacuuuggucaacuccgcuugcucugccccaaagauuuauuuauuauuauacauaaguacacuguagcugucuucauacacaucaaaagagggcaucagaucccauuacacaugguugugagccaccauaugguugcugggaauugaaccuggguccuuuggaagacagacagugcucuuaaccgcugagccaucucuccagccccuggagugacaacucuuucauguugaguuaugugaggaucagaggacaguuuugggugucaguccuugccuuuugcuuugaggcaggggaucucucuccuguggcuuucccaaucucuaauugcugugugugcuaggcuagcuggaucuugaggacucugucuccacccccaucucaccauugaguucugagauuacagauacagacucugaugccuggcuuagcuucugugggucuggggauucagacucagguccuccugcuugcucacauuagguggcuauauguacuguuacuaaccaaccacacucccucccugaacccacagugaaaucaccacaggaaaaauaagguaguuuuauucuuuuaauuuugacguccaggaugaccccaaacucaagaugaucuuuguacuucagacuuccaagugccgaaauuaaagagugccacuaacccagggucucaccaucucacagagaucuuaaagauaauguaucaccaugcuguucccccaccccacccccaccgcccccuugagagugaauuguuucuuagccuuuaucaacaaguaugaggaguccugccuuuuacaguauauuaugcuaaaugauagcuaacauauuuuuaaaauuucauuuguuacucugugagcguguggcuaccaugacacacacauggaggucgaaggacagguuuuaggaauuucaugugguuaagccaauaggcaagcacuuuuacguacgcuaggcuaugcuugucuuacuggucauuguguuucuuuuuaaucuuucugguuuugacuucuaaaguuuugugugugugugaguggguaugugugagagggggagggagagaaguggggggaagacacagguugcaugcucuccaagguacacauggagaugaaagcacguuuuagauaugggacuaaauucaacaggguugcacuugcaaaacauaaaaaucuguugagucauuuuaccagccuccagugauauuuuuaaccaacaaacaauuguguuuucagaaauacaccagugaucaacuauaacuuaagauauuuuuuacuuuaguaauaauaaaaacuuucuguguuucagaaggaagagggggcucuucauuuuuauuuugugaagauuuugaagaaaaacuuaacauuuaagaacuauuucucacuuuucugaauuacucagaagagagcaucuuuuuccauuugguuuuuuucuauaucuuucccauacaugcuuuccuuaaaauuuugggcuuccccaacauucuaggcuugcuuaugcuuucugagaagccucccuauucaucauguggcugccuagccucuguguaccuaccugccuuacaaauuccaaggccuuuucucuucuccucccagcaguuacggaaguucacaaaccuaacaaaauugucguugagcuaaaaaaaaaaaaaaguguguguguguguguguguguguguuaguuaaaggaaggggcuggaguguggcucaguaggauggaugccugcuuagcauccuugaagcccuggguuugauaucugucuagcacaagauaaacugagcaaucacagcacuugggaaauggagacaaggaggaugagaauuucagggucaucugugugaguuaggaggccaacuuuggauacaagcaauccuuggcucuuuccuuccuuccuaccaaaagucaaauacagauuauuauucucaauagagauaaauaaaauguauuugguauaauuagcaaauuguuacaguugaccuuuuauucaaagaugauauguugaauuuggaacucuaggaacagugagccggcucaaaauucuuugacuugccugagcuuuuuuaaauaugggggcagaagguaugggugguuguguacucaccugccugcccguguguagauccacagcuuccuccuuuuucauggcaugcagggaugaggucagcaggcuaugcaugcaguaagugcucuuagccauuuuaccugccaguuuucugagacuuuucaguuuaaaauaaguucuuuauauacuauauacuuacucuaggaauugguuaggggucaggggauugagaaggcuaaaggcucugaaacaauauacaguuuucuaaaacauugucuuugaggagcuggagagauggcucagcgaggaagagcaaugacuacucuuccagaggugcugaguucaauucccagcaaccacauggagauucauagccaucuguaaugggaucuuaugcccucuucuggugugucucaagacagugacaguguacucacauaaaaugaauaauuaaauuuuuaaauuaaaaccccaaaaacauugucuuugaaauauuucacugagcuugucagcucaugaugggaaagguagugcugggugggggggggggggcaaaucaagaggguuccuaagaguccuggggggggggggggagcaaaucaagaggguuccuaagagucuucgaccagccugggcucaaacugacagagccaugacaaaacaaaccagaaagcacugagugcuucucaugcuuuuagguuuugagaugaauaagggagaaagaagcuuguguguguguugggggcaggaggggugaguuucuccucaacuugaaggguuggcucugugccugaauguuuagugauggugacagcuagcagcagcugcuccuccacuacuguuaaguugucgcuccuggaguuucauggccaaagcuguuugucucugaagcacauugacguggagccauuauaugaaguuuuaggauaaggaagugguuugcauaguuagcuggacuguaaugucaaauuugagaguggcagaacauugauuuuaguacuugauguuugcuuuaaaguauaaaauuauaaagguuuaauuucuuuucagaauucuaaaaccuugauuuuuauggggcugaagagagguggcuuaugauuaacagcucaucugcuugccgagggccuggguuggguucccagcacccacaucucaguggcaccuaacucacuuccagggauucuugacacucucuuuuggcuccuccuguacugagagagcaagagagaaacugagacagagacagcgagcaagacagagacagacagacagacacacaaauauacauacacauaaguaucuuuuuuuuuuuaauuucuuuauuuuacauacaccaugagcacacuguagcugucuucagacacaccagaagagggcaucagaucccauuacagaugguugugagccaccaugugguugcugggaauugaacucaggaccucuggaagugacuggaaaugacuacucuuaacucugcugagcaucucuccagccccguaaauaucuuuuuuuaaaaaagcuuauuuuuacacgcacucuuuccaaacccuguuuauaaaagcuaagaggucauuauugacagguuugugaacagguuuauuuguaggauuuuguagcugaacaauguacauucugucuuacuuugccuauuucccuuuuuaauuucuauauguguacuuauuuccaguaacuugguaguuauugugucccagauaauaaguauuauuuuuguugugguuauugaaaacacacaugauaaaguaaacuuaaaaaugaaaaugaaaugucacuuucagugaugugacagguccugucuucagugaaacaugauucaggacagagaaguuguguguugauaaauacucuggaaguugauguaauaaaaaauaaguaucaacuaggccccagagauaagugauuucagcuuaguucuauguuucuauuuuguguaagagaaagcucaucuuuuuuucucccccucugggauuuuaggguuuuguuuuguuucuguauugggcauugaaccaaaggccuuacagaugucucagcauacacucaagucagugacuuacacuuccaaccccgugugcacauuuuucauauggcaugauugacuuugccagucugaaaacagcgugugcugucaacugaccuggacucuuggggcucucagaguccgaaccaccaaccaaagagcgugcacaguuggacuuaggccuccccgaacauagguagcagaugugcagcucagucuucaugugaguucugaaccacgggcuggggucaccccaaaagcuguggccugucugugggcuguguucuuguagcugugcugccuugucuggccucagugggugaggaugcaccuagccucacaaagauuugaugugccagggugggggaguacccaaggggacuccccacucagaagaagggggagggccaguaagugggauguaaauugaauaauaauaauaauaaauuuaagaaagaaaauagcaugugcuaucuaaacuuuccuuggaguuagugccccuuuuuucccuguuuucagacaggcucuuacauuugucaagcuggugucgaacugcucaugccuacuaggauugcaggaaggagcuacuauguggcuauuuuuauuucuaacaaaaaugucuuguuugaggacuauuuacaacccuuugagauuuuuuuccccucacauacgcacacuuuuguuuauuugagacggggguuuuuaguuuagcccuggcugccaagaccagacuggccuugauucacacuaaucuaccugauuaaagguuugcaucaccacgccacacccgucucacuacccuuucuguugugcugggaugagccuacuauuuuuuuucuguuaacaguuuuagcaaacuuuugguucaaagugguguuaauacucacugguccuguuaacccaccugggucuuugccauucaugcagcguacauagugcacuucaaagcaguaccaaaaggcuauucuaaggugugacacagagaagaaucugguaauuuuuuuauucacaaguaauuuuugcauccuugucuuuuaggaggagagcauucccauugcuuuaucugguagggauaucuuagcuagagcaaaaaauggaacaggcaaaagcggugccuaccucauccccuuacuugaaaggcuggaccugaagaaggacaauauucaagguuaguggaauaaagagggaggggugggggcaggacugucuguacuuggagcuuuguagcuuuuagucuuggucagaauucauauaaucuacucucuuaguauauuugccuuaagugucuaaaaauuauuuucaacuuuuaaagggaauuucccaucuucagaguacuuuuuuuaugauugauaaacaguuuuuaaaaugcucaugugugauaagcaacguaaguaaaagcaaacuggugagaggcugagccagccauugcucacagcugugcagccaaacuccccgugggagccauguaagcagagcccguguagaaacaguaaaugcuucugguuguagaggcuugaguuuaucacauuguaagagcuuagacaguagaaaagaaguaaauuucuauaguuguaucuggagucaauucauauaauuaagauuucaccucuaaagcauuccuuaaauugcccaaguuucaauuuauaguucucucuccugucguugaugcaacuagaaccugaauaggaugcauuugcuacuuaaguauuuagauuagugacucuuaugucaagcaaauguaguuuuuaagacuguuauauuaauguuuauguuaugccuguguguuuagacauacugccucagugaaacuauuuuuauagcuucuuaaauuucuaaaagaugguguguucuuauucucucuucucccgcuccuuuguucuuugcuauuuucuagcaauggugauuguucccacuagagaacuugcucuacaggucagucagauuugcauccaggucagcaaacacaugggaggggccaaagugauggcaaccaccggaggaaccaauuuacgagaugacauaaugaggcuugaugauacagguaggaaaugaggcaggcagcagggcugucugauuauagcuacaaaugucucguuuauuuuucagacuuauucgugauuauguggaggugggguguggcuaugcacaugugugugcaggaggugccuauguuuguguaugggggggggcaguggauccccugguucuagaauuaguagcuacugccaauugaacuugaauucuuuacaggagcaauaugagcucuuaaccacuaagccaccucuccagucucuaaggguuuccuuuuaggaaauaacuaaaacuuuguugguuguuuuguuuuguugagacaggguuucucuguguagcccuggcuguccucaaacuuaauuugugaacuaggcaggcuucaaauucagagauuuaccggccucugccucccaguuacuuuuauaaaaagcauaugcuaccacugucuggcccuaaaauacgucuuuaauuaacuaagggacugaggguggauuaguagguaaauugcuugcauagcacauacaaagccuugauuauuuccccaccaaacaaauuggaguuagugacacacaccuauaauuccagcacuggggaagugaaaguuagaggaucaaaagucaagguuauccucgccuacauaaugaguucaaggccagccuguggcacaugauaacccuguuuuaacaaaauaaggaaucaaaagaacagaaacacugugguagaaaaugaagaguaaaaucaaccauuucuuucuuuuaagaggaaaaaaagauaacuaaaagguuauucagccuuauuaguaguuuugguuuuuguuuuccuugacaaggucucucuauguagaccaggcuguccucaaaccuccaacucacagagaccucucugccucugccucuggaauucugggauuauuuuuuaguauuguuuaauguaguucagaguaccauauuuauauuaacuguucuaaauuucaaggcaaaaaaguauuaguuaugagugauggauauuuguggaaaguaggcuguuuuauaacauaaguguacaauauauaugacaguauauuucagguuauaaacuuagauuuucaaguacuuugauaaauauaaaauuguauauaugcaaaguuguuuacucugaaaaagaaggcaaauuuaaauauuucaggagauugguuagauucagugagccugaauggaguuucacagucaguaaagauuuacguauugaguuuuuaugaagggcuguucacuguauaaugcugggugaagaacaguaacaaaauagcaagagucagguuuuacucagaauguuaauauauauuaguauuugguuauuuagcuauauuuuuuaacuugcacaauuuuugguuuagugaucagucuuuuuuuccccuuaaaacagucugagcagcauugcccagauugaagacaugucuuuuguaugcgaaacccuguauucuggcuguuauuucuugcagauugucauaagauaaaaguuguaugccuuuaguuggaauuaguaauuugggaaauuagcccauuuauugaagaguugaaacaaguauugucuaccugcuguaagaagagaugaaaauauacagcccaaaauacaucuuuguaccuuuugguauuaauuuguaccucuauaaauauuaucuaugaugcuaaauauauacuauaaaguuacaaguuuuuuuuuuuuuccguccuagguaaaauuaacaagagaguauauauuuucugaaucuuuuuuauuuuucccuguaaaucuuuguagugcauguggugaucgcuaccccuggcaggauccuggaucucaucaagaaaggcguggcaaagguugaccauguccagaugauagugcuagaugagguaauguuccugacuguccuccucugagcucagcucacacccuguccuggauacgugugauuagaaauaaccaagccaaguucguuuuaugucuuucuauucaguguuaacauuuuaaaagcauguaagcuaagcuaagauaguucuuaacccuacccuuuguuuuacaucugcuucuuuauauuguuugguucaugugugucugaaauuuguuacuuccuuagguuauaaccuaauaugaauuccuuuuaagaaauuacucgacugaagccaaauguuuuaccugggagguagagucagaugucugucuugaauuugaggacugcauaguaaguuucaggccagucaggacuacaaagugagacucugucuuaaaaauaaaaaacuacuccucugugucucucggguguagcagugcuauaugcauuuagugugucacuauuaguguuuugguauacagcuauuuuccuuuucuguuuuguuuuagauuacuaguuucuggcuuuucacuaaugaggaauaacacugacuauuauauauugaguacauaaugugauauuuagucugauaagauauagguuguuaugggaguguggauaaccuguguccauaguugaggacauugaaacauggcuaagugguacccaguacagcuaacgaguaaaacauuucagcccaaauggccuuggauuuaucguccuguuucuucuaccuucugagaguaagguuuaugccaaccacaucuagcucaaaacacauuuuugaccaauauacucuauuaucucuuuaauggggaucacauuuaaauucugucaaagaaaaggauuuugacagucuacauauuuuuuuccuuagggauuauagccucugcuuuaagacagauucauaauguagcccaggcugaccucagcuucucacuucucucccaggucagccacucaggugcugagcuuacaggcauaugcuaccacgcuaggcuccucccccuuaugcacugcuagggguuguccugguaacauugucuacauuagagucuuaggguuauagccaggagaagccuguguguagguugugcauugcccuuugcuuauauugcucuccaaaacuuuuaaugccuuauucuuuuuuaaaaguaacuuuuuuuuuguauuacaggcagauaaauuguugucacaggauuuugugcagauaauggaggauauuauucucacacuaccuaaaaauaggcagauuuuacuauacuccgcuacuuucccucuuaguguacaaaaguuuauggugaguauuagcucuguaccuggcaucagugcugucaugguacugagugugcuuuuaccuguaauuacauuguauuaucagaauauauguuauugcaagguuucggauuuguuuuuuuuaauauggucaauaagauuugggcauggauuuaguuuuuugagacagggucucacuguguagcccuggccaguaugcuagcuucaaauucacagaggucucugucucccaaguacugggauuaaaaauauguaugugcacuuuuuuuuuuuuuaacuuaaaugaccucuacuuguucugaggcuagccugguuuacaugaguuccaugccaucuguccauccgucugucaguuggucuguuuuucucuuuuuuuucuugguuuugauuuuuggagacaguuuuggggguuuuuuuguuuguuuguuuuuguuuuuguuuuuuuuccgagacagggauucucucuauagcuuuggcuguccugaaacucacucuguagaccagacuggccuggaacucagaaaucugccugcuucugccucccuuggagacaguuucuauguguagugcuggcuggccaugagacccugcuucaaaaugagaggaguugugauuuuuuuuuuuuaacucugugccaaggugacauaucccaucguaaguugguuauagcucaucucugugaggugcauuugaaucugaggucuaccauuuuaguauaacuuauuuuaugaauacuugguuuugaaaagagauucauccuuuagagcaagagacaaaauaaaaaaccaaaaaaaaaagguauaaacuuggggcaagaaaugggagcucuugccuuagcaugccugaaagucuuuacuuaaugacuguguucccucccacuccagaauucccaucugcaaaaacccuacgagauaaaccugauggaggaacuaacucugaaaggaguaacucaguacuacgcauauguaacggagcgccaaaaagugcacugccucaauacacuuuucuccaggguaaguagugggcuuuugugcugaguccuguccuucacuaauuccuagcaaguuggacaauuagaucauuuucccuuuccuuuccuuuccuuuccuuuccuuuccuuuccuuuccuuuccuuuccuuuccuuuccuuuccuuuccuuuccauuccucuucucuuuuuuucuuucuuucuuucucuuucuuucuuucuuucuuucuuucucuuucucucucucucucucuuucucucuuuuuaauuuuauuuuugacuuuauuuucacuguaaaaaaucuuacuguuuuguaaaaaguagcuuuaauuggcuuacaguugaaacugauugacacaggugcuuuauauuguuaaauaauuuacuguaauuacaguucauccuuugugaauacuaauugcuaaaauuuauuugugacccccaaauuaguacugaagguuuugguuauucuuagacauauacauuguggacuuaaaaaaaaaaaugaucccagcuaagguccaagaagaggacagacauucugucuucuuguuuuacuuauaaaugcuacaauuguuuuucaaauuuuggugcuguucaucauucauuccaaaaugacggccucgcugcugccgacgugcuuaccuguguucugaagcacagggggacugauguguacuacacagggaaaacauguacuggguaaaccuccugcaggcacggguuauauugguuaggacuauagacauacuaaauaagacaugcucaaagaaaacacauaaauuggcauguuuaccaauuuauaaaaugucaccagaggcucacaaguacuugucauuuucucuagaaacaguguuguuuuaacuuguuuguuuucuuuauuuuaaugagucugugucugugugggguuguacgcauaugagugcaguuucuggaagcauccagaaaaggguguuagagcgcccgaaggagaguuacagguaguuggggcccacacugugugaacugaacugaacuugggucuuguugaauaacagugugugcuauucacugcagagccaucucuguagccucaaagcagugguucuuauuugcugagucaguguuagcagcgguguauuguaggacauuacuguguugucucugcaaguuagguggcccuuaugagauaaucuucucuaggucgacaaauuuucaucugaaagcuuggcuagauauuuucaugauuggauaaacagaugcuucugucuuucucaucuuucucaucuucugugcuuagcuucagauaaaccaguccaucauuuucugcaacuccucccagagagucgagcuacucgccaagaagauuucucagcugggcuacucuugcuuuuauauccaugcuaaaaugaggcagguaaggauaauuucgagaacuugcauagauuuaauaaagaaauauuuuccuaaguauuucuuauauuuucuuuuguuauaauguuguauaaaugccuugugugugagaguaaacuguugucuuaagguagguacugcuguauuagugguagagcaguguuccagaaaaagaacaaaugaacggacuauuuaguagacaaagagaccuucacuuaaaccaauagguuuaaaaagcaguccagaaaugucagaucuuggggcuggagagauggcucagugguuaagagcacugacuguucuucagaagguccugaguucaaaucccagcaaccacaugguggcucacaaccaucuguagugagaucugacgcccucuucuggugugucuaaagacagcuacgguguacuuagacauuauuauuaauaauaauaguaauaauaauaauaaaucuuuaaaaaaaagaaaugucagauuguccaugaaguccuagcauuuaaaguaagugaaaagcucagagucauuaucuguuccauacuaaguuugaaaucagccugagugacaugaaauccuguggggagggaagggcacaggagacauucuuuuggggggaauuucuaaauuuguucuguuuagugcaauaacuuuauuacauagcuccauguacccauuagacuagguaaaagcaaauacaauugaaagguuuguuacuuagucaaaucccugaggcuggugacuccauuauuggagaauaccagugcaauuuuuuuuuuuuuuuuuuuuuuuuuuuuuuuuuacagaaugcacugcucuagauuuuaauauacaguaacuccuccuuacaaaggagaguucugagaucccauaucggauaccuaaaaucauagacaguaccagauuguaugugcaugcuugcuaugaugcaguuuauacauuggauaugguaaaacguucacuaggauaauaaaauagaauaaauaugacacuauauuugucauaaauguuacgugacuaugaucgcagcauggcuuauuaugccuguccuuuuugauagaaugcuuguaugauggaaugaaguguaucauacagacauugagugauacagcucuagacugcuacagaagcauagguaguuguguaaacaaauuugggguugaagaacugauuggguaagagaaaccaugaugaaaauuuugaguugucuauaaauuuuacucaguuuuuauauaucccccuacccuccaggaacaucgaaaucgugucuuucaugauuuccgaaauggcuuaugccgcaaucuuguuugcacugguaaguguuuuuguauuucuuggaccuacuguuuucuuaauuggcugguugguuuuuuuguuguuguuguuguugguuuuuuugucacauagugaaaccuaugugacagcuccuuacacccugcugccacuuugacagcuucugaagacaggggugccugcuguuuaguuccuagguugagagcaggugcuauucagugccugaccuuggguuccuccuagugcucaugcugcacacguggcucuaaauuagguuuugcauuuaugugcuuucugaacaguucuaacauacaaggugagcaaacacaaaauaaacuuuacucgaaauuacauuuuagaaguugugucuauuugauuuuuuuuuuucccagaaucacauuauucuauaccguaagccaagauuuucuaauuuuugguuguucuauuacuacagaaaaauaagccuggguagggagggggagacacaaauuuagcucagaaacuaauagaauggugccuucgcaccuauguacuuagaauuuaaucuuacuauuagugugagaagaagaaucauuugaggaaguagaaggacuuggaguuugaacuauaauguauauauugguaaauugcucaucuuuauuuuucaugugaauuuucacauacgcauguaccuauacauucagauaaaauuguauuuaagaaguuuugguuggcugguugguuuuguuuguuuuugagacaggauacuacuauauagcucuuacuggccuggaaauuggauauguagagcagacuggucuuaagcucacuucuuuuguuagcuggccuuggccgcuuaagugcugagauuagaggugugcagcaccacaccugacacaauuauauacauaauauauauauacauuaaaagauuuauuuuaauuugugucugugucuauucugugucuaccacgcuugcacaacaggugccugcggaggccagaagagggcauuguauccccuggaacuggaguucucaggcaguugugagccuguugauaugggugcuggagaugaacgcacaucuucuggaaagagcagcaagugcucauguccaaggagccaucucuuuagccaccuauuuuaaaauauagucaggauuuuugggaaaaugcacauaaacaaaacacuuguuacugcuaccagauauuaaauuugguuauuccuaguaaucaggaaguaacuguaaaaauaacuuuauggaggcagucauauuauugagugguuagcuuuuuaaaguuguguuuaaauauuuagcuguguauagauauuuuuuuuuuggacauuugggaaaccuauaaaauagcuuacuagugaaaguaaaguuguuagucaaauugaauauucauaagaaaauugagacucuugcuaucaggcaccugccuccaacuccauuuuucaacuuuaaauaaaaaguuggcuuaagagcuguaaauucaaucccaacauuaaaagaagacagacauugauaguauuacuacacugguuaauugguuuauuuguuuguugagucagggucucauguaagccaggagagccuaaaguucagcuugggauggccugcuuccucuucugagacaaaggauuguggguacugauaugccaagcuuuaccugaucuuggaauccuaggauugccuaggguuaggguuuuaugcacugcacucauucaagauucuuaauguauauguggaaugcuuugguauauaaaauccuacuuguuaggguggcugacacaguuugaggcuagccugugcuacagauugaguccuugucucaaaaaagcaaaguaaugagaaaaugccacuucuccuucaaggaauguuaaauuaauuagaaaguugguauuaaaacuugcguaccauguaaucuucauuaaaaguacuugauuuugccaucucagaaucagccuuaagauggaguacaaaugaaugagcauuaaaaauaaaauuguaaaaaacaaaaaacaauaacaaaacuaguuggugccagguguugugcaaucagcaagcacuugggguaggggcaagaaggucacuucagguucaagaccuuccugcucucugcuagccagaggccagcuagaacuacagugaccuguagugaagauaguugagcuugguugacaagggaguaauguaauuauuauccuagugguuauuggaauacacaagaaauagcugucaagucguuucagaagggacgggguuuuaauuggcuuuauggacuggguaaauuugauguggagaaaaaaagauuucaaguuugaagacuuggguuaagaauagugcauaaaggucuacacagaacggcagugugugcuccuaauccugacguuuggggguuugacagaggaacacgaguucaagacuagcuugggccaccagugauccccaccucaaaaagaauucagugucgugagugguuuuggaagguuguugugagaaaggaaggaacccugauuaugacccuguugugagcgugagggacuuugccuauuaguuuacuuagaugaguuguaaauuguuuaccauaaguggauggaggacuucuaaaagcauaauuagugaauuaccuuucaauaaugaaaaucauuacuuguuuguuuguuuguuuguuuguuuuuucagaucuguuuacccgagguauugauauacaagcugugaaugugguaauaaacuuugacuucccaaagcuggcagagaccuaucuucaucguauuggaagaucagguaaguaagaauggggguagccucgcagacauugcuugaugagaaauacaaucuuucauuuuuccuuugugaaguaaaguauaauagcugugagagcagugaaaucacaucaauugacuuguuugauauuuaaaacuaaguaauuuuuuuauuaaucauuuauauuuggagacggggucuggcuacauacauagaaagcccagguuauacuggaacuuaaaauguaccugccucagucucccaagaccuugugucauuuauuagaguuaagccugauagagcaccugaauccaauccugauacuuacguaacaagagagaaacagcugucaacacacacacacuuuuuuuuuuuuuuuuuuggagacaggguuucuuugugcucuggcuguccuagaacucacuuuguagaccaggcuggccucaaacucagaaauccgccugccucugccucccaagugcugggauuaaaggcgugccccaucaucgcccggcuaaauuauaaaacuuuuuaaagaauguucuuuaaagguaagcugacuguaugugguguacacuugggaagaggaggcaggugacaucugaacaccuguguguuagaggccagcugggguuacaaacugauuuugaggccagccucaaacaacaugauugagacccaauuucggggguugggggaguuaaaguaagcuggaaaugguggcacauacccuguaauccuuguguuugagagauugaggcaggaggaucaugauuauaguugguagggggguugggagaaauggguuugcucucaaagagccuguaaagcccucuguuugauuuccaguacccacaucagguaacauaaaagcacuuguaacugcaccuuguuaauaacaaaaaguuaagucacauaguaucucacaagaagaaagaaggaaagaaagagguuaaaguaauuacuauauacuuaaagugaaacacaagaaaacuggauugauugaaugguguaguguacaaguguauuguucaguguguguauuuugacagucguacaaacgaguauccaguuugucauuucaaaaccagaaaauuagguauagcugucccucgggguucaugagcaauggguuccaggacccuugccaacaucaaagucuggguagucucuuaaaagcaugugguauuagcauauaacuggugucuauguuacacuguauuguuuagggaguaguuguccagaagucugcugccuguucaguacaguugaugugccaagagaaagaccuaaguuguuuuguuuuuuauuuguucaaucuuguuugugccauucagaaugccaccaaaugaauauauugcugcucuguguuuuggcauauuacagacuuguuaauacauguugcucucaaaacauguuagauagauacauacuuuuauauuugaaucacuuuauuuaccacuuaaacuuuuugccaauuuuaaacucauuaagcacauuuuucuuuaggucgcuuuggucaucuuggcuuagccaucaacuugaucacuuaugaugaucgcuucaaccugaagaguauugaggagcagcuggggacagagaucaaacccaucccaagcaacaucgacaagagccuguauguggcagaauaccacagugagccugcagaagacgagaaaccguaacaagcacguauguaccuaguaaccugacagaaccuucaaggauuuccaaacccugcccagugugagcgagcgccugcagucgcagcacucuggagacuuugaauuggggaaauaacgucaguagggccgcauagcccuacuauucagaacacaaaaggcuuuucugugaugcuucucuuucacuuaauuuuuauguauuuguuuuugagagcggcucaggcagccagagaugccuucaaacucuucaucuacuguaggauagucuugaaaacccaauguccaugcuuccacuuucccagugcuggcauuagagaugaaggccacacccauggccucuuaguugugaaugaaggcugccugcagucagaacuuggaacgucucauucuguccuuggguaugugggaaacuuguaguuuaguugauuuuucucagccagccuuuagcccuagcucaacugaaacagacuggacuugccugcacgagcugcaacagccaagugaaaucuuccauguaacuaguagaucaccuuaggagaagagagaguuuacuguaaggcuugugaaaacaugucuccuuuuuuauauugcuuucauggauacuaauuuuaaauuucuaaacuuuucccauaggcuuugacaaacuacagaaggcucuuuggaucugugacacaucauuuugggggggugcucuucucuuuguggguuuuuucaucuuuauuuuggaacuaugaagaguuauauaagagcucagacauuuuucuuuuuuuuaaacuggugaagaaaaacugaaaagaagacauagaccuuuuuuguuccacuuguuugcacugugugcugacugaacauucguugcacuaacugcuggucuuuaaagauguuuucuggggaaaggggacaaggaaggaggaaaagaaaagaaggggagaaacccuaaaaaagagaagaauuugggugaacacaugcaccugucuaaaguucuccacuagcugacucuacugcauuucaacuucucccugauuauucauccguuuuuaagccugaagagcuuauuacuuauuugugcgaagugccuuaugcuacaagaccauuaagaauaucaucuuuacacacagcccaaggaaucaacagagucauguucuauuuucuuuuuuauuucuuugccucuucauuuugguuucacguugaagucucaccuccuguucuaccaguacucagcccagggccggaagguggacuagugauggcagcgccauuuuccuuuucuuuauauggaggaguugauucacaacugcaguccauccacacuguacauacauguauuuaaaaaaaaaaacaauaccaaguaaaauuuucuuccgggcugaguagacguaccaucgucgcucccaaaggaaagagcagccucucacugcaggagccagaugacaagccucugugcucuacagcagaacacuacgcuggcucacacgcguccaugagcaggaaggcacucgcuguaaagacuugucggagggagccuugaccuucuuuccucuguggcaaagcgugacccguagaaaauuggauguguauacuuguauaaacuuuguaaauaaguuuuuuuucuggguucauauauauauauauauauauaaauauauauauauacauacauauauauauauuauuuuuuuuggaugaagguugcugggauuaagggauuagagugauuaugggagcagcuaaagaugagaggggcucaguuuucugcaacacuaaauucuaaaaagugcuuuggccucuaacuguaggaagcagaccucugcaggcucuguguuggaaaggggccagaagcccggccacacugcucuuguaaugaaugcacaggcagcggucuuagcagacagcaaaggagcuuugcaaggcuguggucccugggggcuuugagaagcucugugguuuggcucuccuguccuaaacguuugaggaacuucccaaguucugcaaaggggaacaaagauaaaucuuccuuggagugugagaaguguacagagugcagucuuagaggagaguguguggagcauggauuuuuaugucaccggaccagccagugcagccucggcgggcuuggcaguuguggagccuaguuauccgcggccccuccuguugugugugagcagcgcccucugccuaucuugauaaauacauuuuugcaggaaggggcagcccguuagagcuguuaacguccauguccaugcugcagaaagcugcuugcugcccguucucugugccgcacuaagaguugcugucugucguuuugcauuguaaaucgcuggcagaugccuuaggugguaguguugcuuuaaacugugccccucccaacacgcuugauguuuggccugaucuccaggcaaaaggagggagaugaaucaaccagugaacuuuuuuuuuaaaaauguuuuuaauucccuuuuaacccaguauacuaggucaggaggcaucuagggaacaaaaaaagcaaaaaacaaaauuuaaaaaaaaau

SEQ ID NO: 5059 - RNA, 2020 nt, Mus musculus
gggucuuaaaaacucguuauuuugaccaacagaucuugcccuuguaccgaugcagcucuccuccuuccugccuuuggcgagaugagggaucgcuccguagagcaacaugagcaggaaaggaguacaaaugcaaucugcugucucgccagagggcaagugggugaucaacaaagugcagucucuugccaaccuuggacugcucugccaggugccacaugccucugagucccucuuaaagcacagacuccaugggggaguguucugaaguacagccucugcugaggguggcacuuggacagcugggcacccaccccggagaucgcugucugaagaggcggugcugggguggugcuuagcucacuugagcuguuguuaaugggaagaugcccuacugaccaggucaaacccugguuggguuuuuuuguuguuuuuuuuuuuuuuuauccuuuuugaucccucuuaauaaggaauauugcuacuauuggaaauugucuuucagguucuuuccaguaauuuuuaaaguaaugguuauguuuugguuuucgccaguaguucauuucgauaaaaacuauguccuauuuuuaauauccaccucaaugcuuuuagccucuggucauguaguugugugauaaguaacagacuguuacacacuugcugcucagggccuguuuuuuucucucccuuaguguucugaacaugaaagaaacuuucuuaggaauggaauacauuuaccauaaaauguuuuuccuggaaaggaaaaccuaaguagcucuaaauuauuuccaggugggcaccagcaucauaacaauugguuggcccgguggggugggguggggugggcugggugggugguugucauacucguuuucagaaugagaugagggcaucuuuccuuggccaccugcuuugugcuggacaccaucgugcucggugagaacagagcacagcacagaguuuggagugacauguuggaaacaaaacaucucauucugaucauuugguuuauuuuuuuuuaauaggggugggaggggaggguacugugucccaaaagggagggugucugcacuaaggauuuagaaacacuuuggaagcucauaaccucaugggaaacugccuuuagccacacacacuccugaccuuuagaugaguaacaaaaagaugaaauaaguuugugggaauuaagccauguuauuuuaauuggauacuuuuuuuuuucaacucucuguguaucuuuaaaauuguuacuguggaaugauuuucuugccaaauaacuuugucaggcaaaauuauuggccucaugggaggugaaguaagccagauuuuggguaaauuuauguggacuuuggugaguuuguaauucuacuuuauauucauaaagauaguuuuuuaaaacucccaaagcaaaucuauuuucuucucuaauguaaaaacucaucuuuggaauaaagaguuaaguguccgaggguuguaacagauaugaggucagagggagcuagccuggccuggacucugccccuccacagcugacagacuccaacagaaguguauuuaaaucuccaguagacagagcugggcagggcaagggaggggugggccuggguuaguaagcugcaggcugcuguauuuuaaccagugguucuuggggaggggugcuggagaauacaaagucacuucccuuuuuugaaacaaaacaaauuagaaaaaaaccaauuuuuuuguuuaguaaaaauaagaaaauucuaaugucccuagucacaagggaccaguuccacuuugagcaguaggaacuuaaaaauuugaaaacauuuggggaaagggaaaauuggcuuucuguuuaauuggcaaauguuccaguggggagggucuguuuuuguugggauguguuacaguguauguacaugucuauggaccugagucuuuaaggaguuauauacaugguucauucagaaaagaugguugguaaaaucuugauuguuucuuuuuguuaauuuaucucaauaaaagcccacuggaacuucag

SEQ ID NO: 5060 - RNA, 25542 nt, Mus musculus
cuguuagcccaggauuugcagguuuggcuagaauuguggagcgucauuccucuguccuuucuuucucuucgccugcguuuauuuggugcugcuucuuuuuuuuuuuuuuuuuuuuuuuuuuuuaaagauuuauuuauuauuauauguaaguacacuguagcugucuucagacacuccagaagagggagucagaucucguuacggaugguugugagccaccaugugguugcugggauuugaacuccggaccuucggaagagcagucgggugcucuuacccacugagccaucucaccagcccuuggugcugcuucuuaaaguucguaaaaacacucaauggaauauauaaaauaaucugugaccaugaggaacuaguauccugaauacauaacgucuagaacucccguaauaaagccggcaugguguccccucaccuguaaucaauuccagguaaauuaggaaacugaggaggaagaccaaaaauuguccagccgggcacacgccuuuaaucccaguacucgggagccaggggcaggacgaucucuguaaauuugaagccagccuggucuacaaaacaagucugggauagccagagagagcuacacagagaaacccugucuugagaagcaaagcacuaauaaaauacugacacauacaacauagauuagccuugaaaacagguguaaagaaacagaugcaaaggccacuauuuguuugcaaugacuaaaccagggauaucugugaaauuagaaagcuuauaagugauuuaucggaguuccagaagacuaggacauagcggcuagugcauuauguuuggaauguaagugccauggaauuacccagaggcagauauccugaaagccacugaacuguacgguuuaucuucaauauguaauuauuuuauuuuuaaauccuauguguguucagacaugugccugcgaaugcaggcgcugccugauaugggugcugggaaucgaacuggggcuuuuugaaacagcaacggauacucuugacugcugaacccccucuccaguccugaacuguauacuucaaagggcugggguuuuuuguuuguuuguuuguuuguuuguuuuaggguccugagagauagcucagcaguuaaaauccuauauugcucuugcagauuugguuuucuccugccucaaaaaagaaagaaaagaaaauguauguucacaaguguccuuggucaggcgcgccuuagaggcuguauaacagaaguaaaaacaaacgaggaaucagcgcgaccugugcuuaaauucuuuucaguacucaaggccuuagucguuaguuaacucacuacaccucucuaagccuguuauuacucuuuaaacuggugggagcacauacuucauaaauuuauagaguuagauaauagaaaauaaauuagacuguauaagcuaaguguuccaccacaguaacugcucaacaauuuauacuuguuauuauggacauagcaucacaaagauaaaaccaaaaauagcaauucuacucaaaacauauuuuugaggcaguuuuacuuccuauaccugccugaccuagaacucacuauguagaugaggcuggucacgaacacacagaggucugucugccuuuacauccuuaguguuaagauuagaggcaauucucuuuuuaacuugaagcagcacaaaagaggugugugcuaguuaguagccccaaaauagaaaaccuuguguccaccaacugacaaguggauaaagaaaauacuguauacaccccaacgaagcguugaggugagccaucugcaacagcuugggugaaacuggagaaauucuguacauuaaaaaggaaaagaaaggucuccccggagaggguuagucuguguaauccuggcugucuuggaauuugcucuauaaaccaggcuggcauugaacuuagagaucuacaugccucugccucccaagugcugagauuaaaggcaugugccacauacccaucagggacaaaagccagcucuggugacacauguuugaucucagcacuugggaggcagaggcaggaaacucgaguuuaaagucugggcugaagagauagacuuagggauuuacaaggacccucugcuguuccagaggacuaagguucaauuucuaacaccuacguggcagcucacaaccaucuauaauuccgauuccaagagaucggacacccucuuugugacucugaggguaccaggcuuguagaugaugcauaaacauacuugcagguaaaauacccauacauauaaaaguaaauaaaaucuuuuuauaaaacuauuuauuuauuuuagguauguaaguacacuaucauugucuucagacaugccagagagagcaucagaucccauuuacagaugguuguauucuuaucugcugagucaucucuccagccccaauauuuuuuaggaauuagaaaaacacuaacagaaaauaaaauaaaaauuagccgggcagugguggugcacgacuuuaaucccagcacuugggaggcagaggcaggcggauuucugaguucgaggccagccuggucuacagagugaguuccaggacagccagggcuacacagagaaacccugucucaaaaaaacaaaacaaaacaaaacaaaaaaaaaagaaaagaaaaaagaaagaaagggcuggagagauaguucagugauuaagaguauuaacugcucuucuagagaaccuagguucaauuuccaacauccacaugucagcucacagcugucuuuaacuccuguuccagggacucugacagccucauauagacauacaugcaagcaggacacaaauauacauaaaauaaaaauaaaauuuaaaaaaggaagaaauauguucugguguucuguugcauagaaaaguugacuauuaaggacaaaauauaguuuaguauauauuuuauaaaaaaaaaaaaaaccuagaaggaagaacccugauuuuuuuccccacaaaauaaugagaacuguuggcagcacacaugugaaacagcagcacuugagaggcaaaagcaggauacuaugaguuugaggccaaguccauauagugagaugcaggccacaagcaucaugagcccuugugucaaguaagaaaaggaaaaguugaagggcuggagagauggcucagccguuaaaaauacugucuauucuuccagaaguccugaguucaauucccagcauccacaugcuggcucacaaccaucuauaagaucauacaucaaguuguuugguuuuuuuuuuuuaaagauuuauuuauuuauuauauguaaguacacuguagcugucuucagacacaccagaagagggcgucagaucuuguuacggaugguugugagccaccaugugguugcugggacuugaacacuggaccuuuggaagagcagucagguacucuuacccacugagccaucucaccagccccaaguuguuuguuuuaaaagguugagaaucuagaaaugcuaggacuugaauauuuuguaauguacacauguauagaaacaacacaaaaugccccauaacucuguacaauuuuuagguaucgauuuucuuuuuuaaagaagcacguaugagucucucauuuuucuuuuucugaguugggauuguaggucugaacacuauagguuagugcccugcugcauguacaucugcaggccagaagagggcaucaaaucccucucauagaggguugugagcgacgaugugggugcugggaauugaacucaggaccucugcaagaauagacagugugcuuuucuuuuuuuuuucuuuuuuucuuuuauuauuuuggggggugguguggccuccagauaggguuucuuuguguauaaccaugacuuuccuggaacucgcuuuguagaugagacuggccuagaauucagagauccgucugccuuucccuccucagugcugggauuaaaggcaugugccacugaaagacccacaacaugaggacucccccacguucugacucaggagaggcgacaccccaaaaucaccaacgagaaaacggucuuguugcaaauugcaagaggauuuuuauucaagagugcucucgggcccacggucauacaccacgcagggguagaggacuguggcgccccgaguagcugaguaaggggguauuuaaaggagaaaaaccacaacucaaggaggugggaagggcguuguuggaaaauaccaaaaauaccagguaagagucacaaggaaguacaaagucacaggugucacaaggaauaccugguaauuguuaacucucaagacaguuucuaagagccccuaacaauagcacauuugcauugcagcuuccgguaauggucagggugacuuucuuugaaugaauacuccuugaacucaggaaguggguggguggaggaaugucacuaucuguuuuaugauuagcauaccuuggagcacugaguuuacuacucuuucaccaccacgcccagcuguguuauuuuuuauuuuauuuuauuauuauuauuuuuuaucaauuuugaaacuggaccucaauagcccaggcuggccucaaauuuaccaaguuacuuacugagucugaucuugaacuucuaauccuucuaccuccaccuccaaagcgcuaggauagcaguuaugcaccagcuugccugacucauaguuuucuuuagcaaguaaaaacacaggacacagauaaauccuaaucucagaugaaggaagagaaaguaugcuccugugacauaggguaucgcgaggaaaagggcuaucgcgccacagagaugcuauaaaagggcuuuuaaacaugcuuggacuuuuccuugaagagugucuaaacuguggauuaggccuaucuaggagagacuguaggccaaaugagccuugucuuugagaugacaguuucuaguuggagaaaagaaauccacuagccuggccuuccaccuuuggccacuagaugucacaaccgacucaguugcggaaaccauagauaagcgggcugcuagaccgccuagugcccggggccgcucuaucccagcgccgcgucucugcuuccgccaccaccggccgcagcagaggggcgggguggcggcgcaguggcggggcacgucucgcgaucguuccuucagacucucgcuuuguuuugauuuauuuaucuuuuucccuaacgacugacaacaggcggcuuguugcacuuagggauccuugaaguggcugggccugagagugagaccccaguccucggcugggguucuuuccaaauagaagaaacggauccagaggggcuacagguaauuggugcucccgccagcguucuuugcucucugcgccccaccaacugcccuggauccuugacucuccgagaacccggugggauccuaucuucaaaacgggcggaaguagaggugaugcucugaggauuaguggauggggccgaggcuggaauuugccuucucucaggaccauccugucccauccccauacccuccaccucuggcagaagccucaacagcugugcgaaaacugaccaaaccugagacggacggccggccgcagucuggcugugcaugcugugcuucccugccugcaucuuauguagagcuuuuggguugcugcugggaaggguuggauaccguuuuccacugcacuucucuuggcacccagccaaugcuagcuaaauaaugcucuugggucaggaaacuuuccuuugggggaaagcuuggaucggggugaaugcaucucugcaccgaggcuggauguauaucccaugauaggagcuauguaaucguauuuccuuuugcuuagaccaaaauuguugagaaccagacauacgaugagcgucuagagauuaacgacucggaagagguugccaguauuagcacuccaaccccaggacagcaagguaagagaagaugagagacaaaaaaaagggaggugauuuucaaacaaguggcgcagauaggauucagguuguauucagcaagcucuuagcaaguguugaccuccugcuuuaacuuggcgcugauuuugcuuucucacuaguugagggagaaaccaguccaucagauuuugggaucuuugagugcaaacuuauccccugucauuuuuaacucgcuguuacugcuaguagauucuggcacagguucgcuguguuuuggguuuuuuuaauuuuuuaauuuaauuuaauuuaaauuuaauuuaauuuaauuuuuaaauuacuauuuuagaaauguuuauguguauguauguuauuugcuugcauguuuuucugugaaccaccugccugccuggugcccucagagaccagaagaggauguugucagaucuccuugaacuggaguuacacaugguaaugagcugcucuagugugggugcugggaacugaacccuggguccucuggaagaucagccagugcucucaaucguugagccaucucuccagccuggcucacugugcuuuuguuucuaacaauucauuaagaugcuucaucacuugcccuuaacuugccaucccagcuuuaaucgaaacagaguuuuaucagaagacuugaugccauucauuuauucaccuaaccuuuuuuucuuucuuucuuucuuuuuuuuuuuuuguuuuuuuuguuuuuuugagacaggguuccucugcauagcccuggcuguccuggaacucacuuuguagaccaggcuggucucgaacucagaaauccgccugccucugccucccaagugcugggguuaauggcgugcgccaccacgcccagcccucaccuaaccuuuuuugguuuuguuuuguuuuucuuuuuuugagacaggguuucucuguauaguccuggcugcccuguaauucauucuagacaaggcuggucuccaacucagagaugugccugccucugccuccccauugcugagagugaaggugugcaccaguauucucagcucaccuaacauguuugaaugcuugcuaugugccauguuagcacaacagcaaacaaaagacacaucccugccaaccugacacuuggaaucuuagaagaaagauggccggugacuagacagucuucaugaagaaugucaugugugcaggauggaggcaaaugguuuacugcuaugaagcauaauggugguggguggggaucgauuuguggccagggaagacucaagaggaaagaccagugccuggugagagggcaguguguuauggucugaucagaagggaggcgagaggcuuaucaagcagaaguccagaggcuguugcugucacauggagaauuuauuggaggguucucaggugagauugggguggugagugaaaguacuguggcaguggcuggguugccaugguaauggcuuggacuguggcacggauagagacauggcacagauacagcauagauugcccuuacagaaucauuaaggcuugcuccugcguuagauuugaguccucaguuggggaugacuguuguuuacugugguaaaauacacaugguguagaaugcuauuuuagcacuucaaguguaagguuaaauggcuuugaggacauuuacauuuugugauaaccgucaccacuggcuuaguuauuucucuauugcugugauaagacaccuuggccaaggcaaguuauaggagaaaguuuaucuggggcuuacaguuucaggggauuagaauccacgguagcugagaaaaaucauggcagcaggaacagcugagaguuuauaucuuuagacaacaaccaugaagcguagagagcugaaugggaacggcaugggguuuugaaaccucaaagcccgucuccagugauacagcuucuccaacaagaccacacuccccuaaccuuucccaaacagcucuaccaacugcugaccaaacguucaaacauaugagcuuccggguuuguucucauuuaaaacacuacuagaacuuccucaucauuaaacaguaacuacugccaggcauggugguacaugacuuuaaucccagcacuugggaggcagagacaacuggaucucuaugaguuugaggucaaccugaucugcauagugaguuccaagacagccagggcuacauagugagacucugccucagaaacagacagacaaacaaggaaacaaaagauuucuugaccagcacuagggaggcagaggcaggcggauuucugaguuugaggccagccuggucuacaaagugaguuccaggacagccagggcuacacagagaaacccugucucaaaaaaccaaaaaaaaaaaaaaaaaaagagagagauuucuugauucuuuccuuccuuccagucccuauuaaccacuacuuugcuucugugaauuugccuauugguggcauuuccuaggugugaugguuuuguauaugcuuggccuagggaguggaccuauuugaagguguggccuuguuggagugggugugucauugugggcguggcuuuaagauccuacuccuagguaccuggaaguuaguauucucuuagcagccuucagaugaagauguagaacuuucagcuccuccugcaccaugccugcuugaugcugccauguuccugccuugauugguaaugcacugaaccucugaaccuguaagccagccccaauuaaauguuguccuuuauuagaccugccuuggucauggugucuguucacagcaguaaaacccuaagacacuagguaaaaucauaauguccuuuuguggcuagcuugugucccauauacauguuucaagguuugcuuaugcuauagcauguaucauaauuuuuucaauuuuauggcugaauaauaaauagucuauuguauggauacacaauguuuuuaagucucucaucucauggacacugguguuguuuuugccuguagcaauuaugaacaaugcugcugugucugguggugaagaagugucugucugaauucucauuuuuaguacuuuugaauacauacuuuauuucccaaaauuacagccggaugcuccaugaaucuccaugccguccuugcacaggcuguuuuaaucucugcaucauuccagauuuuaguguuugugcuguggaaguuagcauguugaguacugaaccacuagguguuuuuccuccaacauguuaggguuuuauuuauuuacaugaaaauaggauuuuauucugugaagcccggacuaaccugacauucacugugcagcucaggcuggccuuggauuuaaaauacuuuugccucaguuuccugagugcuguaagcuaccauguccagggacuuaacaaguuuaugcucuugucagcuguggacuuguuuuuggcuggguaauuuauuaagucaaaaaauguucaguuugcaucugacauuuucaugcugguuaaucuuacauccaguuauacuuuugauuucagaauguuauuacuccuacagauucucuuaaugcucuuaugcccugaugcaaauucaaagucacagcuagcugcuacuugccaggcucuaagccacuccuuuccaggugggcuuugccacucaguccugucacugaccccauuuagaggagaaaauacugaugcucagagaggggaagucaccucaagcccuccucccauuagcccagcagcuguggcuucucuguucacacccuuuaccccugcuucaguuccagcucuguucucacaguugcagcuagucaguuaguggagcuucuaguccagggcuacgcagaggcgugcuuauaacagcgucuugaguugacacagcgaugacuagaauucaguauccuagcucuccccucaugcuuuauuuuuuuuuacuuuauuuuauuuuauuuuuuuuuuauuuuuuuuuuuuuuuugguuuuucgagacaggguuucucuguauagcccuggcuguccuggaacucacucuguagaccaggguggccucgaacucagaaauccgccugccucugccucccgagugcugggauuaaaggcgugcgccaccacgcccggcgggcuuuauuuuauuuuuauuuuauuuuugagacagggucuuaccauguagcccaagucuugaguuuauagguccaucugccucugccucccuagugguagaacuaaaacaugcuugcuucauguguguguaguaaaagguuaccauuuguaaccuuguauuuuuccacucguccacuuuguucccagaaauaacaacucugagauuuauauauaaauaaaagcuuaggccaauagcuuuggcucuauucccugacuagcucauaucuuaaucaccuguuuauuuuauucuaaguccugccacauagcugguuacccgguccucaguuucauacgacugccuuuuguuucugggguaaaaucuucugcaccugacuaguuucccagaauuccucugucucugccagaugucuccccuucuaaucuugccucagcucauuggccaaggcuuaagaaauaaaaaaugacagguaaauguuucuacacauugcacaauagauucccucuacaugugugucucugugaguucaaggccagcuuggucuacaaagugaauuccauuauagccagggcuacauaaagaaacccugccuugaaaaacuggggggagaaaaaaggaaaaccaaaaauaaguaaauuaaauaaaaauaaaaaggugcaaacauauuuguuuuuuuuaaacaauaauuuaaacaucaacuaaugaaaagauucuuccucuaaggcccuccuuuuucugccgcucuucccaacaagacgauggcugauaacagcagugacgaguacgaggaggacaauaaggugcgugcgcugugacccucagcuuccgcugacccggcucuggguguggucagugugagaaggcucugaguccgcaggaaccucuagugccugaguaccuuugggcuccuguaggaaagucaagaguagagucuugagaugauggcaucuucaggaaugaagccugcuguuguuauuuucugucagaugcuagcuaucaaagcuagaaugucacauucacuagcgagcccgucccugacacagacugucauuaaugcuggcucuuagugaggagcuucaucuaaaauguaacagugcuguagacuuuauugauuaugagaaucaacuaggauguuugcucuuaaaaauaagaugccuugggcuggagagauggcuccaugacuaagagcaacugcuugcucuucuagaggaccuggguucaauucccagcccacaaaugacagcucacacuguaacuccaguuccagggaaucuaaugcugucucuggccucucuggacaccgggcaccaaggcugugcauuaacacacaugcaggcaaaacauccauacacauacaauaaaagaguaaaacacaguaauauagauuccuaguucccucccaaagucucaaagguccuaucucagaacuuauauuuuugauaagcagucuuagaaauucauauacuaagcaaguguuuagaauuacaaaaccaggcaggguuuuguuccuagcacuugcagugaugccaauauuuugugacuuuaaugucuuuucucuuuucuuuuucucucuuuuucuuuucuucucuucucuucucuucucuucucuucucuucucuuuccuuuccuucucuuuucuuucuuccuuccuuucuuccuuucuuucuuucuuucuuucuuuccuuuuuauauauauuucuguguggauuuuuuugauuuuuguuuuccaaaacaggauuucucuguguaauagcucuggcuguccugaaacucacuuuguggaccagguuggccuugaacucauagagauccacauacuucugucucccaagugcugggauuuuuuuuuaaagauuuauuuauuuauuuauuuauuauauauaaguacacuguagcugucuuuagacacaccagaagcaggcaucaaaucucauuacagaugguuaugagccaccauaugguuauugggaacugaacucaugaccucuggaagagcauucagugcucuuaaccacugagccaucucucuaacccccaaguacugggauuaaaggugaacaccaccacugccuggcucgacagccaauauuuuuguuuuugagacaggacucuauaaaacucuggcuguccuggaacucacuauguagacuaggcuggccucaaacuuacuuagagaaaccuauuccaucugccucugccuccugagugcuaaaauuaaaggcauguaccaccaugccagccugacagucaguauucuuaaaaguugccuguugccaaaacugccugggcugacaagaugguucaguagguaagggugcucacaccaagucugaccaccuaaauuugaucucugugacucccauccuggaaggaaggggaguuagaacaaguuguuucugcuuuccauacacaugcaugugcccacccuccucccauaaauacauaaaaauauaauaaaaacugcuuccuaugugaccaaggauaaguucuuaucaauuauaccaguauaucaauaaaguauauuaaauaaacucuacauuugugugguuagaaauagaauagauauuagaagucauaauauacuuuuauucauuauuagaggaaaauaugaccaaaaccaggucuuuuuugggaguucacaucacuaagacuggcuuuaaauuccugaucuuccuacuucuaccucucuagaguccagggauuacagguaugggcuaccaguuuaugugacaguuggaauugaacccagggcuucuucccuacuaacccucagaaacagaugcugggaagugaacgcaagaccucuggaaaagcagccagugcuuuuaacugcugagccauuucuccagccccuaaaagcuacuguaaaaagaggccaguuguccaccugucaugaccuaauggagggcaugccacaggcugugagcacagaggcaaagauaaggacccugucucaacugucucugcaagugcagacaccuccaggcccucucucacggaccugagaggguagaauggagcauggccagccagaaacucaaacauaggcuauaaugucaagaacaaaggguucucuuauccugagcuagaauauauagucauuuucacucacagggaaggggucuguggacaaaccagauacacgaugaaggggguauugcugagcaagcauaugaagccccuacucuccagagcugcugcugugaauccaggcucagggcugauuguggacuuuauuccgcuaaucuuuucaucaccuuacucuaaguauucuuuuuuuuuaaagauuuauuuauuuaauguauaugaauacacuguagcugucuucaggcacaucacaauagggcauuggauuucauuacauaugguugugagccaccauguggcugcugggaauugaacucaggaccucuggaagagcaguccuaguacucuuaaccccugagccaucucuccagcccagcauucuugcaaucuuugagucucuacagucuuugaguacuaugagcuuauaaaguuugucuuccccacuucaucuauuuuuacuccccaauagucuugaguuguuaccucuuuccaauauucauuuauuuaauauuuaauuuuuaaaauuguguguguaucuuugcacaugagugcaggugcccauggagagaugagauccccugagcuggaguuauagcugggagguugucagcuaccugauggggguuuuggagccaaauucuagucuucuguaagaacaguuugugcucauagccacugagcuaucuccagcccucuaugauuuauuuuacucuuaguuauguauaaauggggacaugugguuaugugaaugugaguacaggugcccucagaguccagaggguccccuggaauggaguuccaggcaguuguaagccacuggacauggaugcuggguguucuuaacugaugagccauuucucuagccccaccacuguuuucuaaauuuuagagagugaggcuuuugcacaaaguuuaugcguagcuuccaagaucaaguaauacguucuuaagcauaagauggauagaauuuguaccauuucuaguaggcaacuaugguugaagaacauggaggucugcuuagaaggagaagguucucaggacucuggggacagggcucccuuucuggugacuugguggcaggcagugucugugggcacuaugagagcagugcagagucaggcauaggaacugaauuguucuuuauguaaccucuucccauccccuucccugccaggagaagaagaagcccucccagcugacaccgcagcagggcuucagugagaacgaugaugaugacgacgaugacuccucugagacggauuccgaugacgacgaugacgaugaggagcauggagcaccucuggaaggguaggaugacccugugccaagggaacauccuucaggaugcaguggaaggggcaugucugggaguagaucguagcauccguugaugcccgcuacuuaggguuucccuccuaucucaggagcgcggcacugugagcuuuuguucuuuucuggcuccacugccucgucuguccugugaugucacuucaacuaucugagacacuuguggaccuggcaaaucacaaaccuaaaacauugccucugccuuucaaggagccccugguucgggaaagaggaagugugcuuguacauaggccaaagcauuucuaucuaguggggcaaacugcauccacgcaagcguuuccaguuuaggcugagguccuuccuggacaggagagaaaagcuucagggccucacaucaaggccggguucuuggugacacuaaaaaaacaacaacaacaacagaucuuacucuguugcagccccacugacacagugagucauaauucauuucuguagguuauaaucagcaugcauucugaagaccaucauccauuuacacugggguauagcuugcucaguggucauguguuugccuggauaugugaggccgcagguuguauguauguacuuaggauugcacccuugcacacaaucauacauauaaaauaaaaaucuuuuaaaaaauguauaaaauagauuuagugauguuggacauggugacacagacccguaaucccaacacucaggaggcugaagccaggguauugaaagccuguagccagcaugagcuauauaagacccugucccaaaaaaacccaaggguugggucagauggccuagagggcaaaggcaccugccuccaagcuugagaacaugaguucauuccuugggaccccuaugguggaaggagagaaccgauucccucaagugggcucugaccuuuguauacauauuuauucucucauacacuguaucuuccucucaccuccaugugcauucucuggcaugugcacuuacacacacguguacauauaucacauuuauucacacaugugcgcauacauacucaaagauuuuuaaaaguuguggggccuggagagaugguuuagcaguuaagagcacuggcugcucuuacagaagaccuggguucaauucccagcacccauaugaccacucaaaauugucuaucuaaucccaggggaccugacauacucuucuggcuuccuuggguacaagguacaaauguaaugcagagucacacuuguaggcaaaacagccauacauguuuuuuuuaaaagcgcauggguuuccugcagcuuucuccuuuaguuaagagguaauugacagcuaacuauaaucauugucaaagcugccuuguaggcuaccaggaagguaguauguggcagggacagaaggcaggcuggaggucacgucccuauuagucagaucacacauggacuacaggccugcugccugugcucccgagggccacccugaccugcacgucuucuuccccagggcguaugauccugccgacuacgagcaucugccagucucggccgagaucaaggagcucuuugaguacaucagccgguaagcaugagagccgucuguccacaccucgccugccgugcccgggccuuuacacucucgagucugaagcagcaccaagcuccuuuggggcuuuuuagcccagucaaaugacauuuucugacugcuuccauuuucccucaacugccccuggcagguacacaccucaguugaucgaucuggaccacaaacugaaaccuuucauuccugauuuuaucccagcuguuggggauaucgaugcauuuuuaaagguacagauggugcauccuaaaaaauguguccccugggguugguuccaguuccucuauucuaaucguuccucuaguuucucuaaugagcauucacugccuuaauagugcucauugcauuggaguuccuccagauuccacucaguguguuaugugauacaguauucugugcuugucuccuaccuaaccgugaaguuagucccaugucugugcuucauauaucaugugaguucauucucaguagggcuuaguccagugaucuuagccuuucucugaaccaggugccacgucccgauggaaagccugaccaccuuggccucuugguguuagaugaaccaucgacaaagcagucggacccuaccgugcuuucgcugugguuaacagagaauuccaagcagcauaauauuacggugagccgcugguuuaaaggagggccuaggucagaggcugcacugccaucuuguauucaguugaucacugccuguuaaaggggguguagcuucagaccagcccggguuuuuagugauggcuuuauugagauacaguuuacauacugugagagucacauauguguccuuuuuuuuuuaagauuauguguauaggaguuuugcuugcaugcaugucuguguaucaucacauggauggcccauggaagccaaaagugagcugccauguugguacuaggaacugaaccuggguccucuauaagagcagccagugcuugcucuuagccucuaagccaucucucgaggccugagucacccuuuuaaauuagacaguucacuggcuuucagacguucauggcguuguaguaucaccuuuucucuucaguuagcacaguagucagggucaaagccauacuuuuccaugcuagcuaaaugcccuagcacugagcugagccccagcccugcaucacuccagaaagaagcccuauagauagcguacucuccucuuaauugcaguggccuucauuccuccucgugacuaugcaacacuccaucuguguauaagccacagugcauuuggucccaccaguuguucccacucuuguuaaugaugucacuggaacauucaagucuaagucuguguggcuugugugugauuucucuuggauguauguggagggaagggucacauugccauuuaguugcucuggcuagcauuuugaagaacugccaaaauguuuuuuugaauugguagcagcuuuuccggcaaugaauaagaauguaaacuucaccaaauccuuacuucacacuuggugauuggccuuuuaaauucuggucauuuaaagcaaauaggaaauggcaucucacuguggucagcauuccuugauaccacacauccuucccauggcuacaccagguuuuuuauguuuucuuuauuuuugagacaagaugucagguagccuaggcuagccuuaaucuugaucuuccugccucuaccucccaaguacuaggauuuagauggcagguguacaucaaugccuaauuaacaacucucuuucuuccucuucccuuccucccucucuccccuccuucucuccccuccuucucuccccuccgucucucccuuccuuucuuugucuuuucuuuuuucuguuuuuuugagcuaaggucugucuguguagcccuggcuugccuggaccgcacuauagaccagggugacuucaaacucacugaaaucuaccuaccucuccuuccaagugcugagaaaacccaacaaauagcacuucaccaauuaauuguuuuaaauuacuguccuagucugcuuucucuugcugugauaaacaucaugaccaaaucagcucgaggaggggaggguuaacuuggcucacaccucccaugucacagccacccagugaaagaagccacggcagggaccguaaggcaggaacugaagcagagccauggaagagugcugcuugcuggcuggucuuccugucuugcucagccugcuuucuuccacaaccaagacuaccugcuuaaggguggcauggcccacagugugcuaggggcuaugaaucaucaaccaaggaaaugcccacaaacuugcccgcagggcaguuuauggaggcaguuccucagcuguagccccaccucucagaugacgucaguuugcaucaacuugacauagaacaauaacacacacacacacagaagccccaaacaaccaacaguuguuuguuauuaguugauuuggguuucauuguaauguucuaaucauuguucuccuuauuuuuauagcaacauaugaaaguaaagagccuggaggaugcagagaagaaucccaaagccauugacaccuggauugagagcaucucugaguuacaccguuccaagcccccugcaacugugcacuacaccaggugacgauaacuacaggccacuauguagucuuggcugaccuccugccucucugccuccuccaugacaauaccuggcagagaacgacuucaccauuguaguuuauaguaagugucaccauuggugacccuuugcuuuugaggaaaggucaaaaccugggguaaacuggaucaaccugagguccuuaaaaaaaaauguacauuuacaucguaauucauguaacauaggaaaguuggcagcugcugcagauugcaggugcaaagaugagagcucucugcuaugguuacugagccagcugcuccaaaccaugcccugagaaauuugguuuuccagucuagggucucucccaggugaggaccugguuuagaaguggcuaaugucauugcucaaugagucugcuucauauuuucuucuccacuuuuaggcccaugcccgacauugacacucugaugcaggagugguccccggaauuugaagagcuccugggaaaggugagggggaaggaguaggaguaauacggcauccguccagggcccaggguuccucuuccuguuagcacucugacuuuuuaacggaaccggaacucaugagagagagagaugcguaucagaaagcuugaucacuuugccaacugaacguacuauauaaccagcacuaggugguaaacagcauccugccagccuuccagaaaccuccuucucucccccgccacggugaccauuguccuguuuuuuauuuucucuagcucuaaacagcucuucccccugcccauccucaggagcggagacugaaccaggaccucacaugugguagacaagugcucuaccaucgagcuaguuagagagucagcccucugcgcacacucuguguccuccucuucuccacgugacgagcuccacccgucuuguuccgugucuucucacccauuuccauaaguaaauugugcaccgugcuaugggcuguguguaggagacaguuaguuaucugaugagcaucuggaugguccccagcuuucaugugccucagugaugccgcugggacauuguaccuagcagugugcacagaccuuauugcuuuagaugcugcuuugucuagagauguuuauguucaucuaagaaauugacgucucauuuuuaaagauauuuaaauuuaaauuuuaucuauccagucuuuuucuuuuuuuuuuugucugccugucugucuuuugucugucuaagaaccacggcuuuccuggaggucagucaggcuccugcgugcuaggcaggcuccuuaccagcugagcugcauccuuuguccucuaguaagagaaaacauuuugagaccccucuucauuuuucuuuuagagacaggcucucacugaguauccuaaacuggaacugacuauauagcccagguuggccuccaaccauggcaauccuccugcuucagucuccugagugaugggauuacaggaugagccaccacacccaaguaaaaccagauuuuuugccuccuuuucuucaguaccauacaaacuaauagcuuucauuaugaugcguucacguauacuuacuugcucucaucaccucccuauuuguaaccuaugucccuuccacuuucauagcauggguauugucaucuuucucacucucccuuaaggccuuguuuuucccuucucaaggccccuuucuuguuucuuagccucuuccaacacuuaucccucauaaauacauauauaaaaauauuaacagcuagagaccgaaugugggcgaucauacugcuauuugucuuuccguuuuugucuuuauagcuacgugaaauuccguugucuauagguguccauuuucauuauccauucauuuguugguggacauguagacagaauccauugcuugcuauugugacuagagcaucaauagacauggcugagugagcgucucuggggcaggcauccuuugugugugugcccagcagcgguagagcugagacauguacggacauucuacguuuagguuuuagagaagccuccauacugaauccuaacacagcgcuuagcaguuuacauucucuuuuuguuuguuuguuuguuuguuuguuuguugagacaggguuucucuguguagcccuggguguccuggagcucacuuuguagaccaggcuggccucgaacucagaaaucugccugccucugccucccaagugcugggacuaaaggcgugcgcuaccacgcccgguaguuuacauucucaucagcugugaagaaggcuucucuuucccucacccagugguuguccucuguuuccucgacacuggccgcccugacuugugugagaucgaaguggaguaacuuugcuuuccuuagccauugaugagaugaauuuggguucauuuuugugagaaugagaaguguggaccuaacgucuuuuuuuuuucccccaguguuucgagacaggguuucucugugucgcccuccuuccuaguaucauucuuuauagguggauuugguuuugccaguucuauuuacugcacggcuuccuuuccagggccaggugcacuuccugucccuuuuggucugcacuguuuuguguggcaguacugugcuugcuuugucacuguggcucuguaguauaguuugcgguaagguaacuugacaccucuggcuguguuuuuugacuacuuugacugugguccuugaauucacaaacgaauuuuagaagugucuguccugcuugugugaagaaugcuauuggaauuuugguggggaucgcauugcaucuguauacuuuguccaguagugcagccauuuccccaggauuaauuagaauugugaggugagcacagacauugccgugguguacauguguagcgcaaaggaaacuuuguggagcugguuucuccuuccaccucuggggauugaacucaggguacaaggcuugcaaggccacuggcagcaauauauauucuuaaugguugagccaucuucccagacccuuuguuuauuuguuuguuugugacagucucucaauguagccccagauggucugaaacuuacuauguagaccaggcuauccuggaacucauagagaucuaucuacgaguucuaguucccaugugcugggauucaagggccuauguugagccuuuugacugugggccauccuauguuuccaccaggugagucugcccacugucgagaucgauugcagccuggcugaguacauugacaugaucugugguaagcgccuuucccagccccgccucuggcaucuguguucuaggccuuuggaagggcuuccuguucccuacacaguagugucuugguuugcagucuucacuggaagccagcugugccguuuacagccucuaguguggcguuggggcugaguaucaaaccucaaaguaauaugucccacuugggaggggcuggcauccacaacagaagggcccuagggccagagcuuguugguuuucaucccugcacgcgcuugucuguugcagcgauccuggacauuccuuucuauaagagccggauucagucucuccaccugcucuuuucccucuacucagaguucaagaacucccaggugagacaagaggcgugcucaccgcagcggcccugggcccugcugggguuguccucaccugggcagcagaggaggcuggggcggggaggugagaagcuggccuucagauggagcucagugaggacccacacaugcaaacaagcagcuucgggagugccagcaggaaggaaauagaacacggcuuuguguuugaaggagaugggcgcauugcugacccuuccaaagggaaaacuaaagugugagccuggaagccuggagucaaggagagagauuaagugguuguuuuguuuggagacaugucuaacugugguccaaguugacuuggaacucauaguguagcccagccuagcuuuagauucacagugauccuccugccucagucucccaacuguggagugacaggccugugccagcacacucaguuuaacuuaaagggauuuuaaagugguuuucuuuguuaaaaugcagcagccagcauauugcaaacauguccucuccuuucuugcagcauuuuaaagcucuugcugaaggcaaaaaaguauucaccccuccacccaacucugccucccaggcuggggaugcggagacacugacuuucaucugagccuccuccugggacugugcuucaaaguuagaugaagauguggucucuguuggcagcuuaaugucucccugcuccacagcugggcucugucaacaugaacccugcugccuuguccucgagggcagggcacaccuuguuuacaccugccucccguugccauuccagaggaaggauguagccacucugcugugggccucugaguuggaagaacugggacucugagagccccaggacacagguuggggacagagcuuccagagacacacagacugcucugucagguugugauggaauacauacugguuuucacccauggcuucuggcucauuagugucccauugcccugaugcucucuagagugaguagggucggguuggggccuuacagcaggccugccugugccucugagaaucauguccuucuauuugaccuucugcccuucuuucaccucccuuucuccccaagcagcccacaaccccgaaucuuuccccaaggcaaucauggacaucugcuccuacaaucuuacauucuuuuauuuuacuuuuguuuguguugugaggcagcaucuccuguagcccagcuuggcuucgaacuaucugugcaggcuggucuugaaggccugaucuucccgccuccaccucuaccucccagguaccaggccuucagguauauucagcaaacccaguuuauucuuaaauuuguugaccuaucuggauaauagaccaagacccucauuuagaugggcacuugccccuuaccagcaaggaagcaaacugaguaauuuccagaccucacuuggcaucccacccaaaccacagcauuagaucagaccauuuuugcccagucacaugccagcauagugguccagguuucagcuguuccuucgugugaugucuccauggaaacucaaaaggucaggccuuggagaguuuucagacagucagauacagggagguucccaaaagguggcaugcaucuuacacaucuuugugaauuuuaaaauaauuguauuuguuuuagacugguucucuguacagccgagaguggucuacaguucacuaugaagcucaggcguuacgaguucauuaucaccuuuugcuucuggguacuaggauuacaggccugagccaccgugcccacuguucaccccuucaccugcauccuuugaccaucuuucaugaaaaauugagaaaaguguuucucuagguucugcaauauguugaacuccgaggagcggguuguggggacgccugacuaaccacuggugguugagaggcacaggcaagagcguguggcuccagggagcacggcuguggcaguguuuggaggagcugcuuaagcgggguggaaguggaggagagauucaggagcaauuuggagugguaucaacugguucccagccaggaaaccugaaaccguucuagaguuuuguuggguuuuugucgcugucuucagacacaccagaagagagcaucggaucccauugcagaugguugugagccacuaugugguugcugggaauugaacucaggaccucuggaagagcagccagugcucugaacugcugagccaucucuccugccccauucuggauguuuuuaacaaaggacauuuaacacaacaauuuggugacaaaaguauggggaaggaacugacaagauggcacagcagguaaaggugcuugucacaaagcuuggccaccugaguucaaucccugggacucacaugguggaaggagaaaacuacuaaaacuuguguucuguaagccacgugcacuugcaugagcaugcacacacacauacacaugcgggcacacacacaguggugcaugguaguuuaaagguugguaucuaggagguggcuguggccagaugaugcugagggcagaggaggguugcagagccucaccuaccacugcagggacuuugagcaaagugguugcuuccucucaccuccucaccucccaugacagacaaaaaugcagaccaggaaucagaacccagcagcacaagaaugaggaauuuuccuuuguccacguggaagcucucagccccacccuuggaauuuuuauggggaccucauugcacaggcuugauugacuccaggacaaauacguagaaauaaaaccagacccaaagacugugauccaaagacccaaagauugcuaagaugcugggggcagaggguggggugggguggggcugggggacacccagcaaggccuguguuugguccuucaguauucccuccucugugagagacccgcuaagagaaccaaggaugacgcugagauauuuuaggcuuaagcaacugaauggguaaccgagccauguacugacagggagaaaguggugucacaauggauugcagggaaggcuccacugucagccugaccaacacacacacagacuguucaugagccuuacaaacucaaaccagcugugaucacgucaggcuuggggcuguguugcugccucauucugacacuaggccaggcucucugcuuucucaccauuagcguuagaguuugccuuauggggaguggaagugugcagugaucgcucagaugcuccgucagggcuccagggaacagaccgcuguagcuaccgcucuuauggucacuacuaguccacauuagacuaacagauacugaacugcugcucccggcggguacucaggugccugcugugugaucgaaaacauuuaauacagaaaagacuggcauggucccuacacaaggauaaugugauguggaaauucaugaagggguccauaaaacuuuuuuuuuucuguuugaaucugaaucuguuguauuuuguacagggcauuauccucuugcuacuuugugaauaaaucugcuuaaaaugu

SEQ ID NO: 5061 - RNA, 7528 nt, Mus musculus
uggggaagggguccugccgcggguccuuccgggggugacauucagccggcgguucggggagacguaccuuccaccuuagaccauggccaaguucauccguaacuucgcggagaaggcaccgucgaugguagccggugagcgcagcccgggagaggcucgcgaggggagggauugugcugcggcaccaaggggccgugggcgucgggagggcuuccaggaggccacuguaaggccgcagccucgccuggccugcccgcggcugcuuagagcucacaagcugcaggguccuagcucggccggggagcgagugggucguguaacucugcccggccucacuccgccgcgaacgccgugaugcccccuuaccgugccgggagaguugggaagggaggucgguaacaggggagagagaggucacacaucagaccucauagcuggucugcgucucagcgaaguauuugaaagccaucagaaauuuuaaagacgggugagagaucuuugaaaguuauguuugcuuaccauccugguuagagccuagagaauucugcguccgaugaagggaauuuggaacguaggggugaauauccccuccccagucagcacagaaagcgacgccugucagcagucgucuucagaaccuuggcuuggcauucgugagguuguuuuguuugaaaauucugauagaccgcggucucucagauaaacacugaguaguuauaagccugagcaguauguucaaucgauacaguucucuucugaguagaaaauuacuguauuuuugaagcaggagauuaaguuuacaauuucuucuuuucuguauuguauuaagugguugaagguccuauuuccaaauguucaaauuugguuaugaaaugugaauugaagguggauuuuuuuucaaagauuuauuuauuuuacuuaugugaguacacuagcuguuuucagacacaccagagaaggccauuggaucccauuacagaugguugugagucaccaugugguugcugggaauugaacucagcaccucuggaagagcagccagugcucuuauccgcugagccaucucuccagcccucugagguggaauuuuaaaaacuuguaauuuugagcuuuccaaccuguuugcauauuuaguaauucuuuuuuuucuccccuucaucaccagcuagugagcuauuuaaacccuuaaagugccagccagagucuauaaauacuggauuccuuccuauggaaccugaggcugccaauagcuguuuuccaaagaauuuccuuaguaaaaaaucauuaggugaucugaagcaacguacuacaauuuuuacaccaauacaaccaaaaggcuuugacguuuggacuuugaugguuugaggugcuauuuuuaauauuucguagagaguauuuuuccggccguaugacuuuugcaucuuuuagguagcuuguauucagaaauuuaaaacugauuuuauugaugaaauccaaaaugaaagacauuaucaagguaaacuuuggucaagaaacaacauaaaaccuuuccacuguuguaacuguaagauaacuuguucugccagaaguacugagaccugagggcucugagggaacagaagguuacguagacugugcucugcagcauaggcuggggcuuuuuuuuuuuuaagauuuauuuauuuauguaugugaguacacuauagcugucuccagacacaccagaagagggcgucagauccuauuacggaugguugugagccaccaugugauugcuggggauugaacucaggaccuuuggaagagcagccaucucuccagcccaggcugguguauuaagugugaauguuaaaguauuugauacugacuacugacuagaucuuucaguucccuagggcauguagcuagagaaagaagucaguaauuauuaucauaguucccccagaaaggugaaagucuauuuuuuuguuuuguuuuucuuuucccuuaacuaagcuauaaauuuuacuuauguuucacccgcuuuuccauucauauauuuugagucuacaaauauaggauauuaccuuagaacuaguuucuugugucugcaaucuccccuuucuuauaucugaucucuacuuucaugauuuggccacuuggaggugucugccuggauauuuugaagaauguucuccaaacugguuaucuuggguuucucuaaugauuagccuggaauuagggauuuuaagaacaagaaccacaggggcuggagagauggcucagugguuaagagcacugacugcucuuccagagguccugaguucaauucccagcagugacauaguggcucacagccaucuauaaugggauccgauguguauucauagaaaauaaaucaaucuuuaaaagaaaacaaaaaaaagaacaagaaccgccaggcgcacgccucuaaucccagcacuggggaggcagaggcaggcagauuuccgaguucgaggccagccuggucuacagagugaguuccaggacagccagggcuacacagagaaacccugucucagaaaaaaaaaaaaaaaaagaaaagaaaagaaaaggaaaaaaagagcaagaaccacagagacagaucacccugaugacauauuaagagaucugugguauucaugccaucuauugagcugacaaggucuuccacuauaaaacuacugcuugcacuuucugcacuuguuuuuauuuuuuggaggugucauacauuuguguaacaacuuuuauaaucauuuucaugugcacaccucccucuccuggaauucucagcaaauccaccucuuaccucuaucccccaccccucagaaaagaucauuauagcgacauacugguagugaccagccuuaugugucuacacccauucuuuacaagcaaguuaccagagcaggaggggugaguccauuuucuacauauaguaaguggaauuuugugaggaagaucuaucuuacucaauuucucucuuucucucucccucucuccuguuauuuuaauuguauauugcacuggcucuuuuacauucacuucauacuucuuguaucuaauucuaugucguuuacugcugagauugugcccaccuuggcagucuguagaucuuuuacguugguaccucugcccuuuuggcaugccuucuuaguuuuugguucuacaucauaagucaucuuuuuaucuuuuuucuuugcccagccuuacuuagccuugaccauuucuccaaggagccuugguaccuuuuauuaaacaauggaauucacaaauuaccgucuaggaucuggguuuguuccuugcugcuagaguccauuucaaaguccucucaguggacaggugucugaauuuaguuucauuugcuaugauaaaacaccaugacugggcuggagagauggcuuagcaguuaggagcacugacugcucuuccagagguccugaguucaauucccagcaaccacacgguggcucacaaaugggauccuaugccuucuggugugucugaggacagugaugguguacccacauauauaagauaaagucuuaaaacaaaaacaacaacaaaacccaccaugaccagaggcagugucguggggaggaguagcaucacccugagugaguugcauccucucgcaucagucaccaaggaagaaaaugcaccacagccaaacuaauagggguauuuucucaauucagguuccuuuuuugguuuuuugguuuugugugugugugguuuuuguuuuuguuuuguuuuguuuuguuuuguuuuuugaaagagaauuucucuguguagcauuggcuguccuggaaucacucuguagaccaggcuggccuugaacucagagauaugccugccugucucugccuccugggcacugggauuaaagaugagcaccaccacuacccaaccaguugaguaaggguccuucuuaccaaaugacucuagcuuucauuaaguugacacaaaacuagcgagcacagcagguauucagacauauaucuauaauuuuuuuuaaagauuuauuuauuuauuacauguaaguacacuguagcugucuucagacacuccagaagagggagucagaucucguuauggaugguuuugagccaccaugugguugcugggauuugaacuccagaccuuuggaagagcagucgggugcucuuacccacugagccaucucaccagcccauauaucuauaauugcauguuagucuauacauauaaauacuuguuucuagggcugaagagauggaucaguaguuaagaacucuugcuuaggaacuaaauaaauucaguucucugcaugagugugguggcucaccaccacaguucaaguuccagaggaucuggugcccucuucugacugcucugagcacuacacacauacagugcauccgacacaaaagacaagaaaucucuguggguuuguuuaagauuuauuuuauguaugugaguacacucuuucuguuuucagacacacuagaaaagggcauccaaucccauuacagaugguugugagccaucaugugguugcugggaauugaacucaaaaagacuuuuucagagcagucagaccuccuuuuuuuucccuauaaauauuuuauuuauuuguguuuagaaguugcaguuuuaguacuauuaacagaaaauacauaacaaaggcuuccuaaaagugaaaaaaauuauaaauguuggaaaaguuggccucauuaacauauuugcagacuuuuacuuaauacacacuccuuuggaacucacuuaugacauuuuuacaggcuuuaucacccgagucucugaguagugagcacuucagcucuuuacagucuccccgagacuguaaauaaauaagccaaaugguggcagcagagacagguagaucucugugaauuuaaggccagccuugucuacagaaugaguuccaggauggacaggguugcugagaaaccugcuuagaagaaaaaaugaaugaaugcaugcaugauuguuuuugugcccccacuauauacauacauauaauucuaaaauccagcagcaucagauuccugcccccucaccauacaucucuguuucuauauucguuucugucucugucugcuauaccuucaguccaagaucuugcacauguacuaccacugagccacauccccagacccuguguugaauuuguuacuauaucaucugcuaaauucauugauuuaaaauagugacuacaucaaagaauuucaguuuaaaagcaauucuuaaacucacagccucuguccucagcacuggaguuaaauaaaaggcaugagccaccauuacccagugcagaaucugauuuuaauuguucuuaacacuacauguaaauuuuauuuguauugagugcacuguuugaaaggugagcagcuguacucugguaagagagauuuaagccagcacauauugcuaaggauacaaaaaaacgaauggauacuaauugguguaauuccaucuggacuuguggccaauacugugaugagccucgaucuuauuguuagaagaaugcuauucuacacagcuucuuccccuucuggaccccuucucuucaaaaucugcuguuucuacaaagaacaauacgcuuuugucuuuguuugcaaaucuagcuacgaguaacuuuacauuuaauuagauuugccauucaaaggugaauaacaguacuagcuggccacuagugaguccugacauaauuaacagcuuagagcuuccugccuggcugagugucccugugacacagguguucugcaucuuuaaaagcuucuuguuaccagggagcagcagcucugacuuucacacugggugcacauucaguccaaacagugaguggaugugauacaugaauaaauauuuguguccagcccacacaucugcuucuuuccaucuccagugaguucauccugggguuucuguuuuguuuuguuuuguuuuccagcugccgugacuuacucgaagccucgauuggccacauuuuggcacuacgccaagguugagcugguucccccaaccccugcugaaaucccuacagcuauucagagugugaaaaaaaucauucaaagugcuaaaacugguagcuucaaacaccuuacaguuaagguaacuacgugcuaaaugaaaaaguauguuugugauugaaaaaauaucuucccugggaauauuuccaguucuuuugauuaauauauauauuuuccaauaaggcaaaguccaacauaaugagagcuuaucuuuuuuugacuaccaagaaaaaauuuucuucucucauuuugucaucuggauagaagugauccagcuguuguuugucuuggucuaguugugauuguagagcaaaaaggugaguguccugagagcugggaaccucacucuccuuccugaugucagcaaguaucuuauaauaugacacaguuuuccagcuuuguuuucuuuuuaguacuagaauuagcuccauuucagauaaugacaacuagaguuauuaggcagagcaaaaauaccaaaaucuggguuuucagauugcauguagauuaaauaccacgaguugaaacuuaacuuuuaaguacacccgauaucuaguaacugcuguggccagagccuuugccuggggaaggguggcagucaggagacgucauuagccucuggucuaccugaaggaggaaaaugacuuccaaaaaugcuauuauugcuaguaguaaaaagguccaguuuguuuauagaaggauuuuuuuuccuaacuagaguuuguaauucugaguuugugauuacaugaaacagugcuuccuagaaccaugugugguuugcuuuuguuuuucuuguuggucaagaauauaaaacggauacugaauauuuggaaaaaauuaaacuaaaugauggugaaagagggaagaagacagagcccuucaucuuagacagaaguaucuguucagagagaagccuuccuaugaaugccccaucuaaugugugagccacuuccaggaugugggguguuuuaggacccauaaaguaucucauaaauaauaaugaaaggguuaagucaguucagaaagaccuuuaaaaagcucuuugaaacaguuuauaagcucagguccguuugccucacaaaauugaaaguucaaggcucucaaguugaacauugaauaucaguaauuccuagcuugggcuaaaauuguucuguaguuuucaauggccuccguacauucucugagagagaacaguuuuaaauauguguuggguuuuuugauuguucauuuuuuaaaguaccuuaaaguuucugcuuuuuucuuuuccaggaagcugugcugaaugguuugguggccacugagguguggaugugguuuuauaucggagagaucauaggcaaacguggcauuguuggcuaugauguuugaagaccaaucuuuaacuucugauuugaguucuuauuugaauguucuuggaccauguguaacaggacugcuaucugaauaaaauacuagguguugaaaacacugcuguguuuucucugucaaguacugcagucauaguauuuccugagaguaag

SEQ ID NO: 5062 - RNA, 8956 nt, Mus musculus
auugaacauacugcucaggcuuauaacuacucaguguuuaucugagagaccgcggucuaucagaauuuucaaacaaaacaaccucacgaaugccaagccaagguucugaagacgacugcugacaggcgucgcuuucugugcugacuggggaggggauauucaccccuacguuccaaauucccuucaucggacgcagaauucucuaggcucuaaccaggaugguaagcaaacauaacuuucaaagaucucucacccgucuuuaaaauuucugauggcuuucaaauacuucgcugagacgcagaccagcuaugaggucugaugugugaccucucucuccccuguuaccgaccucccuucccaacucucccggcacgguaagggggcaucacggcguucgcggcggagugaggccgggcagaguuacacgacccacucgcuccccggccgagcuaggacccugcagcuugugagcucuaagcagccgcgggcaggccaggcgaggcugcggccuuacaguggccuccuggaagcccucccgacgcccacggccccuuggugccgcagcacaaucccuccccucgcgagccucucccgggcugcgcucaccggcuaccaucgacggugccuucuccgcgaaguuacggaugaacuuggccauggucuaagguggaagguacgucuccccgaaccgccggcugaaugucacccccggaaggacccgcggcaggaccccuuccccauuuccaaggucaggcugccccucucugugccuguucaaaacauauagguauugauucccuguuuguggcaucucauuagucaguuuacuuuguucacuccaaguaaaaaccuagauauaaaaaaaaaugaggcgcgauaacacgugaagaauccugagauuccucagggagcaggcauuacuugggacagcuauucauguugguccggaagaucggugaagugggggaaaugcgcaugcguuauugguuuucuuggcuugaucgccacauuagcuugcggcaguuuuauagcuuuucagaaaacauggaaaacgaggcuggagggcuucauaagaugcuugugggccuauacguucgcuuuaaaggcauagcaggucugaggucaaauaggagcuuuaaggggccacauaggcguuacauuaugugacucacccauucaccgacuucuuuaauugacuuuuuauaauuccguuuuccuccgcagccaguaucagaauugggauccaauccgguuuuucaaacaagccaguaggagcugugcggacaagaggaagaaagucauguguguugaggguguugcacugugccaggcauuuuguaauuugguggaagcaugcuuugggcauuauccccuuagagaccaagauuccuaaauagucauagaaggagucaguugcaagauaaauacgcaaaggaacauaagguuaagcguggugcugaucugggaaggcguagagauucuugguguauaagaaaauauacaaauuccaaaggcuguaacuuugacauuaugaaugaaaacaacaaaaacaaaccaggaaacccaaaaacuauguaggaaaguaacauuugaugaggagaacaaguucuggaaaagcccaaucuuuagaagaaaaacugaggggcuggagagauggcucagcauuaugagcacugacugcgcuuagguuaggaguucaaaucccaacaaccacaugguggcucacaaccaucugugaugagaucugaugcccucuucuggugugucugaagacagcgacaguguacuuacauauaauaauaaauacaucuuuuaaaacaaaacaaaaaaaaaccugaaguaaaauucauggggugguuagaaaaguuagaagugggaucaaggaaucagugagggagagacaugcugccuuagacagugaagucaaauuaaagcaggaaagauaaccugaaacccacauuauaccagcauacaggagccugaagauuggaaguuacaggccagucuggaccgagguaagacaggccagcuaauuaugaguaugaacaucugugacauuaacuagaaaagguuucaaacccuuagaaaccagauugcagcaaugaagaaauauggaagcaagagaauauaagucagacaacccaagaggaagguggagcucaggaguccaggacagggagacagcaaagaaggcagaggaguuuguuugggaauggugggaccucuuccuuaaacggggugaagggagaaaaguuuccaagugaggagucugacacaugccaccugugugaaaagggaguggugagcaaggcuacauuucagagugucugaaggacacagagaagagcagagaagggcagugguggagucgacuggucugugggcuguacaguugccuguaguuuagguagcagaggguaaugguuaaauuaaccuaagcugagauccugcaugccacagguaugggaauagaauaaggacaugguggcaaaguauuaaaaggucuguuauuuagguuggauagugaagccauaaaggaacuaauuagagucuaagcucuuaagacuuucucccgaagacagccggaggguaccucuagagcaguggcucucaaccuuccuaacgcugccacccuuuaauacaguuccucauguuaugaugaccccagccaugaaacgauuuuuuguugcuccuucauaauguaauguugcugcuguugugaacuguaaauguguguuuucugauggucuuagguaacucacagagaagcacugcucugaaggucuuuagugaggcguuaggucagccaggugauacacauuugcuggcacccugccuuugagaaacuggcaaaacccacuagguuuucagaaggacuugugaaacugucacucaucuuuucuuucugugguagugguacugggauuggauuuagcaauguaugugcuaggcaagcucuaccagacuuuccuuugaaaugucuugaugagaugccuggacuggcuuugaacucacuagguagccuugcccuucaauucucugucaccaguagugggaauuccaggcacacaccacaccaggcugccacuagcuuuccguacggcaaugaagaacuaacaagggugguaagucaggugcuuauuuauuaaauacaaguuuugagcacccucccccacccacccccacacacaggcaagucugacaaaaaguaacuuuccuggaaugucucaaauacaguugucuauugaguuugauuucaguuuaaccuuuuuugcuguuuuguucuucauuuucugucucuagcaucagucuggcuugucacaguacccaguaggcuuuggcuuugcccaauggcugcuuagcaaccagaaccaaauaaaguaaugaagcguuuagagugugguacugagcagcaacuggcacuuucaccugcaccguucguuaugcuacuucucaagugucccucaauuuucacacacccacggaaagcuauauuaaacaaacaaacaaacaacugccugaacucuaaacaauuuuccaaguuuaguauuagccucuuggugaggugugagccgacugaagucuucacuuuccuuuaguacuccagcaaagccgucauguaaaacucgguagucagaagucuuaacagauuuacagccgcugcagaguuccagacaagacacccuuugaccuuugcaaugcacauaugccucuuauuguaccaggauggaagucuuuagaguuucuuuuucuggaugccuuuaaauuaguucacagaaagaaagaaggcacagaggacacuugguuuccucaccacaguggccuuaagcuacacacgugcuuuugugauuaaaggaguucagcagcuuggguggcgucacggccauucauaggaaaguaucagaagaguuuaaaaacaaaacaaaacacaagcuugccaaaacaggcuuacaaucugacgguucaguucagaagcagaauacagacacuggaggcagcacggagcccauucacuagaaagcugcuggcaacagcugucuucucaaggguuuguacccaucuuccuccauuuuucacuugugaaacuugggucuucccucuuuuucaaauaagagcguaaaagcauccucccgcauucacucuggaaaaguaagagcagcagguagaagcuuauuucauaugcaguccauucccagagagggagaggagaaugcugcauacaggaaaugaaguucauuuaaaggaaagaaauccugucaacaucuagcuaaaugcccaggggcacacugagucugccuuaaccuuccggcauuuauagauaugcccgaggcuucccuguucacaacagguacauucuucaauagccagagugagaugcucucuaaucacaaguuuuccaguugacaccaacaagaaaaaacacacaaaggacugccuauagcagcuuguguuggaauacugaaacagcgcuuuugcauauguauacucuuuuguaacaguaauguucuguaaaagaagccacagccacauuuucuuguccuuuacaccucugggcugacacugauaugaaaacaucccgcagaggacugggccucuuagagcaaacaguugggagaagugggcagaaucacuuaguaacuacccagagagaaguauuuauuuaaaauggcuugcuuuaaugucuacuuuguuaauugauaaacuaaggcuagauaagaagcagcucuuagaagccaggucacagcccaaacacuagcuauguacauuguagucuuaggguuuuaccugacuagaacaagugagaaaacacugccaccaacuacauaaaucuuaccugggaagacacgauauaacguggcacucaagugagacuaauaaaaaaaggacacaguaucuguguuuaacacauauacacugagauauacuguuuuaaguguccuaaaaugacauuuucauguagauagaauauuuauugccuauuuuaccuaggccuagaccuuggagcacaaaagagaaaggggcccaauagcuucucauuuauccuuuuacugcaaguuccacacauuacugucacucacugaaagauugugcagcuauguuuuugguggugagauccucauaggaguguuuguugugaucguaucuuuaagugacaagauaauacaaaaguuguauaagauucccucaucuccaccagccaaaaaaaucuauacacacacuaagguauuugcauuuaucuggaaaguuacucuguaauauuacagagcuauauuaaggccagaugcuuaaguccagaccuuaugggcuaguaaauacacaggacaguaggauuuuuggauguuauuacugucauugaaguagcugacaucauagacuuaaaagcagugcucacuaaaaaaaaugucugaacaguacuugggaagggaaagaaaaaaauggcaggacauuuuuguuguuggacuuaauauaauuuaggauagaaaaggaaacaaggagaauaggaaaaccgaggcuaaaauuagugaugauuuauaaagaugcugugaggaagagaauuuucuauaagccagggaaagaacaaggucuuaagaaucauaauuaucauaauuugcacaagaacaauuuucuaauuuaaacaacaaagaaugaaauaaaccaaaauaaaaaacaaaaacaaacaaaaaaacccaaccuaacccaaaccaaaccccaacaaaacaaaucaaaacaaaucagaaaagaaaaagaagaggcucagagccaggggguggggggcaggaagagagcgagcgagcgagcacaagcaccagcucacgcccgggcgugcaugugcaguucacaguauuuauucaggcugcuccuuuuguugcuuccuuucugcgagccaccguuggauuuuuucuuucaguucuguguugggccggaucugguccaugguaaggggacuacgguuaaaaggaucuguuuggucacuaggacaagaaaagaaugaaaagugaguuacuucugaaaguucuaagacccuagggccaagcagagcaucugaacaucccacaugcgcugugacccaagacaugaugcacuauaacugaguccaaaacugacuccuggguuaggaagaaggaaaugaaaagggugcgauuugagucuucuucaguuucucugucucuaccucauaauaaaccuuauucaacugcauucagguuuuuguuuuauuucuguugucuuuuuuuuuuuuuuucaguguuuacacaauguuucucuggguagccuuggcuguccuggaacucacucuuuagaccaagcuggcuucgaacucaagagauccaccugcuucugccucccaagugcugagacuaaaggcgugcgccaccaccucccggcugucauucagauauugauccuagugguuuugcaagcuggagguggugguggugguggugguaauggcucagucauaagugcauugaaugcucuugauaaccuggauucaauuucuaguaccuauauggaguuucauaaccaucuguaauuuuaguuacaggggagucaaugucuuuuucugaccucugugagcacuaggcacacucaugguacaccuacauacauacagacaaaacacauguauaaguaaaauaaguaaauguuaucuuuguuaacagccuuuagauuucucuaaaucagaaauucuagacacuuguguuaucacaaaucauuuguagggguuucccccuuuuugaaaugggauuuuguuauauugcccaaguuggcuucaaauuccuaggcaccaauaaccuccccauguaaaucucccauacaguugagaaaaggccuuguaacagacauuugauuaaaguagcugacugcuauguaaguaaaugcagauuaugguucgaugccgagaguacagaucaguagcacagugcuggcucagcaugcacaaggucugauuccaagcacuacaaaaaaaacaaagcugggaccagcaauauggcucaauguguaaugauguuugcuggcaaggcugaagauccaaguuugaucuccaggacccacaaaguuggagaacuuacuccugcaaguugccuuaccucuacacuuucgaguacacauguguucauguguauacacacacacaccccaaacaaaugaacacauaaauaacugaauguaauuuaaaaauuguggcaaaaccaacaaagaaagacucaagacugccugagauauagcucagagugcagaggaauuuuaauacagcagcagggcugcucuggcaagagaucauaaaaccuucuaggccucugucaucuaacugggaaacagauacuccuuuaauccgaggagacugaggcaugcagaucuccgaacuuggucagucaguugggagucagugcagugcggugcagugcaguggaacugaguuuguucaugaauucauguaguucagugcaggugagcagaggcagcugaagucagagaguaagaaugagccagaguauuagagcauaaugcccaaguaaguauaaggccaagcagagcaauucagugagaagcugagagaagccagauugaaucagucagcuuggagaggacuuugagccugaacagcugaguugagccagccagccagagaucagaaagagcuagaaaaggugagcuuuuuuuuccccugcaguaagccuuggagaugacaauuucauuaggugaauaaaagauauuuuacaguagcgugcuugucuagcaugcacauagcccuaaguugugccccccaguaccacauaagccagggauggugauacaugucugugauuuuagcgcuuaggagggggagauagcaugaucaaaagccgagucuuccucagcuauagaguaagcuuaagccugggcuacacgaaacccugauuccaaaacaaaacaagaucacgauauccucaaagacugucuaaggucugagaucacuaagcuucucacugacauuucagcacaauagcauagugaaaguguaagagggcuggugagauggcucagcgguuaagagcgccgacugcucuuccaaagguccugaguucaaaucccagcaaccacaugguggcucacaaccaucuguaacaaaaucugaugcccucuucuggagugucugaauguacuuacauauaauaaauaaauaaaauauuaaaaaaaaaaaagaaaguguaggaauaccaauugaaacagaaaauucauuuaaugucaaaaaauuccuuaaaugucagucaacuuacguauauuuuaaauaggcaccaugucucucagcacccuucucuuucucuuuaagagagguaaagggugagucaggccaugguggauuugccuauaauccuaguacuuucuuguugcaggaggagcaggacuucaaggucacuucagcuaccaagugaauuugaagacagccugggcuacaugacguccugucuuuaaaaaacuggggccgagcagugguggcgcacgccuuuaaucccagcacuugggagguagagguaggcggauuucugaguuugaggccagccuggucuacagagugagugccaggacagccagggcuacacagagaaacccugucuugaaaaaucaagaaaaacaaacaaacaaacaaacaaacaaaaacaaaccccacaaaaacaaaucgccaaaaccccaaaacugggggcaggguagcuagcugggugcaguguuguuuaacuguaggccuaaguuuuuuaggaaugugaagcaguaagauugcuugagcggaguuugaggccagccuguguaacagcaugauccuauuguaaagauaaguaaguaacaaaguugggucagcaguugggaggacaugugugcucuuguaggggaccuggguuugguuccuaauacccacaaggugacacaaccaucuauaauuccaguugcaggggauuccauaucuucuucagacauc

SEQ ID NO: 5063 - RNA, 8956 nt, Mus musculus
gaugucugaagaagauauggaauccccugcaacuggaauuauagaugguugugucaccuuguggguauuaggaaccaaacccagguccccuacaagagcacacauguccucccaacugcugacccaacuuuguuacuuacuuaucuuuacaauaggaucaugcuguuacacaggcuggccucaaacuccgcucaagcaaucuuacugcuucacauuccuaaaaaacuuaggccuacaguuaaacaacacugcacccagcuagcuacccugcccccaguuuugggguuuuggcgauuuguuuuugugggguuuguuuuuguuuguuuguuuguuuguuuguuuuucuugauuuuucaagacaggguuucucuguguagcccuggcuguccuggcacucacucuguagaccaggcuggccucaaacucagaaauccgccuaccucuaccucccaagugcugggauuaaaggcgugcgccaccacugcucggccccaguuuuuuaaagacaggacgucauguagcccaggcugucuucaaauucacuugguagcugaagugaccuugaaguccugcuccuccugcaacaagaaaguacuaggauuauaggcaaauccaccauggccugacucacccuuuaccucucuuaaagagaaagagaagggugcugagagacauggugccuauuuaaaauauacguaaguugacugacauuuaaggaauuuuuugacauuaaaugaauuuucuguuucaauugguauuccuacacuuucuuuuuuuuuuuuaauauuuuauuuauuuauuauauguaaguacauucagacacuccagaagagggcaucagauuuuguuacagaugguugugagccaccaugugguugcugggauuugaacucaggaccuuuggaagagcagucggcgcucuuaaccgcugagccaucucaccagcccucuuacacuuucacuaugcuauugugcugaaaugucagugagaagcuuagugaucucagaccuuagacagucuuugaggauaucgugaucuuguuuuguuuuggaaucaggguuucguguagcccaggcuuaagcuuacucuauagcugaggaagacucggcuuuugaucaugcuaucucccccuccuaagcgcuaaaaucacagacauguaucaccaucccuggcuuaugugguacuggggggcacaacuuagggcuaugugcaugcuagacaagcacgcuacuguaaaauaucuuuuauucaccuaaugaaauugucaucuccaaggcuuacugcaggggaaaaaaaagcucaccuuuucuagcucuuucugaucucuggcuggcuggcucaacucagcuguucaggcucaaaguccucuccaagcugacugauucaaucuggcuucucucagcuucucacugaauugcucugcuuggccuuauacuuacuugggcauuaugcucuaauacucuggcucauucuuacucucugacuucagcugccucugcucaccugcacugaacuacaugaauucaugaacaaacucaguuccacugcacugcaccgcacugcacugacucccaacugacugaccaaguucggagaucugcaugccucagucuccucggauuaaaggaguaucuguuucccaguuagaugacagaggccuagaagguuuuaugaucucuugccagagcagcccugcugcuguauuaaaauuccucugcacucugagcuauaucucaggcagucuugagucuuucuuuguugguuuugccacaauuuuuaaauuacauucaguuauuuauguguucauuuguuugggguguguguguguauacacaugaacacauguguacucgaaaguguagagguaaggcaacuugcaggaguaaguucuccaacuuuguggguccuggagaucaaacuuggaucuucagccuugccagcaaacaucauuacacauugagccauauugcuggucccagcuuuguuuuuuuuguagugcuuggaaucagaccuugugcaugcugagccagcacugugcuacugaucuguacucucggcaucgaaccauaaucugcauuuacuuacauagcagucagcuacuuuaaucaaaugucuguuacaaggccuuuucucaacuguaugggagauuuacauggggagguuauuggugccuaggaauuugaagccaacuugggcaauauaacaaaaucccauuucaaaaagggggaaaccccuacaaaugauuugugauaacacaagugucuagaauuucugauuuagagaaaucuaaaggcuguuaacaaagauaacauuuacuuauuuuacuuauacauguguuuugucuguauguauguagguguaccaugagugugccuagugcucacagaggucagaaaaagacauugacuccccuguaacuaaaauuacagaugguuaugaaacuccauauagguacuagaaauugaauccagguuaucaagagcauucaaugcacuuaugacugagccauuaccaccaccaccaccaccaccuccagcuugcaaaaccacuaggaucaauaucugaaugacagccgggaggugguggcgcacgccuuuagucucagcacuugggaggcagaagcagguggaucucuugaguucgaagccagcuuggucuaaagagugaguuccaggacagccaaggcuacccagagaaacauuguguaaacacugaaaaaaaaaaaaaaagacaacagaaauaaaacaaaaaccugaaugcaguugaauaagguuuauuaugagguagagacagagaaacugaagaagacucaaaucgcacccuuuucauuuccuucuuccuaacccaggagucaguuuuggacucaguuauagugcaucaugucuugggucacagcgcaugugggauguucagaugcucugcuuggcccuagggucuuagaacuuucagaaguaacucacuuuucauucuuuucuuguccuagugaccaaacagauccuuuuaaccguaguccccuuaccauggaccagauccggcccaacacagaacugaaagaaaaaauccaacgguggcucgcagaaaggaagcaacaaaaggagcagccugaauaaauacugugaacugcacaugcacgcccgggcgugagcuggugcuugugcucgcucgcucgcucucuuccugccccccacccccuggcucugagccucuucuuuuucuuuucugauuuguuuugauuuguuuuguugggguuugguuuggguuagguuggguuuuuuuguuuguuuuuguuuuuuauuuugguuuauuucauucuuuguuguuuaaauuagaaaauuguucuugugcaaauuaugauaauuaugauucuuaagaccuuguucuuucccuggcuuauagaaaauucucuuccucacagcaucuuuauaaaucaucacuaauuuuagccucgguuuuccuauucuccuuguuuccuuuucuauccuaaauuauauuaaguccaacaacaaaaauguccugccauuuuuuucuuucccuucccaaguacuguucagacauuuuuuuuagugagcacugcuuuuaagucuaugaugucagcuacuucaaugacaguaauaacauccaaaaauccuacuguccuguguauuuacuagcccauaaggucuggacuuaagcaucuggccuuaauauagcucuguaauauuacagaguaacuuuccagauaaaugcaaauaccuuaguguguguauagauuuuuuuggcugguggagaugagggaaucuuauacaacuuuuguauuaucuugucacuuaaagauacgaucacaacaaacacuccuaugaggaucucaccaccaaaaacauagcugcacaaucuuucagugagugacaguaauguguggaacuugcaguaaaaggauaaaugagaagcuauugggccccuuucucuuuugugcuccaaggucuaggccuagguaaaauaggcaauaaauauucuaucuacaugaaaaugucauuuuaggacacuuaaaacaguauaucucaguguauauguguuaaacacagauacuguguccuuuuuuuauuagucucacuugagugccacguuauaucgugucuucccagguaagauuuauguaguugguggcaguguuuucucacuuguucuagucagguaaaacccuaagacuacaauguacauagcuaguguuugggcugugaccuggcuucuaagagcugcuucuuaucuagccuuaguuuaucaauuaacaaaguagacauuaaagcaagccauuuuaaauaaauacuucucucuggguaguuacuaagugauucugcccacuucucccaacuguuugcucuaagaggcccaguccucugcgggauguuuucauaucagugucagcccagagguguaaaggacaagaaaauguggcuguggcuucuuuuacagaacauuacuguuacaaaagaguauacauaugcaaaagcgcuguuucaguauuccaacacaagcugcuauaggcaguccuuuguguguuuuuucuuguuggugucaacuggaaaacuugugauuagagagcaucucacucuggcuauugaagaauguaccuguugugaacagggaagccucgggcauaucuauaaaugccggaagguuaaggcagacucagugugccccugggcauuuagcuagauguugacaggauuucuuuccuuuaaaugaacuucauuuccuguaugcagcauucuccucucccucucugggaauggacugcauaugaaauaagcuucuaccugcugcucuuacuuuuccagagugaaugcgggaggaugcuuuuacgcucuuauuugaaaaagagggaagacccaaguuucacaagugaaaaauggaggaagauggguacaaacccuugagaagacagcuguugccagcagcuuucuagugaaugggcuccgugcugccuccagugucuguauucugcuucugaacugaaccgucagauuguaagccuguuuuggcaagcuuguguuuuguuuuguuuuuaaacucuucugauacuuuccuaugaauggccgugacgccacccaagcugcugaacuccuuuaaucacaaaagcacguguguagcuuaaggccacuguggugaggaaaccaaguguccucugugccuucuuucuuucugugaacuaauuuaaaggcauccagaaaaagaaacucuaaagacuuccauccugguacaauaagaggcauaugugcauugcaaaggucaaagggugucuugucuggaacucugcagcggcuguaaaucuguuaagacuucugacuaccgaguuuuacaugacggcuuugcuggaguacuaaaggaaagugaagacuucagucggcucacaccucaccaagaggcuaauacuaaacuuggaaaauuguuuagaguucaggcaguuguuuguuuguuuguuuaauauagcuuuccgugggugugugaaaauugagggacacuugagaaguagcauaacgaacggugcaggugaaagugccaguugcugcucaguaccacacucuaaacgcuucauuacuuuauuugguucugguugcuaagcagccauugggcaaagccaaagccuacuggguacugugacaagccagacugaugcuagagacagaaaaugaagaacaaaacagcaaaaaagguuaaacugaaaucaaacucaauagacaacuguauuugagacauuccaggaaaguuacuuuuugucagacuugccugugugugggggugggugggggagggugcucaaaacuuguauuuaauaaauaagcaccugacuuaccacccuuguuaguucuucauugccguacggaaagcuaguggcagccugguguggugugugccuggaauucccacuacuggugacagagaauugaagggcaaggcuaccuagugaguucaaagccaguccaggcaucucaucaagacauuucaaaggaaagucugguagagcuugccuagcacauacauugcuaaauccaaucccaguaccacuaccacagaaagaaaagaugagugacaguuucacaaguccuucugaaaaccuaguggguuuugccaguuucucaaaggcagggugccagcaaauguguaucaccuggcugaccuaacgccucacuaaagaccuucagagcagugcuucucugugaguuaccuaagaccaucagaaaacacacauuuacaguucacaacagcagcaacauuacauuaugaaggagcaacaaaaaaucguuucauggcuggggucaucauaacaugaggaacuguauuaaaggguggcagcguuaggaagguugagagccacugcucuagagguacccuccggcugucuucgggagaaagucuuaagagcuuagacucuaauuaguuccuuuauggcuucacuauccaaccuaaauaacagaccuuuuaauacuuugccaccauguccuuauucuauucccauaccuguggcaugcaggaucucagcuuagguuaauuuaaccauuacccucugcuaccuaaacuacaggcaacuguacagcccacagaccagucgacuccaccacugcccuucucugcucuucucuguguccuucagacacucugaaauguagccuugcucaccacucccuuuucacacagguggcaugugucagacuccucacuuggaaacuuuucucccuucaccccguuuaaggaagaggucccaccauucccaaacaaacuccucugccuucuuugcugucucccuguccuggacuccugagcuccaccuuccucuuggguugucugacuuauauucucuugcuuccauauuucuucauugcugcaaucugguuucuaaggguuugaaaccuuuucuaguuaaugucacagauguucauacucauaauuagcuggccugucuuaccucgguccagacuggccuguaacuuccaaucuucaggcuccuguaugcugguauaauguggguuucagguuaucuuuccugcuuuaauuugacuucacugucuaaggcagcaugucucucccucacugauuccuugaucccacuucuaacuuuucuaaccaccccaugaauuuuacuucagguuuuuuuuuguuuuguuuuaaaagauguauuuauuauuauauguaaguacacugucgcugucuucagacacaccagaagagggcaucagaucucaucacagaugguugugagccaccaugugguuguugggauuugaacuccuaaccuaagcgcagucagugcucauaaugcugagccaucucuccagccccucaguuuuucuucuaaagauugggcuuuuccagaacuuguucuccucaucaaauguuacuuuccuacauaguuuuuggguuuccugguuuguuuuuguuguuuucauucauaaugucaaaguuacagccuuuggaauuuguauauuuucuuauacaccaagaaucucuacgccuucccagaucagcaccacgcuuaaccuuauguuccuuugcguauuuaucuugcaacugacuccuucuaugacuauuuaggaaucuuggucucuaaggggauaaugcccaaagcaugcuuccaccaaauuacaaaaugccuggcacagugcaacacccucaacacacaugacuuucuuccucuuguccgcacagcuccuacuggcuuguuugaaaaaccggauuggaucccaauucugauacuggcugcggaggaaaacggaauuauaaaaagucaauuaaagaagucggugaaugggugagucacauaauguaacgccuauguggccccuuaaagcuccuauuugaccucagaccugcuaugccuuuaaagcgaacguauaggcccacaagcaucuuaugaagcccuccagccucguuuuccauguuuucugaaaagcuauaaaacugccgcaagcuaauguggcgaucaagccaagaaaaccaauaacgcaugcgcauuucccccacuucaccgaucuuccggaccaacaugaauagcugucccaaguaaugccugcucccugaggaaucucaggauucuucacguguuaucgcgccucauuuuuuuuuauaucuagguuuuuacuuggagugaacaaaguaaacugacuaaugagaugccacaaacagggaaucaauaccuauauguuuugaacaggcacagagaggggcagccugaccuuggaaauggggaagggguccugccgcggguccuuccgggggugacauucagccggcgguucggggagacguaccuuccaccuuagaccauggccaaguucauccguaacuucgcggagaaggcaccgucgaugguagccggugagcgcagcccgggagaggcucgcgaggggagggauugugcugcggcaccaaggggccgugggcgucgggagggcuuccaggaggccacuguaaggccgcagccucgccuggccugcccgcggcugcuuagagcucacaagcugcaggguccuagcucggccggggagcgagugggucguguaacucugcccggccucacuccgccgcgaacgccgugaugcccccuuaccgugccgggagaguugggaagggaggucgguaacaggggagagagaggucacacaucagaccucauagcuggucugcgucucagcgaaguauuugaaagccaucagaaauuuuaaagacgggugagagaucuuugaaaguuauguuugcuuaccauccugguuagagccuagagaauucugcguccgaugaagggaauuuggaacguaggggugaauauccccuccccagucagcacagaaagcgacgccugucagcagucgucuucagaaccuuggcuuggcauucgugagguuguuuuguuugaaaauucugauagaccgcggucucucagauaaacacugaguaguuauaagccugagcaguauguucaau

SEQ ID NO: 5064 - RNA, 42476 nt, Mus musculus
caacaggcucggcgcucagcgaugaugucagcuccgguugccuugcugagucggaaguaagaaccuuuuggucgcuguagcugugaggugucgucgucccugcccuuucaggcuccgguaagaggcaagguauaagaggacgagaguguugaggcugcgacccgguuuucuccuaagcaauugccagucaaggccccugcaugccugcuguucucaacugcuugccugacccggguccgucuugaacuucgacccugucuaaucuggaaacccuuacggugcuccggcguccgguggcucugcacauucccuucuucuuugccaagucccugcuaggaaaggcccgagugugggcuguggcugucuuuugacuuauuuuaucuaggaccugcgcagggugggugggucucccugcugccuaugaauguuacugaaccccaaaggauaaaauacgaagagugaacgacagugccagaugccaaggagacaaaaugaagcucgacucauagcaaucaaaccaguagggugcguguagcaagagguugacuuuuaaagcgagugacggcuucccagcuguagcucuuuggauucugcucgaguuuuucuuggucgagaaaacauuucucagauugaccauagagucagacguuuuguguuuaguauuguuccuuuuaggauucuuuuuugucuccuagagcaagaauggguuaagucucaaugucauugacuuuuuuggucccagagacauaaaauggggcccaagaugaaaugccaggguuuguuagagacgguuuuguuuguuguguuguguucuuuuuuuguuuucggacguguaugugcuucacuugaugagauccuagcuugcagauaaacguauugcaaggauuuuuguuacgacaccuaauguaacacugaagguauuuccagguagacauguuacuuugggaacauuuuuaaauuccaaaauagagacuuuauggaguacaauuuaauacaguguaauuugggcuugggguagggaguugcugggguuauaaacuaagcccuggugcauacuaagugcucuagaacagagcuacacccaaccccaccuuagccauagaacuuggcuauagcaaucuguuuuucaguguuaccaauaguucuacuuuaaaacuggauuggacaugaucuuaaaauaucuguaugcucucaggagccaguaguggccuuaaaggauuagcagcacucuauauaaguagaagcuugagucaggagaaaaugagagaauuguauggguccaaugguugacacuuccuagagauguagacuuuugcagcagguauguaaagugaaguuacuuacuaaaaaugaaucaaauccaaaagccuugggggggcugguaguugugccaucccaaaagcuaucaagaaaguggauguguuucuguguggcaacugaaaacaaggaauuuggguuuauuauuacuauuacuguuucuuuuuaaagauaauuuuuuuaguuuugcuuaugucuccauauguguuucuguauauaugcaugccauaugugugcagcugcccacaaaaguaaaggguauuggauccccaagagcuguaguuacagaaaguuguaagcugcccgacaugggugcuagaaacuaaacugugguccucuaaaagaacagcaaguacucuuaaccacugagccauuucucuuucuuucucucucucucucucucccuaccuuccuucucuuccucucucucuuaaucucuuuguuucuuccccucucucacuuucuuucuuuccuauuaaagaaucuauuuuuuuauggauguguaccuguaagaguguguggaugcccacagagagcaggaguugucaggucccuggaguuggaguugcaggcauuugugagcugcccuguuucagguacugggauccagacucugguacucugguagagucauuucuucaaccucuuacuuauuuauuucugagucagggucucacuguguagcucaggcuggccuugacaucaagauccuccuguuuucacuucccaagugcaaggauuacagguaugcacuacucuacucaagcugggaaacuuaaaauagguagaguaaguauuaagccaaaccagguaucgaggguccauuucaccagaccuuucuuuucuuccuagguacuuuuauuuucauguguaagcucaaugacuaagucuaaccuggaucuccaccgagguucucaacaggugaucugugggcccucauuuuuuccuguaaguugucacaugauuuagccuugcuucuaaagaaggaaauucucuauaccuauuuuaaguagauacgagaacgaugacuucagugggguaggcaaaaccuuguuuuguuuguaacauucuuucuagucuucuuucuguugucauuauaaaccauucugaccaaaagcaacucaaaggaggaaaagaauuauuugugcacuugcaagucacaucccaucacugaggcgagucagggcaagaauucaagcaagaccuugaaguacaaccuauggaggaauguugcuugcuggcugaugcuuugcuugcuugcuuuuuuuuuuuuuuaagauuuauuuacuuauuuuauauaucuaaguacauugucacugucuucagacaccagaagguugugagccaccuugugguugcugggaauugaacucaggaccucuggaagaacacagucagugcucuuaaccagugagccaucucuccagccccauuagcuagccagucaagacaauucccccaaagaaaugucugaucugggcaaucucaaaccaggcuuuccccuaagaugacucuaggcuaugucaaguugacaguuaaagcugacuagggcagcauuugaggugauagcaggcuuauuuucauucucuguucuacauaugcauagguacugaagcgccacagugucuggccugggagcuuggccuguugcugcaucuccagauguaauaagucugugccuugaaguagaucucgaggaauggugugguguggcuacgugcagcucaggaguaaucacuuggaagacugagacugcccgugaacauuugcuuaagcguugugguuuggaggauaguuucagaaucagauaugaacuuguacuugaggguccuagaggcuagcacaguugaucugccaggagugcucuguggaaguuuuaaaauuccauuauaagcagggaaaagauguaauagaaaguuagcuuguguauauaauggaagagaauagaauuaaaaaggaagugaugccauuuguggugcuaagcccucucuccugauaguuuugagaauauguccuguucuuccugcuuucagcuuucuuuuuauauauaugcugcagaucauugucuccuaucuaaugagcuggaucauucaguuguauuuuuuuaaauauaaaauaacucaagccaggcauugcgauacaugccuguaaucuuagcacuuggagacugaggcagaagaaucacuguacauucaaggauagccugggcuacacagugaggcucgacuuuuuaauuaaaaaaauaaaauaaaauaaaaaggccuggagaugacuuaguggguggguaagaguugcuggugcacaaacagaacccgaguucaaauccucgacacccacauaaagagcuagauguguccacaaguauaccuguaacccuagcacuauggggaguagaaacaggaggauugguacugcuagcuggcuuucaucuugacucuaggaucaguaagcccccgucucaggggaauaaggaaaguaacagcaugggaucccuagcauccucuguuggccuccauacuucaugcauguacgccauguaccuguaucacacaugcauacacccuucacacuggcucacguaguuucagacuuugucuguacacaugugugccacacucucauaucacuguacacacauguacacguauacagacuucacaguggcucguauaguuaugcaguuagccugcauacaugugugcuacacacuuaugcaugcacaucacauuggcucaugugguuauggaauuugccuauauacacgugugcuacaaacuuuuauuguugacuuuuauaacugaaaagucuaaaauacucuguuuuccugucugguugcuuaauuuggagguagggauuuuauagaugguuuaaagguggcaacucugggcuugggcuuugcuaaccuagcaacugagaagaaaaagaguucucuauagggucagcccaaagacauuguucacugguucccauaagcuuugauagagguguugcccacucuuggauccaucacucuguccucucuggcccuccuggagcucauaggugaaaucagcacaucuggacauaugucuugacuggacuugguacucagcgaaaaacuaagugugucauauugagggagaagguggugauauuccgaagccaaagugacaagcgugcacuauacuucugccaucuuuuagaucucaggauacugugggguguugagaacagcaguagcuugcugacagugagacagcucagcauggcaucacgugcaucaggggcaaauuaaacuacccucugguugcauagguaaaagcccucucaagaacuguuaauuccaacauaaaguaugauaauuuuuguuaaaugugauuaaauauucauagccaaaaaagaaagaaaaagucgcugagucaucucuccaguuccagaucuguaguuuuaaaccuguaaguagaguuagguaacuuaauauggaugaaagacgcacaaaccuaacagcuaaucggauucuggccuugauucaguauuccaaaucugaguaucaagccaggcaugguaguacauguuuguaauccuagcauuagguggaggcagaaggauuaggaguucaagguccuccccaccuacagagggaauuuguggcccaccuacauaauaugaaaaccugccuuuuagaaaagagaagaaaaaggagcgagaaggggaggaagaggaaggggggaagaagaaaucaucgucaucaggguuucugugcgguuaaggaagcccagcuuccaccugagcuguagccggcugagcaggcgucacuuuguuuuccccaugugagugaaaauuagucugccagcuuaagaacuuaugggaaauccauaacuuuugucaugucacagugcuacaguagugcacuagucaagguuuaggcaauggaaacaugacagccagucggugcagucagugucuguugagccuugugaguuuuagcuguguccaguugguaagcugguaacugucuugccaaauaugucuugaguuugggaacaggaauuggcauguguuacuccaaagcaugguauucaaggaugggaaaaggaaagaugguggggauauuacagugaugguguuaucugcccuucugagucuaaugccuguccuuugcauagccgcuccccuagggcuggauggaggacaccuuaaagugaaaugacagaccaggagaauaacaacaacaucucaaguaaccccuuugcugcucuuuuuggcucccuggcugaugccaagcaguuugcagcaauccagaaagagcagcugaagcagcaguccgguaaguagaggagccaguagcagcagaugccgcuccuagaaccaggucugcccggaucuucccagaggaaggguucuuuaggaaaugaaccacaguuagaacuuaaguuuggugcugaaguuguuuugcuuuuauucucugucugucucuguuggugaaagcaaaaguuaguuugauguuaguuguggcucauuuuggggucuuccccucugcuguccucucacauaaagagagacuggcuaucaggugaguccacagggcucguagccaguugugaucccaaagcugucaaguuguuuagucaaagggggaaaagggucuguuaguagcuuuuuaacauggaagaccaagguggugugguaaacaggcugcacgcaguagagaaacuagagauuuuucugaccaaaaaaagaguuguuaauuccagcacuuuaaaugaccucucaggagaaguguaucuuugauucugcugaguggcccccuuuguagcucacugcuguuaggacagauugcugagaauugaauccuuugccuuaacaugaaaaaaggaaagacaaaacucagaauaaucucucacuagccagaaaaauggcuuuccucagguggagcugaauuuaacaucaagugcagcuucuuucuguacuguguuagaauacauuucuagcacacauugucccuggggauagucauaaucuuuuuuuuuuuaaagauuuauuuauuuauuuauuuguuuguuuguuuauuauaaguacacuguagcuguccucagacacuccagaagagggagucagaucucguuacggaugguugugagccaucaugugguugcugggauuugaacuccugaccuucagaagagcagucgggugcucuuacccacugagccaucucaccagccccauaaucuuuuuuuuuuaagauuuauuuuauuguaaaugcguauguacucuacauguacaccugcaugccagaagagggcauuggaucacauuacagaugguuuugagcuaccauauaguugcugggaauugaacucaggaccucuggaagaacagcuaguguuccugaccacugaguuauaaucuuuuaagccagaaaugaccaccucuucccaaaacaguggugguuuuuauuuuaauaaaaggaaaaauaauuuaugucuuugcuucauuuauuuacaaaguauauaguucaggggcaugcucggcuuuggucuugcuuuaugauugggauugaauaaacagaagaaaagcaagacagauagggaagaaagguuauagauaaagcaaaagaaaguaaaugcagggcuuuuuaacuggcuguaagcaggcucgaaagacuggagcugagagcauuauuagcagcaggcagugggaaugaggcaggcacacgcccaucuguuacuauuugcuaccuuaucaccuuaguuugucuacacugaguuccucaugccaccagguccaaccuguuugucaacagcaauuaguauucugccagaaccuuuggccuccuauucugagcucaggucugcucaacucacacauagaagcaucucuuacuucuaagagucugguccagauuuucagaaaaacauuuugccaagaaagaaaagcaguuguagacccacguaguuccuagugacuaucauuacacuuaucagagcauucuuuuuuuuuuuuuuuuuuuuguuuuuguuuuuguuuuucgagacaggguuucucuguauagcccuggcugugcuggaacucacuuuguagaccaggcuggccucgaacucagagauccaccuaccucugccucccgaguccugggauuaaaggcuugugccaccacgcccggcuuuaucagagcauucuugcaagugcccuccugagaggcagucuuugagguguucuauaaaacacuaaaggaauucaguugauaaggaaggaggggcuggaagacaaauguaaugaccaacuuaaauaucaaaugaugaaaguuucagucuuacuagucuauagaaaagugcccauuaaaucuaugguuaggggcuggugagaugguucaguagcuaaaggcccaagccugagguccugaguucagucccugggaccccccgugguggaaagacagaaaagacuccaacaaguuguccucugacuuugugugugcucaguagcaagcaugcaaccacacauacacucucuaaauaaaaguaauuuuuuaaaaaauuagauuuuuguuuguuuguuuaaaaugucauucucaucuuuauuuuuugucauaaacauguuuuaacagccccaguuuauguguauaacuauaacaucaaaagcaauacagucuuucuaaaaacuacucaauggucacuucaccuucaaauaauuauaaguagcaggguggaacaguguguuuccaugugcgcuagagguaacgaucaagaucaggacacagaaaacauugcucuacccuacaugccauacaucacaacaauaauccguaauuguuuuuuaaauggagguuugccuacaccugcaucaacaguaguaccagccccuagaacuuaaaaagcaaaaucucuucauaugcacaugaugaugaacuguccaccuaggaaaaugcacguagcaggauucgagcgguacuuggagcaugugaccagggcguuuuuucucagauuaaguaguuugaacauuuggggcacuuuacaguaacuagcauuaguggcaggcaucacccagugcaacauuucaaacagaagaugcucaaaacaugcuggcaguuuacucagauugguugguaugcuuacugaguggacccaugagugagaguaugauuucaggauccaguuaagguacaugaaccaagaacuugacuuaaaguaguucauguaacuauaccuccuuaaagaaagcuuguaagugccugguggaugucagauugcugguauaauguuaagagugaccaacagcaacccaaggcuuccaaaauguaauguuaaaacgccuccccuggaaggguuucaguagucugaaacauucacaccccaguggucaaacuccucccuaaagucuaaagcaguauaaggcgcuuccacgcucaggaauugugugacuguuuagcucuccucagaugaagccgugauugcuacagagguaccauaacuuaacaaguuagccuggaagccccaaaagagaacaggauuauugucaacuauaugaauagaacugucuaacguuuacaguccuggcucacuucaaccugcuuucagauaccuuaucaaucucaucuuuuguaucaagaggacauccgugcguccagacucccuuuggcccaguggcaccuauugcuacaucagugacagaaucaggagucacccaucucaggaucaugaggaagagauagaugggcacagccuauaaagcaaaacuagccuguaacuggaccacagugaggugagcugguucagccuccugugcaucggcagcauccaccauccucucgaacaccucaguucccucggccacguccugccagauggaaagcaccuuuacugcauuaugaauguuuucgggagcuggcaauguccccgacuucacuuggaaaauagcuuuuucuagcccuucacacaaagacuuuacugaagauucacauaaaauagaaagguucucuggaugcuaacaacuuguagaccacagcugguggcuuccaggaucaccgugcagaaggcuucagacaggaagguguuaagaaaagcaugucccugaauuaagacauuucugauauccuuguguucuaaagcucccaaaagcuacacacuguaucuuucccauacuucuaaacauuaaucuuugguccuucuccaacuaaacaaguuaacuggaggcauuucuggcagaauucagguaccauaccacugagcaguucgaucccuuuucuguaaaugaaucugcugaugacagccaauaguuauugcacugcugcaccuccuaagagguccugggucaguaggaucuaaagcguuaggagugacggacacucuaggauuuagugcugcuuauaguucaguguuuuccuuacuaguguaagaaacacaaauggugugcuuuaugucaccaagagacacagaagcuucguuuguaagcauagagcugaugucagcaaauucgaagagggaauagucugugaagauuguuuggagucuuggcauggaagagagagagcauuaugggcuauggcagaaaaugaacugugagaauagacaauuguaauucucuccugaacacuuggaguucugucacuuggaguucauucuacagucagcuuucuccuuagugaaggguaguaaugcucaaaugcuucccuuuacuuuuuuuuuuaaccuuccugugguuaggccucuccuccaugagugcccuccuuucaguauagacuccucuauucccauacugccucuggaauucuuuuuuucuuuuuuuuuuuuucuuuuugguuuuucgagacaggguuucacugugucacccuggcuguccuguaacucacucuguagaccaggcuggccucaaacucagaaaucugcccgccucugccucccgagugcugggauuaaaagcgugcaccaccacugcccagcucugccucuguaauuauaucaaauuuuauuaauaagaggggcauuuucucauacagcuaaguguagauaaaagcagucucucugagaauaacuuauguuaacuuucaaaauacuuaagcucuuuuaaaauguuuaaauuacauucaguguguguguguguguguguguguguguguguguguguguguguguguguguaagucagagcauaacuugccuguucaguucucuccuucuaccguguggguuccaaggacugaacuccaggcaccaagcuuggcagcaaacaccuuuauccucuaagugaucucauccacccagaagcucucaggcucuuugagccaguaguucuacuucaugaauuugucuuacaaaaugcucagcuaauugaacaaaaacaauuagauuacacucaguacugcauuacuuaagaucaugaaacccuggaacaguucucauguucaucugaugaaugaacagggaguuuaaguggcuacauaagucguaauaaaggcaagaaaugcaugacaauguaacuauuaaaagggauaaggcgggugggccugcuaguacaggccuggacucucagcuccucaggagacucaagcaggaggauaagaaguucaggccuuccuuacccacauaguuaguuucaggcuggccugggcaauaugagacacuuucugaaaaacaaaaaauagggccggaaauacaguucaguugguggaguucuugccuagcaagcacaaacccacauaaaaacagguguggagugcaucccuuugauucuaguaacuuggugguagagacgaggguuagaaagauuagaucaaccuuauggggaguuugaaaaaaacaggagcccauguuucuuuuguuguuguuguuugguuuuuggaggcaggguuucucuguauagcccuggcuauccugaaacucacucuguagaccaggcugaccucgaacucagaaauccaccugccucugccucccgagugcugggauuaaaggcguaagccaccucgcccgguuuaggagccccuguuucaaagaauacaaaacacacaaagaucuaauaaacagaaugaagaaggucucugaauuacuuacaggaaaaauuguugguguugauaaguuaaaacuaaagcuaguugagaggcuaaagagaugauccuguggcuaagaguacuggcugcucuuccagaaguccuggguucaauucccagcaccuacauggugucucacaaugaucuauaacuguaguccugugggacugaugcccucuucaguguccauacauguagacacaacaccauguacauaaaaauaaaccaguacaucuuuaaagcuaguugagggaugguaagauaugucaguggugaagacauggcuuccaguccugaugaccugagucaucaaaugcaugucauagcacauaagcauccaugcacauacaaaaauauaggggaaaugucuugacuaugguacugaucugucauuaaaaagauggacaauggcucagcauguagaucuccauacacagaaugcauacgcacacaucauuuaaaaaaugcaucuuaggaaaaaaaauacuccugaggagguggcucaacagguaaaggugccugaguaaaagucccaggacucauauggaaggaaaaaguuggcugcuacaggcuugugugucaucugaccgccacaaguauacuaacauguacugcccacgcacaaaauaagugucagagagggaggggcagcugagaagcacaacgggguuuuugauaaaaagcaaugguaaugaauaugagcacaggaguguggaacacugcagaacuaagcaguuaucuguagggaacugguucagggagcccuucuacaggauacaucccugagugccaaguuaacaaaacaaacguauucuuuagggaaaggccauacacuuaaaauaguuagagucauuugaucuacuugguaacucuuuucucuaagauuugggguuagguaaugcugcuaauuuugccagggagggguacaauugcaagucaaagugauaaaguguacuguauagaaggcaagauuuacagccaggauuuccaaauccuagaauacacuugccuggcuugaguugcucacuaaugagaugaauaauuuguuucacaucuacaauuguccuucuugugauucauucuagguaguguauuugguucugaggaagaagcguuguguaacagcuuacauguuccagcagaugagcucccagcaagcccagaugacucggauaauagugugucagagagccuggaugaguuugacuacucuguaucugagauuagccgcuccuuccggacacaccaagaaaugugugagcaacucaacaucaaucacaugauccagaggaucuuccucaucacccuggacaacagugaguugcaggcuuacaccauucaguaucuauucuucccucuuggcuugggcuagggacuacuuugguucuuagaaaacugcuaugucaggcuggagagauggcucaaugcuuaaaagcacugacugcucuuccagaggucauaagaucaauucccagcaaccacaucauggcucacaaccaucgcaaugggaucugauucccucuuuggguaugucugaagauauccacaguguauucauaugcauaaaauaauucuuuacaaaaaaaaaaaaaaaagaaaacagaaaacuucuauaucuaaugguuaaacccacuccuguauccccaaaacacaggguuuaccuuaguaaggcuuuaauuucuuaaaaacaguauuucaguagauggaauuucugcugccauguugaugucuguucuuccuuaaaagaggaggagaaagaguagcuaaacccguuuuccucuuggauggaugcugaaagggucaaaaggguuuuaccucugugcccuaucuguaauucaacccuaaacuuaaugcuggugucuggaauuuuuuccuaacuguccuacugagaauccgcacaguuuaugcuuuguaacuacuuugugcaucaagaucacugugauuauuucugaauucaagagacuuacuaucaagaacaguuguugaaagcugagcacagcaguauuugccuuuagucuccaggacuggggaggcagaggcagaagggaccacuugagccuaaguguugacuaccaagcuaggcaacauaaagacaaaaccagugucaugagaacaggagcauuguccauaaccugucagauggaaacuuucacaggugauccaagcuugaaaagcgggaauggcauccccagccguuguguguacuuggaagaaauggcaguagagcuggaagaucaagacuggcuugauaugagcaauguugagcagguaccuccugauaaugugcccucagcagaacagccaugcugaauccuguucauucuccugagagacuuugccucugucucuccauugucuguggcauugccuuuugaacucuuccuauccacccuggccacacauccagauucacccauuguuuaagaaccaguuaagaugucaucggaguuuccagaaaagagcugucauccccuccucugaguuccuuaucaucuacauuuuauuaugggaacugucacugucucuuguggcuuuuuaaugaaccugucuuauuacuccuguuagagucuuaaguuccuaagacaaggcccaccucuuuuuuacauacuuucaaaaacccaaaacuggucugggagauggugcacaaguuaggaugcccaucacccacugaagcuaaugguaccacaugggacaacaaucucagugcuagcagggagcgggaggagggagcagagugucucugcagacuugcugaucauccagcccggaugggaaauagugagcuccaggguuaaucagaguucaggggcaugaggccgagagugacagagcaggacacuccauguccucuggccucauuccaguccucagaagaucaacuacagaagacaacaucugucaaguacaaguguuuccuaggguaucagagcccacaauaaucagacuggguguuuaauuaaaaauaauaaagguuuuaaaauaucgagaggaaagacagaucacuuggcauuucacuuuuacacuucaagugucuuuguguccagcaggcacauggcagcguagauuuuacauguagguuucucacccaugcuucacaccauucagcauggaacuguuuggugccuacucugcugugacuaucccagacacuggagucuuaauuacaguaacaauggauauaauuaguuucuaacauuccugaauaagauuccccccaccccauuccaaacuacaucugauucuugccaaggcauguaucagacuucuuauaucuuagugcucuaggauuuaccuugugagcauuuuguuuauuuuucuuaauaggccaucuuugcucgauuauugcuucaagauccaggaaaccacuugaucagcaugacuuccuccacaacuuuaaaucucucugcugaucgugaugcaggagagaggcacaucuucuguuaccuuuacuccugcuuccagagagccaaggaagagguaaaugaauaagccccaugggauuuuaaauuaucuuaagugauguuagcaugugugagagagagagaguuggcucagugucuuucaugccauaauguguauuuuaugguauaucuggcacuauuagguugccaaaagucuuagucuccuuuuuguggcaugggguccaucucucuuugcaucuaacuaaugucuccuguucucuauacaaacuucucuagaaaucacaccuuuaaaaaaggaaaaaaaaaaaaaaaaaucaaccacaacaacaaaaaagaaaaccaaacaucaggucagcugauguaguagcacaugucuguaaaucucucagcugugugguagcacaugucugugaaucaugaggauugcuacucaugaggcacagacaaaugauugcuacaaguucagagcuagccuggucuacauauuuacacagugaguuccaggccagccuacacuuuguagugagaccaaaauaaaacaacaggaaccaaacaaauuccaaaucuucuaacauuucccaugagguggagauacuuaauugggcuucaggauuagaaguuuagcaugugagccugaaagccaaacuacaaaucugucaggaauuuucaguccccaagaaaucaauacugccaagugguggcggcacacacauuuuaucccagcacucaggaggcagaggcaggcagaucucugaguuugaggccagccuggucuauagaaugaguuccaggacagccaggacuauacagacagacccugucuggaaaaaacaaaagaaaagaaaccaauacgguuugggauauguuguuuuucuauccuguguacuguaccuacccuugcuccauguuauaaaagcuauaugcuuuucucucuucguugcagauuaccaaaguuccagaaaaccuacuccccuuugcagugcagugcagaaaccucacuguguccaacacucgaacaguucuccucaccccagagaucuauguugaccaaaacauccaugagcaacugguagauuugauguuggaagcuauucagggagcccgugaguauagaagcaaggucuuugacuaucugaauuuagaauaccaauuuaaaacuccucuaauggcgggcguuagagggucucagagucacuaugauucugacagaaguuaaggagggaagcuuacaccuugaucuuuaagccucaauacuagcagaauucucaaagauaccauagagggcuggagagacgacccagcaguuaagagcacuuuuagcugcccuuccagaggacccuaguucaguucucaucaccuacaugaaggcucacagcugcauguaacuucaguuccaggggauccacugcacucuucuggccccaaaggcacugccugcacuugguacaugcaugcaggcaaagcacccauccacauaaaauaaaaguaaauaaaucuugggaggcagaggcaggcagauuucugaguucgaggccagccuggucuacagagugaguuccaggacagccagggcuacacagagaaacccugucucgaaaaacaaaaacaaaacaacacaaaaaaguaaauaaaucucaaagaaccauuguugggaaguggguaucuaguucgcuggucagcaguaguggaacauugccuagcauugagcugagcaagucuucaguucagucgcugcaucacagcagagacagacagacagacagacagacagacagacagacagauagcaugaaaguguaaaugcauaaaaucugucacagccuccuucuuuucucgucugucuacuauuagauuuugaagauguaacugaauuuuuagaagaggucauugaagccuugcuguuggaugaggagguucgaacauuuccugaagucaugauuccaguguuugauauuuuacucagccgaauaaaagaucuggaacucugccagauccuccuguaugcauaucuggacauucuucucuauuucacuaggcagaaggauauggccaagguaggucucaaagcauuguauucucuuggugcuggcauuuuaauaaguugaugcuuccuguccugagggcacuagaacauugccuauagaaagccaagugugguauuacacgccuagaauccuagcauuugggaaguggcagaucaguguuauccucagcuacacagggaaguugaugccauuaggccagggcuggugagcugguccaguggguaaaggccauaaagucugaagagcuaaauuugauccccagaacccaugugguggaaggagaggaccaaccccuacauacaaguugucuucugaccuccacacuacacucaugguguacguauacacauacacacacacacacacacacacacacacacacacacacacuaaaggaguagauaaauaaauaaauguuuaaaaguuuucuguaguuugaggccagccuggauucuacaaaaccuggccuuuaaaggggguggggauuguauaagacuaaauucuuugagaccccugcaucuuaucgccuuucugucaucauacaguugaguaaauaggauuuuccuccugcagguguuuuuagaauacauucagcccaaggaucccagcaaugggcagauguaucagaagaccuugcugggagucauccugaauaucucgugcuuguuaaagacuccgggugugguagagaaccauggcuucuuccugaauccaucccguuccaguccucaggagaucaaaguacaggaggccaacauccaucagguggaaccgccucccagggugucugccacagccccugcuuugagaugaccaaggagccauguagggauaaggcugcuucauccugccuaggaaagcuaauuagucuggcuggcguuugucauaagaacauaacaaaauugcccccugauugagggugugggguggcacaugcuugucauccuagcacuuaagaaguaagagucagggggucauccugagcuacauagccaguacuaggcaaaccuacacuauaggagagagggucucaaaaauaauggaaggggcgggggugggggagugcacuucuuuaaucccagcacuugggggcagaggcaggcggaucuuugaguuccaggacagccagggcuacacagagaaacucugucucaaaaaaaaaagggggggggggcuugcagggggaggcagcaaagaaaucagccuugacacacaccuauuauaaucucagcagacagagacaaaggcaggcuuagucuacauggugaguuccaugacauguggaaaaauccugucucaaaaaaagaaaagaacagugucacugucuucaguccuucacuaaaaaggggaugaugguuggcgugggugagaucugcccagugugacagugcugcacaccccucaguucuugcccuucucgccaagacacugucgucacucagcucauaauccuuaugacgagagccaucuaucuuauaaaucuuccccuuccuccucuucaugcauaggccucuuaacagaauuuagcaguagucugaugaagaggcauagauggccaaacagggcacaguuaagugucccguuacuguuaagucaucacggugcugucaagcagguguuuagcagacuacaacaguggccaaacuaacugcccuugguguguguuuguuucuuauaaagaaggauuuacugggcccauggagcuggcucagugaguaaagaucuuaucauccagucugcugccucgaggcuguuccccagggccacacagcagagaaucugcucccauacgugcucauacaugcuuccuaguguguuacucccacauacaacuacacugacacugaauaaauguaauauaaaaacuaaaaacacuuauugacuauagccaugucuaucuguuccauuuauggcucaguaucauacuacagugguagaggugaguaaugcugugacaaccauuugaaaaauugagccgaaggauuuaucaccuaacacuguaccaaaaaucccuacugugaaaccuauuaaaucugugcaauauggcagcugaccagaaaaggucuccuaaguauccaguaauacauauaauaucuaugacguguaaauaaacauauaucagaaucagaaaaucagguacaaaaggggaaaagggaaagguuaagauuagcauuuauuuaaaaaccuguauuugcuggggcuuaggaguaaaaaagaaaauaccaggauugugaaauuggaauguucugugguuguguuuucuggcuaaacaguucauggcucaguuccaugaaaagaucuaccagaugcugaagaacuugcuccagcucucuccagaaaccaagcacuguaucuuguucuggcuuggaaacuguuugcaugcaaaugcaggccgcaccaagaucugggccaaucagaugcccgaaaucuucuuccaaauguaugccucggaugccuucuuucugaaucugggugcugcccuccugaagcugugccagccauucugcaagcccagauccucccggcuccucaccuuuaaccccacguacuguguccucaaggacuugaaugaugaagaacgaaaaauuaaaagugugcauaugagagguagguggggaacugggcucuucaaaacagugagugugucucaccucugaagcauuugcucccuuggccuuugagaaagugccccuuguucaaaacagaugagaacaaguuaaauaacauggaauuuugaaaaacagcaccuguuagcuuuuaaauguuaggccuuguugagaccuuccgucugauucuggcaaccuuggauauucauuuccucaucuuuuauaaagugcagucagauacagcugcuauccuucuugaacucagagguuccagaagagggcagacagguagguuaucaacauuuucuggacaacagcaguaugguugaacaaccaguucugcagagcugucgucuucaugucucaacagacaagucagaguuuaccaggcaaaggagcaggaguguagagacuagcugauguagagguggcagccuguggaagcagcagcacgcacugacuugacaggcagaggcagguagucuuggaguuggaggcuaucuagaaaaaaaaaucuauggaaagaauugauugaggaauagugagaaguuccuuguaguuagagcaagggacaggauugggcucugaagaguguggggugggaggaagaaagcuggcaccggacuggagaaaacgugaauauggagaagugaaaaggagugggcccugaucugucacucagaacaaaucucuuguugguuuugacugauuuccuucuagguuugggggcauuuuuuuuagccucuuauaaauuaacaaaaccaauaucugcacaaaaauaauuuaucuuaaaacacugaaaagcaaagaauaaguugaaauagccaaguaauaguagcccaugccuuuaaucucagccaccaagacacagagacaggugaaucuuugugaguuugaggccuggcugguugacagagcaaguuccuugaaaaccggagcuacacagagacucugucucgaaggaaggaaggacggacggacggacagacagaaagaggaaaaugucccauugccuaucacuuggaaaguauacaguauuaucacucaguuuagguuuuuugcugauuucauugguccagcaaaagagauuuagcuguuucuguagauaucaggaagccagaaaguguuuuuagacaaggaagucauuggagauauguuacaaggaagauauuguagaaauauggaggcugagggagaguggagcccaagaccgaugucuguggagagcaguccaucaccauuccuuuugcuucuucgagguuuggacaaggagaccugucugaucccagcugugcaggagccaacguucccccagagcuacaaccuugugacggagaaccuggcccugacagaguauaccuuguacuugggauuucacagguaacuccuuugaugucuuggaaaagaauggucccguuaguuguguugacagcuugaaggugggcagugagucugaagagcccuguuaggauggcacagggaagucacaugcacugguuuaaauuuaccugaguccacuuuguacggauuacuuacaggguuuuuuuuuuuuaaaucucucuuuaaaauuaacauuguacuaauauuuucuccacauuuugccaacuuuucaaucccugccuuuuuguuauuaucuaggaaaaucuaauuacugucauuuuacauuucacucuuuaccauugaguuauuacuucugauguccaaagaaagacaagagacaaacuuucauaaguugagagacugguguaagggacuccagauagacaauccgagcacauaagagcugcggaccugagaggacugcuucuaaagacaggaaggcugagagcuuguguagacguuccggaagcauccauuucuagcaaaccagccauaugccacuccacaguuuuucccuuuguugagcagagaaugguuuccaggauaaggaggagaaauaacaacuccuacaucucaucuguagaaagaguauuaugaauacugggguuuuuuuuuaauuggugggaacagggcacccaugcucaggugugauuuagaagccagagauuggggucagguggcuuucucagaugcucccccaccguaucuuuugagagaggaucuuucacugaaccuugagcucacugauugagcaagacuccaggauccuccuguuucugugucccggcauuaggaccgcagggcacaccagcacacucguguuuacaugggugcuggggaucuaaacacagguccccuugcucgcauaugcaagcaguuuaucaguugagccaucgccccagacccaggaauacugauaguuuuuuguuuauuuguuuguuuguucuuucguucaagacaggguuucucuguguagcuuuggcuauccuggaacgcacucuguagaccagacugccucuaccucuugagugcugagauuaacaguguaacaguguguaucacaugccuggccuggaauacugauuuuuuuaaugcauucucaggauacuuaaauuaauguaagguuuugggguuuuuuguuuuguuuuuucaacuccuccagcagaaaauucaugggggagggggaugaaaaugucuuuauuagacaguguuucugcccuguuguugacauuuuaaaugucacagaaguucaacaugugcuugaucugcucaacaaucuaaauucagaucuagaaaugccuggcaucuaguuuccuacugucacccuaguagcugucugcaagauccaaggaagugauuuaggauuguacauguagaaccaguugucaguagcuuuuaguucuaggucuucuuuucaauauuagagugaaauuuugugaagaauaauuaucuuauucuucagaaggcugggcgaugcucuuagguugugugccugaauauggcugcucuaggugugguuguuagaaucaagucuuuuucaccuacauaguuuucucacugugcaaagauuauccucugaccucaccaauguacucuaaagcuuguacugggcugcucauacucugcaucauuaaaaugucuguuuuccauaauaaccacacacucugcacccugcuccugugagaggccacucacucugcauaauuagcuucagauuuguugugcauaugguaacauuuucugagaacagugcaccuugcgucugaccagcugguaacuuuugugaguaccuucugugucauugacccugcaacuuucuacaaguauagaacacuauaaaaaacaaacaaggauuugcuuuucaguguggucuauacuacacugcccccacaugggccucccugaccuagucucuucugcuuucuugggggcagguugcaugaucagaugguaaaaaucaaccaaaaucugcaucggcugcagguugccuggcgggaugcucagcagaguucuagcccugcugcugacaaucuccgugagcaguucgaacgccugaugaccaucuaucucucuaccaagacugcuaugacugaaccccagaugcugcaaaacugucugaauuugcagguguccauggcuguucugcugguucaacuggccauaggcaaugagggcucccagccaauagaacuaaguuucccuuugccagauggcuacagcucuuuggcuuaugugccagguaagcagccugucccuuggaaacaaccuauuaauagccaccuaaguuuaacugggucaccuuggaagcuuaauccucaaaauagccuuccuuaguuaucauuucauuguuuuuagagaagcuacucaaacuuacaagaaucuccuggccaaaucauggggccccaguaguugcuucuccagcuuugugucccugauagugggacugucagaaaacagccugccagagaugaacugcagucaggguuuucacagcucuuagugucugucguuaauauuguuugacuuucaaagauucaacugccugucuaacccucccugaggguuuuugggguuuuuuguuuuguuuuguuuuuuuaggaaaaaaaaaauccccucuuacuaacucagaagggaaauuguguguauguaugucaguaaggggucaguaaauguuguucacuaaucagauuaaauguucuugaacacugugcuggucucauauugcuauguaacaaguuacuccccaaacauagcagcuuaaaacagcaaacacuaucucacacaguccucugcgucagaaauccuggagcacuuggccaugugauucuaucucagagugccaaugagguuauggucaagccgucagucagagccauagauucugaggacucaacgagggcuggaggaucuacuuacaagcccaguugacuaguugucaacgggccucagcugcuugccaauagccuaacacaucucuuagugucugccacucaugauguggcagcacaggugaccaaaaugaaaacugcaaacucucucaacuuaccuugaaaaugaugucucuacugcauacccccggguguguccccgucucgagcgaugaugauguccuucgcugcauacagcaggggacuuccuagucuagaaugaugcacaaagagacuuugcaaagaucucagugccaaaagggaaagcaguuagaggaccagccuggagguccuuauugcagucaccuaguguaacuagccacaccuaaaggguggcuuaaacuguggccaaccuauggaggcaugcagugcuaguguaaagaguccugugucacugcuguccaugcacuuccucagauaagaacagagcuugauacgcacguaagagauccuacugacuuaacaccaucccugguacauaaaagaguuaaacuuuuuuuuaaccuuuguuaauuuaugugaaggagguacugggauguuguuugagaccaaugaacagauguuuggcuaauuccagugaaucuuuuucagaauuuuuugcagauaacuugggugauuuccucauuuuccuccggcgcuuugcugaggacaucuuggagacgucagcagacucccuggagcauguccuucauuuuaucaccauuuucacuggaagcauagaaaggugaugugugggacacuugccccagucacuggcuagagccacaaacauucugccugcuguggugagguuuaauaagcagaggacuuugcucacagaauuugaaccugcauauaggguaccuaauaggauuccauugcuggucccugguuaaaauaguuaaccagaauaccagaagcuggaccaguggcugacagaugcugaacuuuuacuaauuaugucaaccaaagcugguuccugcagccggaguuggguaagcaguaaaccuggguuuauguuacuucuagccugcugguuugacuauguuuacgguguacuaugguuuuuagauuugcuuugggggggaggaguggaggguguuaugugugggggcuaaaggaaacaauuuuuaugcacaaaagggcacauuugcugcaaaaugaaaguccacaauucugccauacauaucaaugagaagccaacccuucacugagcugagcagaccuaaggggaaguuggccacaagccaacaggcauugauuagacucauaggacagggaucauggagcuaucagauaauuauaaccuaauuauuugcacucagaaaguguaggaaggcaaauuuauucaaaaugaaccugucaguacauaguaacuagugccuuguuauagagaaaauugaauguccuaagcauuccaugggaacuaaaguacucccucauacaugguuagcuguccucucgagaguuaagcagacaggcauaguaguguacaucuauaauuccagcacucaggaggcagagacaggaagaaugcugcagguucaaagccagccuggucugcauagggaguuccaggagagccaggacuauguaauaaaaccaucucaaaacauguuacaugguaucuccugcaccggaguacugacuuuccuauagugugacucuucuauauuuagcuccucauguagaguagaaucacaucaaggaguuauguccuccugcucaucgugcuuucugcccucugcagaaugaagaauccucaccugagggccaaacuagcagagguguuagaagcagugaugccucaccuagaccagaccccaagccccuugguguccaguguguuccaccggaaacguguguucugcaacuuuccauacgcuccccaacuugcagaagcuuugaucaagguguuuguggacaucgaguuuacagguaaaggagucccgcagcucuagaaccgcucuagagcugagagcuaaggguuucacagcuuggucccugucgggugucacagaaaugccagccagcauuacuugaguacucacugugugccaggcuuaauggugggggcuugauuuuuacuaugucacuaaacuugucuaucugaaaaguuuaucuauauuguucucauuuuauauguaagaauauagaugcuaaaaauguuuuguuuguacauaucauacaccuaaaagugcuaaaaccagcucugucucacaaaauauaaauaaaaaacaucccaccugcauacauucuggaaaggcaagcaugaggaccugagauggagccuuaaaauacagguuuuaaaaagcugggugcagcaaugccuaccccuaauucaguucuagggaggcagagacaagacggugccuaggaaucuauggucaacaguccaggcaaaucauugacuucugcuuuaaugagagacugucucugaaacauaaaguggaagcaaggugguaguggcagaggcaggaggauuucucugaguuuagggacagccucaucucucgagugaguuccaggacagccagggcuacacagagaaacccugucucaaacaaacaacaacaaaagagagagcauuugaagaaggcacuugguguaggcuuucagccuccaugugagugcaugugcaagcccacacacauggacacacacacacaaacauguaugaacacauacccacaacauguauacauaaaaaaagaaagaaaagaguaccaguagacagcauugucucccucuucuguccugaucaccugaguuucaauuaagcagagcuuuaucugagcuaguagucaagacauguuaagcaguugcauaagagucuuuuuaaaggagauuucugccauuugguaacuuggacaauuaacauuuaaagaggcauuuagcauuuuauuagcuguucacauuucuguucugccuuugucucuuacuuaaccucuggguuucgauuucucccauauaaaaugagucaagggcuggugagauggcucaguggguaagagcacccgacugcucucccgaaggucaggaguucaaaucccagcaaccacaugguggcucauaaccaucuguaacaagaucugacgcccucuucuggagugucugaagacagcuacaguguacuuacauauaauaaauaaauaaaucuuuaaaaaaaauaaauaaauaaaaaauaaauaaaaugagucaaaaugaggagucacugacauaguaugugcuaaccugccccuaagaagcugcccagcagucauggugacgaugucacuguguggcuauacagccagagaauugcaauggaauacauuccaugaaucuaaaagugaagguuggaaaaggcuuggagagccaagcacagugauaccacauaccuguguaaucuuaacaucugagaggcagaggcagaaagacauaauuggaaacccuccuggagccaggugugguggcacucaacucuaaucccaacacucacgaggcagucauaggugaagcucugacagccuagucuguauagcaaguuccaggacagccaggguuucucaaaacaaaacaaagcaaagcaaaauaauuucaugcguguaaaaaauauuugaucauauccaccuccagcuccccuuccuacuuccucuggaaacucccaacauguucccuuucccuucccccauucacaucugcuccuucuuuugcccacaagccacugaaccuaguuggugcugccuguuggaauguugacugguuuuguuuuguucacaucaucauaugcagguaguuguagcuacagcuuggguuuuaucccacacaccccaaggagugugagcuggaggugcuccuagggaagauuuggcaacagccuugacauucagaguaaaaaaugcacacacauaagcuuguucucuauuagaccaccucagcugauuuuucauucucaccuuacuuuaaggggacccccaucaauuugaacagaaguuuaauuaccgccguccuauguaucccauccuaagauacaugugggggacagauugcuaucgggagagcauuaagguaagagagguuuucaugguacuaguugcuucaggucagccucaguaccauugguacaugauuuggcacuaaaauaucuucuucuugggcugggacuuacaggauuuggcugacuaugccucuaagaauuuagaagcuaugaaucccccacuguuccuccgauuucuuaaccuguuaaugaaugaugcuaucuuccuuuuggaugaagccauacagguaaaaaaagggaauauugcguguguuccuauaccauuuacagugaucucaaugaaaaaggcuucagaucaucaacacugguggcagugagguggugguggcagugggguggugguggcaguguuuguguuuuguuugguuucguugguguguguuugcuuaaauaaguucucucucacucuuuauccucagcugaccucaaacccauagggauccuuucaccuuagccucccagagcguuaggguugcagacaugaaccacuacaccuggcaaagaauauauuguuuugaccuuuuaauuauaauagaguaauccuugcucuagaacauuuagcacagcaccagugucuguguuauaauagugugcccgacacuugguccacagcuuuccuggcucaucguuucacuaugucaugggugguuccuuggaugagaguuuaaaagaugaucuuggagcuggagaaaucacuuaguggcuaggaacacuuaggacuuuuguagagaaccuggauucaaugcccagcaccuaagugacggcucacaaacaccuguaacucuaguucugaccccaucuucugaccgcuugcagacgaguggugcccauacauacauacacauauuuauuuaagugugauaaagccaaacuaagguguaucaaugggcaacaauacaggaaaaaaauuauaggaucuuccuuguggucagugacuaugagacuuucauuauuacaauagaguaccugagaaaaccaccuaaagaaggaaggauuguuucagcuccaaguugcauagguuuugguccaggcuuagcugugugcucugcguugggccugcagcagggcaggagcucggagugaccagcagugagccucaggaagaugaugcagguuaguuugaaggucgccuaccgggcagucagagcucucguugauaacccacuaaguaacuugugcuugcuuugugagaggggucuaccuccugaucuuuucauaauccugcacucugaaacuuaacauagguucucugaggaagugagaacaauuccuauuauaaacaucucuguuaagugaggacaauaugauuccgggcaugaggcagaucauuauuugcugcagcaguaaggugaugagaggugaggguuuuaaguauuuaugauucccucuggagagcaggcauauuuguagaaguuuaguuuugaaccuuguguguuguuuuauguuuuaggaaggauuccuuuuccugucauccugaugcuuuagcuuggcuuccacacacugcuccacugaugcuccuuuccauccggaucgcauccuagcucaggcaguuagcuagcaguuugcucaagcuaagacaaagcugaaggaggacacuauuauucucuuucccaaagucccuuagaguuuaguuuaauuuuacauucuguguguccacuugccacaguguacgugaggaggucagaggacagcuuaggggagucuguuuucuccuuucaccaugaggguucuggggccaacugcaggucaucagcuuugguaacaaguaccguagcccacugagccaucucgcugcuccuccccagguucuugagugucagcccugcacugacagaggcuucgcaucgucucaauuucccagcuggcugacuggguuuguuuuuugcuuuuuaagauuuauguauaugaguguuuuguuccauguauguaacuacacuacaugcaugcaggugcuugggcaggcuaaaagaguucauuguauuucuggaagcuagagucauagguuuuugugagcugccauaugugagaacaagugcucuuaaacgcugaaccacuucuccagcucuggauuuuuuuuguguuuguauuguuuuguuugaauuauguaggugcauauaaugccuacaaaggccaaaagaggauaucagauccccuggaacuggaguuaacaggugguugugaaccacaguguuggugcuagcaaucaagccuugcccuuuacaagagcagcaagagcuuguaaccacugagccuccuuuccaaacccagaugacuagauuuuaauuaagcccucuuaaaugucuuggcccuucaguugcauuucucuuaucugguguaucacauuucugguuuccauaguauuugagcaagauaaagauucagcagauugagaaagaccgaggagaaugggagagucugacaccagaagcccgccgagagaaagaggcaggucugcagauguuugggcagcuggcacgguuccauaacaucauguccaaugaaacaauugguacccuuuccuuccugacaucagguaagaacauaaggcaugccaucccccaaaauguagaaaucaaggucuccuucacugagggaucagcccagcucaaaauuaagaguguagaaucugggacgggaugcagcucagucuguagagugcuugccucaccugcaugaaagccugcaugguggcccacaccaggaaugccagcacucuggagacugaggcagggagauccaggacauccucaucuacagagaaagguccaggacaccuuaggaugcauaagacccuguccaaaagaaaauuggacucuggugauuguaauuuccacaucugagaccaaaacaaaucagagaaacuucaaaaaaaugaugguguucauuauugacaugccaaaaaauauaagcugguuuccugaaggagcugggaguauagauuagugauagagcacauacagagcauauacaaaacccugaguacagcccggcggugguggugcacgccuuuaaucccagcacucaggaggcagaggcaggcggauuucuaaguucgagaccagccuggucuacagagugaguuccaggacagccagagcuacacagagaaacccugucucaaaaaaccaaaaaacaaacaaacaaaaaacccugaguacaaucccuacuacccaaaaaaacucuguaaagaccaguuagccauuaacucuguguuuuuguauauguguguuugugcgcacacaugcacgcaugcuauaaaaacauaaauccaagcaugguaugauauccucuugggaaaugaagacagagaacucugagucccaggcuagccugagcuacauaguuccagcguguggcagauaaugacagaugagggagggaggaggauaaauaauuugcauucagugaauacauuuagugugcuagagcagccagagagcacgugugaaaagaaaucaucuaaugagaaaugcagaaauugacuuuuaaagcuuuuuaaaaacuuuuucaguucagggaaaucagagaagauaagguggccacaaaccaagagcaaaagccacaaaggacagaagacauuuuaaauauugaaaaugugacuuuaaaacuuuaaauauuuagugaaaggguuaaaaaaauaaacucaaggaacacucucauugaaguggaacagaaaaaaaaaugagauagaaaguagggaaggauaagaaaaugaaaacgaagucuuaaguccaagucaaaugugggacuuguggguaaaggccuuugccaccaagucuggcaaccuagguuugaucccugagacccacauggugacaggagagaauugacucccguaaguuguccucugacccacauacacuugcuguaacacauguaggugcacacaauaauguaguuuuuaaauauuuuaacagugucugugacuggguuaguagcuuuucguuuguuuguuuguuuguuuguuuguuuguuuguuuuucgagacaggguuucucuguguagcccuggcuguccaggaacucacucuguagaccaggcuggccucgaacucagaaauccgccugccucugccuccaaaugcuggaauuaaagaugugcaccaccaccacccagcugguaguaacuuuucuuuccuuucauuuauuuguuuuuugguuuuugcuugucugaauuuuuucuuuuuuuccauuuuuuauuagguauuuagcucauuuacauuuccaaugcuauaccaaaagucccccauacccacccaccccgaauuuuuuuuauugaaaaugcauuauguaauuaaaaauccucaaaggucuccaauaaaaugagauguaaggagaaaauuagagcugcauugagcuuuaagacuguggcuuucuuccagagaucaagucgcuguuugugcauccguuccuggccgagcgcaucaucuccaugcucaacuacuuccugcagcaccuggugggccccaagaugggugcccucaaagucaaggacuucagcgaauuugacuucaaaccucagcagcucguaucagacaucugcacuaucuacuuaaaucuuggguauuugagauugguguugagaaagccauagggaugcuaguauuuugauagcagaaugacugguuaggucuugugugaaaauagugggggaaggcaggcucauuucuagcugauagaugaaagacuccuccacaguacuaaauagauuuuaucuggcccauuggacauugcucaguauuuccaacauucugccuugaucugugcaaagauaaauauuacugguuauacuacuguuugugaaaauauuuuauggcuauggaauacuuuauaguacagaaaauuagaugggagccaaaggcauauggaucucugaguuuaaugcuagccaaagaaagaaaggaaauuaaaugucaagccagggagauggcucaguuaguaaaaugcuugccacacagacaugagugucugucugaguucagaucccuagaacccaccuaaaaagcuacaugugguagcauggacaauaaucccaguauugggacagcaaaaaccaguaagauuccugaaguauacuggacauucaaccucacaaaacugaugaauucuaggaucagugagagaccaugucucaaacacagucuugagaguaacugaggaaaacacccagcguugaucucuguccuucacacauauacagacauacuuaugcaugugcauauacacacacacacaccgcacagagagauacacauaguucacaagcgcacugguggcuuggaagugcugggaugguugucuguagcccaucugcuaucugcacauugacuguggucugaugcucaguuucuuucuaacacugaccuuucagggaugaggagaacuucugugccacugugcccaaagacggacguuccuauucuccgacucucuuugcacagacaguccguguccugaagaaaaucaauaagcccgggaauaugaucguggcuuucaguaacuuggcagagagaaucaaggugaggaagaggacagcuuguuuucucagauauucaguaaaaaacgccacagagacgcggagcagugguggcacacgccuuuaaucccagcacuugggaggcagaggcagguggauuucugaguucgaggccagccuggucuacagagugaguuccaggucagccagggcuacacagagaaacccugucucaaaaaaaaaaagaaaagaaaaaaaaagaaacgccacagagucacuucaacucugcugcuucugccccauuuccaggagcaagggguacugccuagaggcauuagaaacagacacuuccucuuggucagucaaugacuagagccgccgucuuacuaaauguuaccccugcccaggaagaauaaucgaagauguuuauaccaggugaaaagaauguguauuugugaaggcuuucuuuuuuuuuuaauuuauuuuuuuuaauuugguauuuucuucauuuacauuucaaaugcuaucucaaaagucccccagacccuccccccccacuccccuacccacccacucccacuucuuggcccugguguucccccauacugaggcauauaaaguuugcaagaccaaggggccucucuucccaaugauggccaucuucugauacauaugcagcuagagacacaagcuccggggucacugguuaguucauguuguuguuccaccuauaggguugcaaaccccuuuagcuccuuggguacuuucucuagcuccuccauugggggcccuguguuccauccaauagcugacugugagcauccacuucuguguuugccaggccccggcauagccucacaagagacagcuauaucaggguccuuucagcaaaaucuugcugguguaugcaguggugucagcguuuggagucugauuaugggauggauccccagguauggcagucucuaggugguccauccuuucgucucagcuccaaacuuuguuucuguaacuccuuccuugugaaggcuuucuuuagauuaacuuuuaugucccaguguuaugaaagauuugaaaaccuaguguaaaugcaaaagaacuuuauggaauaaaauucaggaggaagggcaaggcuuggugguacacggccauaaccuagcacucacccagcugagggaagaggauuccaaguucaagacuagugugggcaacauaaugaguuccuaacucaaaaucaguaaaaacugagcaaugaugaguagcuugcagacacugguuccuauggcuuuucucuguuccuuacauuucuacugaugguugguuuauacugaauguauuuuagagauuaaaauacucuguugugcucagcuaaucccuccaguuggacaauggaaaaacuccauuaggagugguggaaagaaaaaauacacggcacagacgucuaauaaaaaaaccuuccaggcugggcaguaguggcucacaccuuuacucccagcccuuggaaugcagaggcaggaagaucuuuugaguuccaggucagccagagcuacacacaaaaaaaaaacagcuccaaaaacaaaacaaaaaaaagaaaagaaaaagaucagucaauaccuuuuuuacaggugucaguuguucuucagugaguuucuucuuacaggauuuucugaguagccuuggcuguccuagacucacucuguagaccaggcuggccuugaccacagagaucugccugccucugacucccaagugcugguaugugccaccacugccaggcugaguuuguuuuuuguuuuuuauugagcugagcuuaugguuggccuacagcuuagccagauuaagcuguaaggaaguauaccagagucagaugucagagccuuuuaaauguauaaccugcuuguauuuaucagaaacugcuugcagcacaggcuaugugauuauucgacuaacagcccucccacccuuuccccuuucaaaugccagcagucacaccagaaugcuuaaagacauucccuucagccaugaugcccagcagcugagcucuacaacgugaucaugggcuugucuuugaaaagacaaaguggccgggcagugguggccaugccuuuaaucccagcacuugggagacagaggcaggcggauuucugaguucgaggccagccuggucuacagagugaguuccaggacagcuaggguuacacagaaaaauccugucucgaaaaaccaaaaaaaagaaaagaaaggaaaaaagaggggcuggagagauggcucaucgguuaagagcacugacugcucuuccaaaggucccaaguucaagucccagaaaccacaugguggcucacaaccaucugugacgagauuugacgcccucuucuggugugucugaggacaacuacagugugcuuacauauaauagaccuuuuuaaaagaaagaaaggaaaaaagacaaaaugaucugccucacugggacgguuacugaugaccaagauuaagguguaguaguuacuaagcagucugagagcugcaaggugagcucacuuuagagaccagcuaugguugccucagucucuugcagaccuccaacaacaagaggaggagacauaugcagacgccugugaugaguuccuggaucccaucaugagcacacugaugucugacccuguggugcuuccaucuuccagagucacuguggacagauccaccauugcuaggcauuuacucagguaugcccacucacagagccgccucagaacuacaucuguguuagcuuccuaugucugcacucugcacaguggguaccccauacgguagacucauugguggagcauuuugauaucaccuguuuauaacuuuaaagauuaagggaauagcucuuaccucuucccuccuugaguaaucuuagccaagcauggugacaggagcuuggaauugcacuugaggacagaggcaggaagauugccauaacuuugaagcuaucaugguuuacauagcaaguuguaagcagccagagcuacauagugagacccugucucaaaaaauagaagaaaauaauuuuauccacauuaugaaauaucucaacaugaaauaugcucugaccugaaauuauuuuaauuguaaaaauaacagacuuuacacucccuucaguuacuauauuucuauuuuuugggagguaguuuguguaacauaaacucaccaagcugaaugcuguuuggacagucauccuucagauguccagagaaaaggcaggaaggcaaagguaagugaaagcuagucagcgcccaagcagccuuccuuucacuuuagaagaguauucugcagccugaagaagggacgcugcuaacaggaguuucaugcuugcagcccccuacagccaacuguuuguuucuuaauguuuuugagccgcacaugcauacuuagugucugcagaugucugaagaagauauggaauccccugcaacuggaauuauagaugguugugucaccuuguggguauuaggaaccaaacccagguccccuacaagagcacacauguccucccaacugcugacccaacuuuguuacuuacuuaucuuuacaauaggaucaugcuguuacacaggcuggccucaaacuccgcucaagcaaucuuacugcuucacauuccuaaaaaacuuaggccuacaguuaaacaacacugcacccagcuagcuacccugcccccaguuuugggguuuuggcgauuuguuuuugugggguuuguuuuuguuuguuuguuuguuuguuuguuuuucuugauuuuucaagacaggguuucucuguguagcccuggcuguccuggcacucacucuguagaccaggcuggccucaaacucagaaauccgccuaccucuaccucccaagugcugggauuaaaggcgugcgccaccacugcucggccccaguuuuuuaaagacaggacgucauguagcccaggcugucuucaaauucacuugguagcugaagugaccuugaaguccugcuccuccugcaacaagaaaguacuaggauuauaggcaaauccaccauggccugacucacccuuuaccucucuuaaagagaaagagaagggugcugagagacauggugccuauuuaaaauauacguaaguugacugacauuuaaggaauuuuuugacauuaaaugaauuuucuguuucaauugguauuccuacacuuucuuuuuuuuuuuuaauauuuuauuuauuuauuauauguaaguacauucagacacuccagaagagggcaucagauuuuguuacagaugguugugagccaccaugugguugcugggauuugaacucaggaccuuuggaagagcagucggcgcucuuaaccgcugagccaucucaccagcccucuuacacuuucacuaugcuauugugcugaaaugucagugagaagcuuagugaucucagaccuuagacagucuuugaggauaucgugaucuuguuuuguuuuggaaucaggguuucguguagcccaggcuuaagcuuacucuauagcugaggaagacucggcuuuugaucaugcuaucucccccuccuaagcgcuaaaaucacagacauguaucaccaucccuggcuuaugugguacuggggggcacaacuuagggcuaugugcaugcuagacaagcacgcuacuguaaaauaucuuuuauucaccuaaugaaauugucaucuccaaggcuuacugcaggggaaaaaaaagcucaccuuuucuagcucuuucugaucucuggcuggcuggcucaacucagcuguucaggcucaaaguccucuccaagcugacugauucaaucuggcuucucucagcuucucacugaauugcucugcuuggccuuauacuuacuugggcauuaugcucuaauacucuggcucauucuuacucucugacuucagcugccucugcucaccugcacugaacuacaugaauucaugaacaaacucaguuccacugcacugcaccgcacugcacugacucccaacugacugaccaaguucggagaucugcaugccucagucuccucggauuaaaggaguaucuguuucccaguuagaugacagaggccuagaagguuuuaugaucucuugccagagcagcccugcugcuguauuaaaauuccucugcacucugagcuauaucucaggcagucuugagucuuucuuuguugguuuugccacaauuuuuaaauuacauucaguuauuuauguguucauuuguuugggguguguguguguauacacaugaacacauguguacucgaaaguguagagguaaggcaacuugcaggaguaaguucuccaacuuuguggguccuggagaucaaacuuggaucuucagccuugccagcaaacaucauuacacauugagccauauugcuggucccagcuuuguuuuuuuuguagugcuuggaaucagaccuugugcaugcugagccagcacugugcuacugaucuguacucucggcaucgaaccauaaucugcauuuacuuacauagcagucagcuacuuuaaucaaaugucuguuacaaggccuuuucucaacuguaugggagauuuacauggggagguuauuggugccuaggaauuugaagccaacuugggcaauauaacaaaaucccauuucaaaaagggggaaaccccuacaaaugauuugugauaacacaagugucuagaauuucugauuuagagaaaucuaaaggcuguuaacaaagauaacauuuacuuauuuuacuuauacauguguuuugucuguauguauguagguguaccaugagugugccuagugcucacagaggucagaaaaagacauugacuccccuguaacuaaaauuacagaugguuaugaaacuccauauagguacuagaaauugaauccagguuaucaagagcauucaaugcacuuaugacugagccauuaccaccaccaccaccaccaccuccagcuugcaaaaccacuaggaucaauaucugaaugacagccgggaggugguggcgcacgccuuuagucucagcacuugggaggcagaagcagguggaucucuugaguucgaagccagcuuggucuaaagagugaguuccaggacagccaaggcuacccagagaaacauuguguaaacacugaaaaaaaaaaaaaaagacaacagaaauaaaacaaaaaccugaaugcaguugaauaagguuuauuaugagguagagacagagaaacugaagaagacucaaaucgcacccuuuucauuuccuucuuccuaacccaggagucaguuuuggacucaguuauagugcaucaugucuugggucacagcgcaugugggauguucagaugcucugcuuggcccuagggucuuagaacuuucagaaguaacucacuuuucauucuuuucuuguccuagugaccaaacagauccuuuuaaccguaguccccuuaccauggaccagauccggcccaacacagaacugaaagaaaaaauccaacgguggcucgcagaaaggaagcaacaaaaggagcagccugaauaaauacugugaacugcacaugcacgcccgggcgugagcuggugcuugugcucgcucgcucgcucucuuccugccccccacccccuggcucugagccucuucuuuuucuuuucugauuuguuuugauuuguuuuguugggguuugguuuggguuagguuggguuuuuuuguuuguuuuuguuuuuuauuuugguuuauuucauucuuuguuguuuaaauuagaaaauuguucuugugcaaauuaugauaauuaugauucuuaagaccuuguucuuucccuggcuuauagaaaauucucuuccucacagcaucuuuauaaaucaucacuaauuuuagccucgguuuuccuauucuccuuguuuccuuuucuauccuaaauuauauuaaguccaacaacaaaaauguccugccauuuuuuucuuucccuucccaaguacuguucagacauuuuuuuuagugagcacugcuuuuaagucuaugaugucagcuacuucaaugacaguaauaacauccaaaaauccuacuguccuguguauuuacuagcccauaaggucuggacuuaagcaucuggccuuaauauagcucuguaauauuacagaguaacuuuccagauaaaugcaaauaccuuaguguguguauagauuuuuuuggcugguggagaugagggaaucuuauacaacuuuuguauuaucuugucacuuaaagauacgaucacaacaaacacuccuaugaggaucucaccaccaaaaacauagcugcacaaucuuucagugagugacaguaauguguggaacuugcaguaaaaggauaaaugagaagcuauugggccccuuucucuuuugugcuccaaggucuaggccuagguaaaauaggcaauaaauauucuaucuacaugaaaaugucauuuuaggacacuuaaaacaguauaucucaguguauauguguuaaacacagauacuguguccuuuuuuuauuagucucacuugagugccacguuauaucgugucuucccagguaagauuuauguaguugguggcaguguuuucucacuuguucuagucagguaaaacccuaagacuacaauguacauagcuaguguuugggcugugaccuggcuucuaagagcugcuucuuaucuagccuuaguuuaucaauuaacaaaguagacauuaaagcaagccauuuuaaauaaauacuucucucuggguaguuacuaagugauucugcccacuucucccaacuguuugcucuaagaggcccaguccucugcgggauguuuucauaucagugucagcccagagguguaaaggacaagaaaauguggcuguggcuucuuuuacagaacauuacuguuacaaaagaguauacauaugcaaaagcgcuguuucaguauuccaacacaagcugcuauaggcaguccuuuguguguuuuuucuuguuggugucaacuggaaaacuugugauuagagagcaucucacucuggcuauugaagaauguaccuguugugaacagggaagccucgggcauaucuauaaaugccggaagguuaaggcagacucagugugccccugggcauuuagcuagauguugacaggauuucuuuccuuuaaaugaacuucauuuccuguaugcagcauucuccucucccucucugggaauggacugcauaugaaauaagcuucuaccugcugcucuuacuuuuccagagugaaugcgggaggaugcuuuuacgcucuuauuugaaaaagagggaagacccaaguuucacaagugaaaaauggaggaagauggguacaaacccuugagaagacagcuguugccagcagcuuucuagugaaugggcuccgugcugccuccagugucuguauucugcuucugaacugaaccgucagauuguaagccuguuuuggcaagcuuguguuuuguuuuguuuuuaaacucuucugauacuuuccuaugaauggccgugacgccacccaagcugcugaacuccuuuaaucacaaaagcacguguguagcuuaaggccacuguggugaggaaaccaaguguccucugugccuucuuucuuucugugaacuaauuuaaaggcauccagaaaaagaaacucuaaagacuuccauccugguacaauaagaggcauaugugcauugcaaaggucaaagggugucuugucuggaacucugcagcggcuguaaaucuguuaagacuucugacuaccgaguuuuacaugacggcuuugcuggaguacuaaaggaaagugaagacuucagucggcucacaccucaccaagaggcuaauacuaaacuuggaaaauuguuuagaguucaggcaguuguuuguuuguuuguuuaauauagcuuuccgugggugugugaaaauugagggacacuugagaaguagcauaacgaacggugcaggugaaagugccaguugcugcucaguaccacacucuaaacgcuucauuacuuuauuugguucugguugcuaagcagccauugggcaaagccaaagccuacuggguacugugacaagccagacugaugcuagagacagaaaaugaagaacaaaacagcaaaaaagguuaaacugaaaucaaacucaauagacaacuguauuugagacauuccaggaaaguuacuuuuugucagacuugccugugugugggggugggugggggagggugcucaaaacuuguauuuaauaaauaagcaccugacuuaccac

SEQ ID NO: 5065 - RNA, 3923 nt, Mus musculus
uggaguccagccagcuggcgcacucacccuggacgacuaggaugcucagcaguggaaagagagcgcagccacggccuccuacuguuccucuugccagcugcaucccgacagcucuuccgauacuuacacacccucuuuacgccucccggggaccaugcagguggugccggaagugacgucaugucgggagucaccuuugaaagagccgucccggacccaaccucaaucagggacaaggauuguuacuagaaucguacccgguuacccucaucagcgguucuuugacucucaggaggaucugauugcgcucuucugcuucagauuggcuacagacugaaaaaacaguucuauuuuuauggaauuccagggaaccaggcucgauccuccgacuguaauccagaaguuaucucucuagaauaucuaaguugaacccucacaaaagauucucauacauuugaaguucaggaaaacguaggcgaccauccaagaucagaauaaauauaucuuuuuuggguccuuugguaaauacgugcaagcgucgucauuuguguaccuuuuaauguagccauuacaucauucagaauuggauguuuauuaaauuacugcagugacagugaugaugaaaucauuacaguguguauuaaaggagaggaggaacuuggguuuguguaucuuugcauuuuaaaaguaaggauaucauuaucacgguacuugacguggaaugagacagucuaacaugcucugaaagaaaggguggaaaggaccccgcuuuacugguguaaucacucaauucuccuggacccgccaugguuaaugaaaguaaaagggaauaaaaagccucagcuuuuggaaauauuucauagcugacauuuuccauuggcauacuuuacuagacuuggaagccgguaguuuuuucuaugagaagaaucaagaguagaaaaacaaauauccuuguuucuaaaguucccaaacuaagucagguaggauggcaaaagccuguaaauccaagaucugcaagacuggggcagaagaacuaaggacaaccuggacuucagucguaagacucagauuaggguuagguccaagaaaugagucuuccaaaugugugcuaucauuuugcccauuucccaguccuccaaagcaauaugugaagccuauagaaauauaaaacuacuagaaauuaauuucaucaauuaaugauugcucugcgugucuaacucuacuaucuaccaagaaaacuugagcaaaguuaaacaucuucccuuguuuuccauuaacugcuguugugaauuuugcagauuuguuuguaagcaaauaauaaaaaucauaguucuuuauuacuaaggguuuauuuacacagugauucaugcauaauaaaaaauaaguuacaguacaaaaguacucuuaggaaggagacacugaacaagaaccugauaucccaugaguauucaaacaagacacaagcugcaaguucccuggagacauucucugugaguuuuuaacuacuucauuacaaauaugaaauauacacaggccaucuguuuaaagaaauauccaguuguuauauucacaagagaaaauauagcucuaacuuguagcuucaaaacuagguaucaaaauuuuagaccaggguaugguggaacaugcccuuauuccuagcacuagggaggcagaggcaguaggaucucugaguucaaggacagccuggucuacagagcaaguucuaggauagacagaacuauauaguagugagacccugucuuaauuuuuaagggggggggagggagagaaauaaaaacaaaaccuuuuuuaggcauuuuaaaaaguggaacaagauguauagaaugaauuucaagaccaaaauuuauauuuaaauuaugccaauuuguuuguaaagacuggguaaaauuacaagauccaauauguagaaauagaaucuuuuggaaauuccaguuuguuaaaaagaaauagucuguguggcccagucagugaagacuaaaccaucacaucgcaaagauucacccuggaccugaacuuuuagauggucucuguucuccaaacaaugcuagugugcacagaccauguaaccagacacaaagaagaaagccaucccucuucuuuccauaggccacuugaaaaguuugcuuuauacucaaauaaagggaaaaauaaaauugguuauuuccauuuagguagucuuuggcccauggcaaauucuccuuaaaguaaggugaauuaaaaccaaaaguauuuuaaauaaucucuuccaguucucacacauaagacugaaaaaaaaaauggucauuugcuuugaguuggccuucuucacaagucuauuuucuuuuaaaguuaucguguaucacgaagucuucuaauaaauugcuuaagggcuccagucugcaaaugaagagaauguugagcuggggguaaaagggagcacacagcaagcacgcugucugugcucauuacaaaccuacagucgggcuagauguggggguacacccuugagugaagcacuugagagcugaggcagggggugucucuagguuucaggccaacacugcauagucagcucuagagcagccagcacuacauagugagaaccugacuaaaaauaaauaaauaaauacaaaagugaugcugagagauucauccugguagcacuugcugguguccugguguucuugugaccuuuugucauuauugugcuuagauuugcgcugucaucuauaaaccuuggaauaauugacaaaacaauaaaccuaggauacugaaaaaaaaucaguaaaacaagauguuuccauuuaaagauagccaugaaaaucagacuuccugugugacuuuggauuuugguauuaaucaaaaguggcuggaaugguuagcucaucuuuuuaugacuuaauuuauuuuuaucuugggggggggguaucugccugcauguaucacaugcauucagugccugcagacaccagaagagagugucaccuccccuaaaacuggguacugaugguugugagccaccaaauggaugcugggaacugaacugggaucuucugcaagaggauagaugagcuaucucuucagaccccugagcacaccugugugcuguucuaaagaaacuaaaauaugagaagguauguucuggcagacaagcuaguuggcuucuuaccccucugaugcacagaaauaugggagucacacaccauaggaauguggaaggacaaauauguaaccucuugguuugcaaaagcuaacacacaauugcacucuggaauuagauagaaccguagcaacgaagguaagucugagucuaguagcucaggcagaacccaaagcugccaggcaggggcguugcucaucugggcagguuugugcugcagaaccuguaggacgacagacaggucaucgcuggaaacauuucuauugauuucaaggggugcugaugguguccucaaaaauccucagcuucuggaauacaaaaguuuaaaaagucaauguucuugagaagaaucuaagaggaauaccuggcagugccaucauccacuccuaauagaaauuugguuugguuuuuuuuuuuuugagacagaguauauaucgucugugauuucugacaggagauacaaauuuaaacaaauuuuaaaaaucucuguaucccaggcuggccuggucuuacacgcguucucgagacuggccaggaagaacacaacaaaccggaaucuucugcggcaaagcuuuauugcuuacaucuucaggagccagagagcaagagagcaagagagcaagagagcaagagcuuuauugcuuacaucuuuaggagccagagcgcaaaagagcaagagcgcaagagcaagagugcaagagugcaagagagcaagaaaaagaacaagaaagcaagagcaagagcaagagagagcaagaaagca

SEQ ID NO: 5066 - RNA, 12199 nt, Mus musculus
ggaaauaaagcuuccucaauguugcauaugucuuugaaguacauccgugcauuuucuuuuuuagcauuuaaccauuccuaccuugugguccuuggucccucaaucacccuuucccacagcccacccgccuaacgucacagucucugaaaaugcacagggaugccuggcuaccucgcccugccuucagucucacggggcucagucuguuuuucucuuuggguaaguuagaaccacaucugcaugcuccuaagggucagaagugcagcugcagcggaaagaggagggggcgggggagggggcaagagggaaggagugugagccgcuucccucuguguccuugggaaggggcgugcuggggaucugggacagcugggacugccggaugcugggcuucuccuucccagaaauguugacuagagggugaguguugcucggggaugaaaauggucaaauuuaucaagaggugguucauccuguagauuucccugaaguggacccauguggggguggggcagagcuaggcugcucugcggucucuucagggauuuuucucuucaccaccaccaccaccaccaccaccaccaccaccaccaccaccaccaccaucaucaucauguuuucauuuucaguuacuucccaagagaucucauaggaguugcuggcuucuuuaaaagucucauuugugagcccguucccugggaucugguggauuuaaaggagaucgcguucucgagaguugggggcagagaguugagccuaucccaccaauuuguugggaugcgugugggaggagguggguaucaggcuuaaggaccagcuccggguuggcaggagaggcaccagaguagcugcuaccgaggcaggcaccccuggugugaaccagauggaauggaugaggucaggugcccaggauccugggaaaaggagcaaacuguaaguggaaccuagggagaguuccuuuaaaaccagucuccgugguccagcccaaccuugcagaccacccugucguaaggucccaaagccaauuucauagcugaacaccuagagaccucguacuaggcagguauguuaggaggcuauuuguaggccugcuucccgacucuaccccaccccacaacccauaaggucucacuuuguagucuuggcugaucucgaacuuucagugauucuccugucucuuucucuuccugggugaugggauuacagacaagugccaccaugcugggcucuaaaccugccuuguggacaguuuuacucucacucuuaaaauucucucuguagugccugagggucaaguuuaaggaucuuaggugagauuaggucccacuauaagcucucucaaucugucugucucucuguugucucucuuucugucucuaugcuggucucugucucucugucccaccuucuguguccuuucucacugugcugggugguauauccccccucccucucaugcuggguauagggcccacagggauaacagagacaugaagcaauccugguaaccugcaagauaaagaucuaacaucuuucgucuuucggaacuggacccaaguuuaaaacuagcuuuguguuuuacucuauaaccaugggcgagacccuaccuaccccgagcgccacuucagcaucacugcucccaugggagacuggagacugucucuugcuuggugagcuugugaccuaacacacagcaggggccaacaugcuucccgugaacccuggcauggcauauuuugcuaagcccucacgcacagcaguuacuuguaguagauacugugaaucuauucauguucuaggguggaaacaaaggcacggugagguucaguaacuccuccaaucaggucaugugacuagcaugagagagcugagauuugaacucagaacugagauuuguaucuggcuuagcacauucuuuuaauauuggguucuacugcccccaauguucaggaagugguacuacucuguuggcauuaauuggucaagaguaucaaguacaggcuaaaagggggaguaggaggaagaucugaauuuaaaaaaaaaaaaaaaagccagagguggaggacagaucuccucucaggcacuggccacagccuccugucagauggaggcugucuauggcagccauauuuaagugaacaaggccagggcuuuggcaagaggaccagcgggccuggccuugagggagauggugccuuggaugcagacgccugcgcaugagggcugcaaggaggcaaugggaagaagugcauguuucagcaggucugugagaguggagaccuggagcuucgggaagcuguaaggaggcacgccucuggcaguccauucccucggcaacggaacuuggaugcuugcaguagcaguggucacugggaugcagggauaccaccgauuaggagggagagcguaucagaggcagguuacaugcggaugacuguaaagauggccaacagcuauucccacgacaagcuccaggguguuucucaagaccacgcguuuuucagccacuguccuggucaucaaggucugggcuguguuugaggggagcuuagagaguagagugugggcuuccguucaacccuacacauuugcugcuaagggcaggacuuagauuuggaggagaaugccuccucccugccuacccauaccccuggcaacaaaauuguauugagcacucaguaugugcuaugugccguucuggacucagggauagcaacacgaauaagaaggagcucaccagagccucuggagagacgcagguacauaagcaacagcgccucagcauugugugugcuaugagaauguugggcaugcuaaugcuggaggucaccuuuugcuaacagcugugugccaggcugagcuucgcacauagagcacgucacuuaauugccccauugaccuuagagggguuaguguccccuguauuacagaugaggacauugcagcacuggaacccuagugcacuugcccaagaucauaucaagaucucuagagucccaggcuugaacauccuaccacuuggccccugagucacuggaaguaauaggagccuggcugggagaggaucagacacuagggaagaugucaccuaagcugugcccuaugagugggguuugggguuuauguggaagaacuccagggaggacggcgagcaaaacuuccaaccuaaagcaaaagccugaacaaggccagguggaggggagggaagaggagacugggagauucggugucccuagagucccacgcaagggguggggccuggcaggagaugaggcugugaugugcagcugugccccagaugggaaaggccacccaggagcugcacccaggugccagaacucugcccuagaagcagcaggaagccacuggugucucggagguaggggaugggaguacagcuugguucuggcugccuggggaggagaucugggcaagagaaacugaguggagaggcgggagagcuagacaucacaugucccuuggaggcaggagcuauuagaagacaauucuccccaaccuccucuuaccccucccucccuuuuuaaaaaaucuucuuuuuuccuuaagaauaagacaaguguauagauuacuuuaggccuggaaggaggagaaaagggaauuuacuuccaagucuuuugaagagaguguuuggcagauaagccauguuucagggucucugcaugauugcccugggagaacaauggauggucagggccuaaaggacccagcugugucgaauacuggguugcugcaccccacuaucaucuuccuguaaguugggaaucaggaaaccuagaccucagaccugguaccagauaggacuuugguggaacccaaggcggaccauugucugcuggggauucugcaggagucagggacuggagccacuauguacaucuuaggacaccuugaacggacaguaaccagccccccaacccaacccauccccagcucuguguccucaccucagcccuguucggagccaggcggcauggauucagguucuaguuucuccucacuuucuucccugcugcugggacugguucguugacaucuguggccacuagagggcacacgaaucccaucuggcuccucuugcagagcacaugcagggggaacccgcauugcaccuuucucuguccccugccauuagccugaaaacgccucuggcuccccugcaacucugccaccugacguagcuggauccuucuagaugagauggggcgggagggagaugugagcugauguucaaacugggaaggaacaaggagaagaaagguggacuuuaccgagccaacuaguuucacagagcacuuguguggggagggguggcccugggaagguggaagcccuuucagggggaggggcuggauaggucggaaugcccgguauagaagguaaacugaggacaagccuccaucaguucuuucccucaaauuccucagccucugcagugugggggugguguuaauauuuucugcacaccucccucucgucuggcaccgggccagguacuuuuagacucgauaugaaagugcaagagcugagagccaggcuuuguuccucuugggaggagccccaucagcuuccccagcuggcguaaccccugugagcagcucugugcucaacuggagucauuggugagcagguguggucucuagacccgcccccaggcagggccuugguggggauuccaaggccagcaguccagagacccuccugauuuuagguuucgagcucugcaggcccuucacaagggugggugugcagugcagaagggugcuccggcagguuuagcuucucugcuugcaggcuguuguacuucugcuucugaagggagggccagcugguuugugggaaaacccaggauccuugcagccuggcuccuuagcuagagaucccggguaaauccaguccugaaguacccucaguccuagagacugccccaccucaccucuuagcucuuucuguccccaaagcagacguuaggagaaugcaguuaauagcagcugucauuugcugagcucucagcauuuacuuuagucacuauaagcacccagugacagugucaugaacuagguuugcuggaggaaggggcugaggcacagggauggggguggggguucggggguagggguggagaagucugcuuacauuucucauaguugaucggggcuacagcugggacggaagauaaguggaauuggggggacaugugucugcccacaucaguagcuauaaucuucacucagcuggcaccccaucgacugcaccccauccuuaaacccccccuaaaucaucccagaucccauguucugccccuuggccugguccuugcccagcucuaaucucaggucuucccaugcccugccuuguucuuucucagauguaugaaggucaaauccagccuuagaaauguggcccuugauguuccaugauggcucacuccuucucaaguucaaugcugucuggaugucauucuccagagccuuauuuccuggccacccuuaaacuccccucugccauauuuuauucuuauaucccaugucauguaacauuccagacggccauguuccuauuuucauucuugucccuuuaugcucccucaccagaauacaagccccaccacacagugguuaugccucauacuagugacaaguccuaggaucuaggacuaaacacaaccuggcacacaguagguaauuuacguguauuuaguaucgugaaugaaugagggcuagagaugugguucuguugguagagugccugccucuaccaauuuaaggacuuacauuugauucugagcagugaauaaacuggguggggguggggcacccuuauaaucccagcacucuggaaguggaaguaggcagguuaaaaguucaaggucauucuuagcuauauagcuaguuccaagauagccugggcuaccagaggaggccagccagauacaccccuccucgcaacacuccaaggccaaauguaaaaaucaaaccgaacaaaccagacaaacaaaaaaagccaugccccauaucacaaaacaaugaaaaugaaguggcacugucacugcuggggguuuugaugugagccauugcucuaacccugagcuaugccccugcccuguuaauacuaagcugaacuuuuagaaugaaguuuuaacagccuuggcagaugaucgauuguggaauuaaggucugggcuagucugaggcaguccugcagguaucuguggaguacuuucauggcuuugcagugcgugucucuguaacggcugggcccugggcugcucaccugugcucccucaucucugcucuacggaguauugugggggcacuucucucaguugcagcaccaggccuugaccucauccaguacuuccgagggauuucuguucccacccugccuccugccaaccugaaccaacucugcgccauagcguuuccaggucagcauuucccaaagggcagagcauccauguaggccggucagcaaguccucagaaugaaccucuucuuaugggacaccucuucuuucccgucugcccucuuucucgagccuggggauagucaguggcucgugcugggccaagggagagcgaggccuucccaggcucgcccaguuuuagcugccugccccaugggaacaacgacgcuuccccuagaugggcuuaaauaauaaucugaagcaaaaauaaucuggaguggauggagaaugggaaauggaggcaagcccagugaagccuuuggcagggaaauggcuucgggguggguagaggcaaggaaagggucugccuacaaugaacuuagaacaagcagaguccauuugacuguccauggccugguagacaauuugaugggucuguucuacacugguucuguuccucuucuccuccuaaggaccacaucuggugucccucaugcgcuucaccuuccuaacagcuguaaagagcccagccuauugccccuuaacuccucugucucucuccgucuguuccccauuggcuacagaaggguugcaacccuccaccugucaccaagcauccucaucagguugugguucuaucugcagugcccccggggcggagcauggaagucacagcgcccaccacucuuaguguccucaauggguccgauacccgccugcccuguaccuucaacuccugcuacaccgugaaccacaagcaguucucucuuaacuggacuuaccaggaguguaacaauugcacagaggagaugguaaguccugguggaggagggaguggagggaagcaaaacccccaaggcaugaagcccaccauccccaucccauccccacccccacccccacccccacccccaucccuaguccugcacuggaacagggccccaagaggacucuguguaggcuguuugauacagagguuaugaugucgccacaacuggaugggccuuccaggucuaaugcccuuccuucccauguuaagaaagaagaugcacaggaagaggguguguccccacaagccccauagccccuugcgcaugcucacacagcgcucauacuauuugccccuccccucccaguuccuccaguuccgaaugaagaucauuaaccugaagcuggagcgguuuggagaccgcguggaguucucagggaaccccaguaaguacgacgugucagugacucuaaagaacgugcagcuagaagacgaaggcauuuacaacugcuacauuaccaacccuccagaccgccaccgcggccacggcaagauuuaccugcagguccuucuagaagguaagagugacugaguugcugugggacacucaccguucucuacagcuuagcucagggcacuucaaggagccugugacucccaucucaucuucaggugcuuguccugguggaagacauccacaccuucccucuaaagggaacaagucagucacgauuaaaaccuucauuaugcccauuguauggaugaggaaacugagguucaagagcauacauuucuuaagauaacauaauuccuaacuucuauaauuagauuugagucugaucuuaauguccacgaguuaaauacuccauucuguggguagaggggccuuuugaagggggcaguggucuaguuugcuuugacuuucacuaaugcccuguccauggagaggaaucaaauaauauccccuccuauuuuggggagcaggggcgagauacggaauuuccuuuccagcucuaugauucugcuuccuuucccuuaguacccccagagcgggacuccacgguggcggucaucgugggugccucagugggggguuuccuggcuguggucaucuuggugcugaugguggucaaaugugugaggaggaaaaaagagcagaagcugagcacggaugaccugaagacugaagaggaaggcaagauggauggugagggcaacgcggaagauggcaccaaguaaccggaagccugcccugaagccccuccccgugcccuaucuccucucacucucugcccuguacagugugaccccgccugcucucucuuggugugcuucucuugaauaggaccccagaaucgaccuggggccucacuucccaugcccccaccccuauaccaagggugaucgcccucccuuucaucugaaaacugccuugguaucugagauucgggagucccagggagaacagagaagggcuguagccugucagucuuugaggaagaaagacuuguguggucccaaagacaggaugggggagggagggcagugggagaagaggucugcugaccaucuugucuaaggcuuggucugguggcgauuuaaacugugggaguagcagugugugugguggcgggguucugugcugaccagaggcaccaugggaaugacuugugaagauggcuagggaacagccaucagcuggagaugaaggugggguccuaccauuugugaaagcacuauuuaaagggaugacugugcauuuccaggguacucaaggaaaaaggaaagauagggcugagucguuucuggaugcgagccuuggcccagagaacucuguucuggccucguuucuaucacuagccacucccagagaggcucugguuacuguaggcugcugcuccaugggggaugcuggcgagagguaggauccuauccuacccuagggcugccccuuaagagaccugugaggaacugccgggugcaggcuucacugcauacacauggcugccuucucaaacaagaugcucaccuuggccucugcagcagccaucaacccucagaacugggguguguuugggggagcggaacuguguauaggggcaacuuccuguguggcuuuaguuuggggauuuucgagcaggguuucucugccuggcuuuuggcaagauggaagagaaagcuggaacgcuuuaaauaugagagcauaugcugaaggagccucugaacccugccccgcccccaccccacccccaccuccacccccaccccggaacucccuuuguacgggagaaagucacuccugugguaagccuacauucacugccguuuuacuaucauuauaagggacuuaaguccagagacauuuuacuaucauuauaagaaacuuguuauaaguccagagaugggagaaaggcaggguagaaauggcuaaucggagaguauccuguugggacgugcucagagaacuggcacaaagccuccugcagauggggagacugaaguuccaagugaccaacagaggcugaaagcauugcccauguucuggcuccuugguccucaguuagaacaaauagagcuuccuggugggagaaccucaagccuuggauguguuuugugcacaguaguggugggguucaucuagccccgcuccccuuccaggaacucaacccccacaagcucagggaguuagcuguucaggguagggaaagagugugguaggagacaggacuaagacagucucagggaccaauacuugccucuguuuaucagauagccacucgaagagacaaugguggccgauggaaaguucaacuuaauucacuucaaccaccauuuacugaguuuaugcuguaugccaggcaccgugcugggugucaggggugccuacaaagccauaacagagucagggacugccaaaucgguacuauaggaccaagaauauuauuacuauuuauuauuauuauuguuauuguuauuguuauuauuuuggugcaucuacuuccaccuccauagccacugcuuccacaagagacucagaagggugagacucuugaaucugggguuugggaaagugagggugcaaggggagggggaagguacugcugggaagggugcaggggucagguagguugggcauggaguaaggaaugauggauagccagccagagaacuccuggguaaggggaaucuaacccuucuggaaguucuaaucucuuuggcucaguaccuaacugccaaacaacacacugccaaugggagugggugagaccaccggggugccuggagcaggugaauacugcccauccuucaagcaagccaaccaggaguagagagaugaguugugggcuccccaagccggcugaaaccaaggguggugguguauauauaguucugcagcuuugaguggccaguuuucaucaccuggcauguguccucuucuuucacagugcacagacaagggacuuggcuuuugcggacggucuucuaacaucuuuugggugggugggugguuacuugugaaaucccccuacaggguuguacuaauaagcugucucuuuuuuuguuugguuggguuucuuucuuucuuucuuucuuucuuucuuucuuucuuucuuuuuuuuuuuuuuuuuuuuuuuuugagacaggguuucucuguguagcccuggcuguccuggcacucacuuuguagaccagguuggccucgaacucauacauccgccugccucugccucccaagugcugggauuaaaggcauacaccaccaccgcccagcuaagcugucccuuaaagaaguaaaguuucuuggggucuuuuucuuuucugcccugacggaaugaggcccagggaaagcaaugccugccucuggaccucauggacugggucaggagccauuucugccccagguaguuguccucaugugcacuuucuuuuggagccacuuggacccuccuccagggucucugggcuugugcuugggaacaaaacuaggcuucugugagauggggugagaaacugugagauguuccuacaggagccauugcucaagcuugcuucuuagcuuaugccagcaaacugcucucuugcugcagugugggcucugagcgcugcuccuggcugaaugcuuccacuacagugcucucagucucuccugccucuccugcucucccagaagccccuccucacacccccucugccucugccugcuaauuaagggccacugcaaagaaaggcuggcuggccaaccugcgggauucagcucaugagaacaaagcacaauauuucaggacugaaagugccuugcggugccuuggaacuggcuuuggaaauagcuguuugccccuccagcugugggcagacucaucaccuagucccacuuuaucaaaugggagaagcugauuggguccacguuucccugugagucuccuugggaaaguuggagugcuacauaccuacaagaucaggcuaagcagguagauagguggaaauaccaaccagguccaaagaaguuaaucccaggccauaggaauggcuuggugcaguuggaacgggugacaaauuaagagaacuuuuuuccuacauaugucuuaagaauagacagccuugcugugccuccugcugaugucuuccuuuauugaagcuugcugaugcgauuguacauagccuuucuauacagguagagauauauuauauauauacauauaaaacaucucacuaugcccaccccaaaaguuacacugugggguggagggugaaaucaccucucaguguuuccaaguaccaaagguucauuauggaauguucuuuaugcuuuuuaggggagaacccagcugcauacauagcaagugcuuaugcaggucuagguacuacuuccugucuguugguugggaggggagagaagcuuaaauggucuucugugacccagcugcgggggcaggcuggauuucuauagcaguuugucagauugcuuggaucuauuggcugcaauaaacacacugucuccccggaacau

SEQ ID NO: 5067 - RNA, 25977 nt, Mus musculus
cagcugcuggcaaauccgcuccggcgcugggcgccuccuccgcgcgucuccuguugcuucuucaagccucacuucccuuugcgaagagcucgcagagagaagggcgcgggcgacaucacaggggucugcaaggggacccagaagccaguggacgagggcgaccggggaggccaaccagucagcccccucugggaggcgggaaagcugcaagccgcgcccaccgcccugcccccagcgcgccacucccggcugcuuggacucugcuaguccuucugggauccgcucggaggggacccaacgccuaggugagcagcaagggaggugggcaaaguuggcaccuucuuccgaguggaggaggcuuggguggggauccgucacucuagcgccagguuccuccgagucuuguuuguuucagugggugugugcccaggucccugccugggcggcgggaaauggauuuggagauguaaacaaguagaugagcuuccaaaagcuaaggauaccgggaugggguugcaggcaauggcggugggcgaugcugguggcuggaaaaugcuuuugaggcugcccugagcuugcaucaggagcuccagaaggauagaggacccuuuagcaggggagcuucccuuuguuacucggaagcgggagacccugcggggaauggagaugcgaggacccgggaaugaaggaaugugaauguggacacaugggccacacaaaauggaaauuugcuggcuuggugcuuguggggugugggcgugggcuccgggaguggcgaagaggcccuguagacggcguugggguucgaggaugaggggauucaucugacugcauugccuucuuuuggucuguccagcucgauuuucuuuccagggcugcuaguacccuaucuccaucguucccaaccggggcuggcccuggcggagccuccccgcuuuaugucugcccagggcuuuucuguagaguugguugagagacugggucucugggcgucugcuccuaggagcagucagguuggaaauaccggcccacccaagcugccaccaaccuccagacccagagguugugaugccuggaggcuuggcuccaucaauguacccucugucuuuauuuccuuugucuaaccugucuucccgcgcuacuggaauugggauuucuaccuuuguagugggaccagugggcaucucagcccucucaaggacccuuggcacuaguguucugacugcccucauauuguagauguaugaauguguguaucuguuuuccaacuuggccuuuugcacgugaccugucucaugguugccauggaaaccccuccaguucaaccucccucagauuucugcccauuccucaccuccaauugccuccccuccccccaauaugguugcuuagauacugguuacccuuugcuuuuuaaaggaggacacccuaugucuggcucccguucuaaacugccuggcccuuuacccaucccaccaccacaagcaccacaaacacaagugcucacacauuacacacaauaucgucacagccucacauaccugucaacccucacagcccuuuagcauaguggacacacauaacauacacauuuauaucacaugaacaccaaguaacacaucaugaaaccacaacacaucaagccaaagacaccaaaugcacagcccaccacauaaacggcaaauauaucccgcacccuacacaccacauacacaccaacuacaccacacacauacgacacccacaccaaauagacgaccugcaucccgucccacauacacaguaacuguaccaaccguccuacauacacaguaacuguaccaacuguccuacauacacaguaacuguaccaaaugcauguuacuuauacucagcccucacucugugugugcaugcagggacuccaccuguaacacaaacugacacauacauguacacacgcauguacaugcacacacacacacacacacacacacacacacacacacacacaccaggcugggugaggcuaagcagacagagagugcuuuccuuccuguucagccuuauucuggauacuuagaguaucaagaaggaguagcccagaagggaaccucugacuucucccagggaccuuacaggaaaaagccaaagaaaagcucccaaaccauccuaggagagaaaccccucugcuaggugccagacuccagggccauggcugggcacaaaccaggauuuaagucucuccaggcuguguucuuccuuccuugacacccaugguccuuucugaacagaggaggcucuguggaagggagggaagccuguuaugagaacacaagagggcagagagaaggaacagggaucaaagauauaugugugugugagagagagagagacagagacauagaaagacagagagacagagacagaaagaaggagaaagagagacagagagaggagacagugacacagagugauagagauaaagagagggagagagaagagccaaagaaaugccaaacaggguucucagcuguguguggaguucuggucuaccccagucccaguuuuccugcuucuugcuugccccuccagucauuuucaugccucuaggagagcaagccaagggcugcugaguugccaggacacuaucaagacuuauccucagguggcuggaacuugagggaagaguuucccucuggguuccauuugaccuuuggacuguuggagaacccauuuuguucaguuauugaaugguuuugagcaccuacuguaugcuaacuucugggaacgugacagugaagaagaagacaccguccucagagccugagaaagaauuaggucaggacauggguggggaaacugagucaaagccccauaagcagcaguggcagaggccuauguccuuaggcaagaucuuagauuccacacugcucagcccguaccucuuuccuuggcgucuaucaauccauuggaaauugggacgucccuuccaaagugaccuuguagauguguuggaagauguugcaaggagagaugagaagggugcccugggaaagcagaagucacaugagacagagccuggggcccacaaaaagucagguucuagcuccuuggcucacaccugagcgcugugcuccccaagaacaaaugcauuuauucuacaaauauccuguuggacacaccacaggucucuuggugcaaccuaaaaauggcuuugucugugcucaaguaaccugaggccuccaagaucuuaggcguuuguuuccagauugguccaugggggauuuaguuaugauuucuaagccacauccuucccuuaaauguguguggguucuagaaucuugaaaaagaucgauuuccucuuagguaccaaugugugugaggaauuggggugggguguggcuaaagcgagcuggaaaaggacugucugaccacucuggacaaagcuuuucuuucaccaccaaccaggcaauggcugagaagccaaggucagcuaugcuuuucaugggcuggaugggggagggacucuuccuggacaagagucaccugucuguucuguuaggacacacaugggcccugaaaggcuuaaggggccuaaggggcugccucugcagagugggaaaucaggaccagcaguggcuggucuuugaaguacucuggacgguuuagagggucugcucaagagcaccccucaucuuugaucucugucuuuaaaaagaagccggaccucucugaccaagacagaaucuuggagccauuuagccacaucuucucugucuuaaaauggggcuggagaggaauucugaccugugaaauauaaagccagcuuggaaacaacauaggaaaacaucugucacgagaugucuggcagggugaggggguggggaggaagagguuugaguuccagggaucggguugggacuguaggaaugucucugcacagucaagaacuaugguuuggguagaaagggucagagaggagaccaaggaguucuauuuggagucauggugacauuccugucuuccacagcuccaaaggaaagccagcccucgguuuuacucauugacacuuuuaacaaaugccaagucucuccaguaugguaggcccuguggguuucacagaacccuguggacuguagagcuguggagucauucuuucuuucuuuuugguuuuucgagacagggcuucucuguguagcccuggcuguccuggaacucacucacuuuguagaccaggcuggccucgaaaucagacauccaccugccucugccucccgagugcugggauuaaaggcgugcgccaccacacucagcuggagucauucuuucuuacucauuccugcugaggcagaucuaaugauuuggccugucccucccccuaucugcuuacuucucugucuuccuggaggaagacccuguaauacuccuuguggcccucuuccuccacaggagggccccucgacucaccaacaagcacacucacacuucugugagcaaccccuuccucacacauacauagcccucucucccugacacuuaggcaggugcuugcacgucuccacacaccuucucacuuuccagcagccgucucucgcccccgugauggccuauuaacuucuguccucucagcuggaucuguggaucucucagcuccagucuggcccugucaaagccccuguguguggcugucuaucacugaguaaugacaggugcguggucuuacccuucgugcccuccaggugccuacccuaagcccuugggacuuucuagaacaugcauuguuccugccuguuggagguugggggugacagucuuuguagacccauucugaggcuuccuuuuuuuuuuaucuuuauaugucaaaugagcuuggagauggguggagcgagcucuguaaagcaauugaacgucauuggugaugacuccaucuugcuguccuuaggaugacgucacuguucugucuccucgauggugaucauuccuccaagaagcucuuucuaauuccuacucagcauuuuggccacucccacauucuauccuacauucuauccccacccccuuaaagaccugaggaagucuggugagccuguagaggagccauccugcccuuguucucaucacccagcccauuccuuucuucccaugcauggucuuggaaugucucuuccuugguagucuggaagacaucaaaaggcugaaguuaacagagugagcugauucacugcuccauuuuggggcuugacgagacccagauggcagagaugaagaagugaaggccuggaguuggggaaagugugaugaaaugccucauacgcuuaaaauacaccauugagauucucagguguucugagcuuaggguggguugugacuacuuaaagagacagcgaugcugaaauaucaguuaacuaauuacaccacacacacacacacacacacacacacacacgagcuguggcacucuggggaucggccaaccaaggcacaagguaagaagggaagggacagacaaauguggucaagucaagagucccuuaaccucggugcacuagacccaagugaccuucauuucucccucccauaccugggaaagaauaugaauccaugaagaugguaggcggaaccgugaaggccagagaugugcuuccagaaguaggcagcuagcggagggagaaugccagugcccuggaaugugaucugcuagcgagaaggauggcauggcacuggucuccaucccuggccuggugcagacuucaggacugucuuugcuacugagacugcucucuggccucugugaauguguguauguguguguugcacacaugcacacgugugcaugugcagacccaggagggggugauuucuuuugugcauggucaagccacacucagcccaugacuucuguauaaugcaacugguuacuuagacuugcugggacuagguauagugcuacuaggugggaugcuggggccuggcucccugacucaugcugagcagugcaugucaggugccuggguaugaguuggcuauaacaucccuauuccucugggcacuguguaggcugauaaacugaagacugucucaguagugacagugacguggccauaagccccaggcuccugcuguuaggcuagcauggagucuuucuaggaggacauguagaaaucaggugugagguuugugacguguuucccuuucucagaagaagccugguuucuuugucaggucugcuaucauugcuccuuccguggccagugucuucucuuccagaagugacuccagguuaaagguaaagguuccugaaguaacaagugcugugugaggcaggacuuugaccucugaccugcacaaccaacuggauuugggacuggguccuuagagaaagauuuuugagucuuggggaccuggagguuccccuuuucuaugaaggaggcauaguugagaagaacccccaguuacuggacccuugccagucaugaagaucuagucaugaagcgaaaugauuaacugccccauucuuaggcugcccagcugccuucuguacaccacaaggaauucaagacgaacuaacucaagccaccaggauuccaggucuuucggaaagccaccacccucuacccuuuccuuucccuggacagcuuugaauccauuuccuuaucggcuccacucuggagugcuggcauggucgggggagggggccagucuauagagagacuacagucauuucaagccuggcucuuaaacugaagaauugauguuuaacuguuuauucaauguguauuugaaauacagaucaagcaaauaggccacagaacuaucaguggccucugaucccaacccaaaacaguugcuguaaaaggcagcuuuaaaagccuuggcuggcucuuggcuccguggcagugaaccagcuaugcccugcccauuguagacgcauguggcaugugaacaccuguguucugcagugugccaagacagugagcugagaggcuaggaaugaauagagauggaggacugauuugauuguucaauauugacuauucaaauuugguaaggaguagacuuuuuuuuggaacaguuuuagguuuacagaaaacuuggguggacagcacaggccuccauaccuucuuggucugcacacagcuucugugugcaaauaaaauacacuaaaaaagucaauaaagauauuacguuagugugucacagucucuacugcauuccagcuacagcugauacauuauaaacuaaaguugacagucugugcagcucuuucccaaccaauguccucuuucugucccaggauucaccuccccagaccacauugcauuuagguaucuugucucuuugggcucuucucggcugugacaauguaucuuuguuuugaugacuguugcaucuguaaggagcacaggucagguaggauguucugcucuugggaauuggcuaguauuuucucaucauuagacuggggcauggguuuggggaaggaagaucacagguaaggagucacuugucacgucaugucaugucaugucaugucaugucaaaagcaccgucucaccauucaugccccaguaacacaguuggcaccuguuauuagagcccugcucccuccacucacagcagacauccuaacacaucagucuauucucccuggccaucucaacauccgagucuugcaugucugugaaugagaggcaggagaagguuaaagauguacacagcagcugcagaaggaggcaggcuguuguaccagcccaacagguaauagaaucuaggagacagacuuaaagauucucucaaggugacugcaccugaaacauagaacuggacuggagucagggagggagcgggcagccucagagcaugguuggaucauagcuccuucuggcagaggcugugucucucucgauuggugcagaacucuugcugauaagggaaauaucuggaggaguuagguggccauuggagugaucaagcugauauucuuucugaaaucauagccucuuccacaaugauuuucuguaucucagccauacagaaaucaaucugacuauacccugggcuaaggcaucagccgccuguagcaucagaaggauuucucauuuacauguuugauauugugggagaagaugccuucauuucagccccauguccuaauauucucaccagaaggaacacaagguguucaguauguagcuuuguaccccuuggggaaggcuaccaauugcuggucuguugcauuucuugguaucagcuaugagcugagcaccaaugagcaguagccucuacagcuugucggggacaugguccagcuucagguaaaaggcaagagucucugaucagaugcaucaaacuccuugagcccuaggaaauaggaggaccagugacacccaagaaauagccccagaucuuagaggagugaauguggccugacauaggcaacuuaggacccuaggcacacaucgaaaugucccuugcagaagcuagucuuucugaaggacuuuugaaacagaagaagauuggccuugcugcuagagaggugucugaggaccucaagaguuggggcauugcuguccccuacccugcccgacugccagggaacggugggagaugcuucucccgggcacgacagcugccuguugacuuucccugugcaggcgcuacucugguguguuuucuuuucucugcucuuuggagcaucaugguaaccagggagccaggggcacggcggagguugcugggcagccuggugugacccuguggggaggaagaguauguggagacuuggaauuuccucaugugcagauuuagucucugccaucugcauuucccucugugcuuccuguccacuuucuggcucaguaucugauggggacacuguccuuggacuagccucaguuccaucuucccuuccuucgccugccucucccacuucagucagugagagugccuccugguucuccucagcaccucuguucccuccuccuccuccgccggcauacucuugugcuaccugcuugaacccuagugacagcugcuauucuuggagcaaaaaguagugccuggggagccaaugucagcgaugggcugagucuacccugccuugugucaguauaggacacuggaaccuucuaguggucaugagauaauucaaggaagaagggagaaguuccaggaaaaaauagaaaaggaggaugggaggaggggacagagcuaggcuuacuaacaguaaugagcccaaccgugggugccuaaggagcuaguucucugccggcugcugagcccaagccccuucucucucagcuagggucucaugcaaccugugguucaagagaugacuauguagcugcggaugaccuugaacuccugaucuuucugccuccacuuccugagugcugggauuguaggugugugccaccaugccuggcuggaauggaaccuguccucaaucaggcaaggcagggauggucagucacagagcugagcuucaagaauaguaggcucugcucucugggggacagauggccugaugcccaccagaaccuuuucccugucccuucuuguaacuucuuuuuccugguuagcaacacaaacacacacacacacacacacacacacacacacacacacaaacucacucacacucacacacacacacacucaugcacacacaaacacacaugcacaugcauaccauaccuccagcccugcaucucaucaccggguuuuucugucucuuccuugauucugacaacucagguagcaaggggugacacugaaguccucuacuucuucuuuuuggcuaccagugagacugugaggggcagccuucaauagacaacuggcugagggcaaaggggguccaacucccucccaggaggaaauagcugugguaagaguggccacggaagcaagacagcaacugugcccucucaaaggccacagcauccauucucacagaccugagaccauaucgccaucaccucuuacagcugcgagaggaaaagauuccagaccuccaguugcuuuugagacacagguccugaguggcagauacaggagagccgaguguuccccauggggaccugagggucaggguacuggggaccgaaucugaccucuagggcuuuuggaaauuaaccaaaccuuucucuccucaguuggccuauugguaaugcucaucaugauggacacucccaggacuguugaaggauuguaagcugcauagaaccacccuugcauggcaugggcaucugauaaauauugcauauugcugccacagagcucugcuguuucaaaaacccuucccacguguuaucucacuugcccuuucauacagccuugagaaguggacaggauggaucagcugacucugcacugcccaccccacgcucccacccucgccuaauaaacugcauuggccuguaaucugucuuugaaaacaaaaagaaggagcccucccaagcaaacagcucucgguucccacucggggugagcuggcagacagccugcauucugcugucccccucucccucucuguaaauauggaugaagcuggaggugcugggagcuuggguggggaaggggggagcuuuacuguggaguucaucagauucccucccugcaguuaggucucagagucuuagccugcuggauaugggguggggggagggggcaaggagagugacacauggcagggggauguggguccuucacuacccacuuugccccuuccccccuuuguaucuuuaacccaagcucauuuuccagucgaaggagcuugucagcugcuucccuucugccucucauugcccugccguggcgccugucaggcugccuccaggaacuaucggguacugcccagccucuccugauacauggcuggcuguucccaacuucaguuugucaaauuggcuggcagggccagaggcauggguucuugagccaggcccuccucacccuugacuggcagcugaaucaggucccucucucauuggaccuaggcuuuccaaaauuaaaggcagaugguugucucauuauaucccagcgugcccugcugagaugccacauucucuguugaaagacaaggagauacaauaagcuaaaucguguccuguggucucuaauaacagcccagguaacccgugaggccaggacacagugcucaggcauuccauggcccuuugaaggcugccccuucuuggguacgucugcuugucaucuuacugggguauucaagcaggcuguggugauccuaggguacauuguccagcccgagguugagccugcagaaaggcaagcaggccccauagaagggaaacgagggucugcagguagggugaggaaaauucaugucauuuggaacuucggccuaguaaagagagaugguuaucaaauuacaucacaagaguaccaagcauucugguauaucucagaguaacacagcauguugcuguaucaucgaccgguggcuucucuuucugaguggcuuuuacccagcaauuaagugaaauuaugugacucaguauggaaagguaaucgcuggaggauucuucugauugccuuugccucccaugcagugggugccugugcgaacagcgggauagcgggagaggagacuaacacagaauggcugcgguuggccacagugugugccugggcauggacagaguggaccauggaaaggagguggaacucuuccucauacugugcgagaucuaacagaauggucuagagcaauggugaccagauuaauaaggcgagauggagcucucaacuccagcagcaaugauguaaugcaguccucaacuccagcaguguugauguaauggagcccucagcuccagcagcaaugacuuauaagauucccugucucagccagccaggucuucagggcucuaugcagggguccagguccacaaaacaaaacauuuuaauacgcagguugagacuuagggaacaauccugagccucccuccuggcccuauucucuucugcguggcuuauucccuuacuucaauauuccucccuccuuccguucuucccaaaacucugggccuggaaugagaugauuauacuaccucaucuauguccuccaaccucagcugagcuccaggcugcccaguuccuccccuguaaggaagaggaaaggaaugcagagacuggaaugucaggagaagccagggucuuaccacgaagagaggagaggucaagauagaacuccuugguuaauagaaacaaaggcaucuguguccccucaaaggcuccguguauguagcuggccacugugcucccagacagugccagcuguaccaccgaugccaucuuucaaagugguccaggugccaagaggcagccuuggaagaggcucaggcugagaggagcugcugguguagaccaggccccggcagcagcuuggaggauagagacuuggcuaguucucaaauguaugauagugucccuuucagaacucugcaacuugaucgcagauguuugcuuugcaauacaaggacaggucuucacuccagagcuuggcauuacugagucuccauagucugaugccagccaucuuaucggcauucucccuacccacccaucacgauuuacccagacuggauuauucacuguuuuugaaggugucuggcacuagaaaugaaaacacuuuguggguuggugucacauuccccuccuaugucauauacuaguggacccagccucauccugaugccuucuagguggacccugcagacagccacuguugagugaagugucaugggauucaaauuaaguugaacuuggaaugagaauuuuuuggccgccccuucuuuccauggcucccucuugcugcucucucuccccccacccuugucuaucgagaucacggcugcucucaggguuuggcugaagugucagcuccuccgugggcacuuucagcucuccugcuguucucuccuuacugauaauagcaggaucuuuguucucaaaaucugugucucucccuggucaaaaucuugaucauuuacguauccccugcagaucuagaauuccugccccuggggaggauuuaaugggaauuaucccgagcugaacaucuguggagcugacuguaagguucucaggaguaacagaguggaugggugggcacuauaccugguagucuggaguccuugauacggaugggucuuuuuuuuccaggaggggcucuaccugcccaguaauuccucugcugugggccaagaagccuagacuguccauccuucuccuggcaccuacgacccaguguccacaggaaggucccuaagaauugguuuuauuuuguuuuaaguaugagacagggucucucuauguauccuggccuggccuagaacucaugggaauccccuugccucagccugcugagugcucggauuguaugcaugagccacaguugagggcuuuuaaugucaguucuauccuccuuccaaacuacuuuuggaucuggucuccucugacugaggcccagauauaauuuaacuauggaacgugagauggaacuugauccggggguagcaauacauuugacaaaggggaaggaagggaaggaggaagauuuuacacacagcagguacauauaacuuaguucccuccuuaaaugauugagaaauuuuucuccuguaacgugaugaucccagcucuguugucacagggcuuggccugccacacaugaaggaagaaagaggcuccucuaccacucacuccuuucugcacaccaaacaacaccuaaaacucuagaacugaaauaaaucucccaacuaagauccuaugaaaucaaagucgcaugauuauguaaagugugaacugaauugaagcggagcugcugagaaugaacggcagucggcauccauugcugccuacuggaggccaauaagcaccgaaccagcaggaguaggauccaagcccaugacuucuccauugaacugagaacgcuugagagaggcuaaucuggucuuaguuugauauuggccacucucaguccccauggaaaaagaaaaacagccucagaauuucccacagauuaaaauauaacaaauuggaguacacagucaaagacuacuaaacuaagguagugugugugugugugugugugugugugugugugugugugugugugugcaugugcacaugcacaugugugcacuaggagggacccaagagaagccgaaucacuguuuaaaaaccacagaugccaccaaucaauuuaugcucccaggaauucaggauuuugaaggaaggucuagcaguggcagugguauuaggagccuuuaauccuagcacuugggaggcagaggcaggcaggucucugaguucaaggccagccuggucuacagagugaguuccgggacucaaggccagggcuauacagagaggcccugucuugaaaaacaaaacaaggaaacaaacaaacaaaaccaaacagaaguggagaauucaggauuuugaaguuaaaagauacagaacauaaaauaacugugaggaaaauguuggaaggaaacaguggaucauacaaaugagugggcaaggaagacgaaugaagugaccaagcuguuagaaaaggagccaacuagaacguacagacguaauacaaccguuggaauaggaaauuaaguggaugaacgaaacagcagauuaagcacaguuagagggagagaggaaauaauucugaaacaauuacccagcagguagcacagugaagcaaggacgagaaaaacugagugagcaguccggugauuuguggaacacaauaaggacgcccagcacguuucagagccguagucuaggaagacagaauaggcugcucgcaugacaggacguagacaucacuuacuuauucguaauuaauguaaagcgagcauuuuggaagcccaggguuaaagcagaaucuucaaaaccuuagaacuccauuuaaagccaguaguaaguaauuuaaaaaaaaaucgugcacaugugugugcacauguguuuauaaccauuguuucccuacugcguuucacugacacagugcacuaaaacaagggguagaaacaaucugugugcuaauuaguaagaucauuugcaaagucuguguacagagaaaacccaaaggcguacagguaaauuauuagaagugagagaucuuaagauuacuguauuuaagaccaauugauaaaaaaccaauuguuuugcuccauacuacacaguacguuaauguuuuaaaaaaaacaauauaacuuacaauguaccaauggaugaaacagcuaugugaagguaucuuggcauuucauaagaagcuauugauaaggcccuggggaaucaaaagauuuaugacacuugaggaauuggaaucaggaacaugccagauucacccaaucccuccagguaggucccugacaguucuuaugaaagucccaaaguuuuaagugaugcugagcgacacacuccuguguuugaguauauguccagaggauggacauacucuuaaaggauucagagaaggagauggaaggcucucuuacaacccaacaggauuauuaaaaagcuauaguaacagaaauacaggauuuaaugcguuaccauaguccagagggaauauacccuaagaccacguagaugacugacaccugaaaccaacuaggauucaacacuaagcauacuguuuucucuauaacaucuacuuaugauaaauuuuaauauguaagcuaggcauaguaagagcuuaacggcaauauguagagcaauuacaaaaaaccauaagaacaauuuuuuguuagcuuguuuguuuguuuuuguuuuucaagacaggguuucucuguguugccuuggcuguccuggaacuaacuuuguauagcaggcuggacuugaacucagaaaucugccugucucuaccucccaagugcugggauuaaaggugugugccaccacugccuggcaagaacaauucuuuuuuguuuguuuguuuguuuauuuuucgagacaggguuucucaguguagcccuggcuguccuggaacucacuuuguagaccagguuggccucgaacucagaaauccgccugccucugccuccugagugaacaauucuuaaauauggcuuuuccccaguguaucuuguuuuauuuucuugucugaaaaaaacaccuuacaggauuuuuuuuuuuuuuugacucugugucuguuauguuagaggguuacuuaaacacacggacagugauacacaacaguugugccaaaacagagaugcuucuaagugacuggugggcagguagggguaguauauacaguguggauguguuggaccagaagggugacucauguucugcagcaggauggauugggacagugagagauuuuaccaugaucuguguguuauaaacuguaugaauuauuuauuucugagacuucucauugaauaaguucagaccacaguuggcaaaaagcaauugaauccauagaaaguuaaggagaggggcuagagagauggcucagugguuaagagcacugacugcuuuuccaaagguccugaguucaaauuucagcaaccacaugguggcucacaaccaucuguaaugagaucugacgcccucuucuggugugucugaagacagcuacaguguacuuagauauaaucauaaauaaaucuugaaaaaaaaaaaaagaaaguuaaggagaguaucauagagacaaauuagccgauacacccaaagaggaagcugggagauaaccacacagccaagcagaaaccagacuugugguggcgacguggaacaccacgagaaguggcuggcaguuccaagugguucugggacaucugguuaucagaaugggagaaaaauaagauucagaccccuaccucacaccucaguuccaaguggaauacaaguuuugaguguagcugggcucaauggugcaugucugugguucugggcacuccuccaguugcugacuuagggucucuuagauccagacaccuaauaccacaaacaaaacacaaagcacaaacaaaccuuuaauguggccuaccugugugaagaaaugucuuuaaaaagacacauaggaucaucauauuagaacugagaaguucugugcccuguaagacaauuuuuaaaaguaaagacagagccagcaagacagcucaggagcuccagggucuaccaccaggccugacccugggguuugcucccaugaugccugugauaggcgagaacucccaccccccccccaagaugucaucugaccucuacacaccugcuggggcgcaugcgcgcgcgcgcgcgcgcgcgcacacacacacacacacacacacacacacagagugaguaaaugaaaugugaaaaaaaaguucuuaaguaaaaagacaaaucacaggcuaagaggagauauuauauuggaauauuauauuggaauacucaauaacugagguuuaaugucaagauuggaaaaaaaugauuugaaacaggaaaaagauaagaacauccuaucaccugugaagaaacagaaaugucaaacacccaauuacuaagugaccagauuaaugcuacauuuuaugccucgaaauugacaaaaauugggacaucuauuaaugccaaacugaucuggauggggaguggcagaucaaucacaucgcgcuggccggaugauaggaggggaaugaccgggugaagagugauuaacugugcagcacugacgguuugucacccaagccguggucucagagccaugcucacucguggccgccauuuccaggcugcagggugagaccggccaaggggccaagccguauucccuuuaaaaggaaacuaagcaggagaguacuucgugcaccauaagugucguuuggucguuauguuuucugguguccaggaaugaguggucccccccuuccccgcaucugcaauauaaacagguuccucuugagacugggugugaguguuuauaacccuaucacguaaaguuagcaaugccacguuaaagacaccagauguccaucaacaagagaauggaucaguacacaauaguuugccuucacaaugaaaugccagguguuaaacaugaauuaacugcagagcugugcauagauaaaucuucaguacaaaguugauuaaggcaaguccaggggccuguacauauuauaauucuuuaaagcuauauuagggguuggggagaaggcucagucaguaaggcauuuaccucaagugugagggccugaguuugauccccagaacuuauguggaguggcaccuaacagcggucucagcauugagaagauggagaguuugaaggauggcuggaauuugccagcuagccagccagcuagcccgccggccuccuugaaucagaaucugucagcuccaggcucugucucaaaagauaaaguacggagugugugaggaagacaucugacguggaccuuguggcuccacaugcaagagcaugcgcccgcucagacacccaaacacuuacauaugcacagaaucacucugagcaauguuauuggauaucugggucaagcauaguuuuuaagaagagcaaggugcauguucacacagcaggcgaugauuugacaccuacaggacucuggcuggaaauggucauggaugaagcucugcugcccccuggugucugauugguagauggcagcagggucacuuguuagacugagcgugggaccggccauucuagacagguucaagcuguggcccgucuuacccugcauggaaaagauuaagcagcuuugggcgcuccugauuugcauucuucucacuucucacucuguauuagucuucugagucugagagugacaaguguaaccccacugauacaugucccuggugugucccaucagagucccccacuucaucaccagaaauugaugagauccacguagaggggucagugacuuccgugggaggagagacugggguugaugcuuagaaaccccuauccagacuaccuuaacacaauuaucaccuuuaggagauggggccucuagggaaagcugagaaaacaggaaacaacaggaaggacaccuaagaucacauaugggcaucaggguuugugauagcguuuggggaacagaaagagucuuccacccaucaccugauagaaaaacacuuccuagggucuggagagauggcucagugcuuagaaugcuuacugcucuuccagaggacucaaauuugguucccagcacccauaucagacagcucuuaaccaccuguaacuccagcuccuggagaugccgugagcuggucuuccuagccuccaaggacaccugcacacaugcacacauagacacacacucacacauacaauauaaacauaucuuaaaaacacuuucuggcgggcuguugacugugggagcugggcccagggccccacaucuuaaugaggcagaaguuggcccggaaggaggacacuggugagacaucuccaaagcccuugggaaggcaaggcuucagcccagaagccccacgcuaaugagucccugagccgucaucugaccugggcccuaccgcucccccuaugaagggcgauaauuaucagcaaguuucugguuccaggccugcaguguggaccuagcacagugccuguuaaguguccugacucaucuggguuaauaguauuggccacacagagcucucugagagucugaugagagccugauaagguggcauuggucccggagauuugaaguggccucaggucacacaagcuccccauacagcucaggcuaggacgaggcccugucagggugacggcuuaccgaggaaggucuucugucccuggaguaaugucuugcuucuuuacccccagacaccauggagacggugcugguccucugcagcuugcuggccccugugguccuggcgagugguaagaauccuuuagggccuugcugugccaaacuggcagacauagcccuuuccagcagaagauucuggcccauucagacauuaggguugagaucuuaggccacuuuacaucuggucacgggcucuuacugucagcagaggaaaacagauccuaguucagggccccccugcacgcccuucucccacuguuucccacaaggguucagcaauccuucuguuaaucucuccagguaccuugggcuccuguggaauuguagccuagacuguaauuaauccauccugacuuuauaugcaggucacgagccucccccaccccuuggucucaguuucccccuuugucacuagaugauaauagaccuggucuuuuggaggaaaugaaagacauaaugugagcccgggaccccaaagacucuaauucaggcgaggacccccaagcccagcuagcccaucuuccaugaucuccaguaucucugcccagugaacccccuucacaaggacucuuugguggggacuagagguuauggggcaggugagaagucacaggaaguauggcugucuuccucuugaccaugucacaucuuucccagcagcugagaaggagaaagaaaaggauccuuucuauuacggugagugagcucagcagcccugggggguggucccauccaggaggggccggcgugaccuccuggccccgccucucucccaccucucacuucuccucccuuugcagacuaccagacccugaggauugggggguugguguuugcugugguccucuucuccguugggauacuucucauccucaguaaguguguccuuucucucuacggcugcuagacagauggggacaguauacaagccuagccauuuugucugugggacaggagaaggcacagucuugccucuccacaguaucuccaggaucaauacagggcuggccauguaguacgugcucaggaaaacaaggaaggcauggccagagaauguaagugagaacagacauagccaagaaccacagacugcauccauagggcagggggcuggccaucccaggagucagaugcuguucucgccgugcuccuagagaugugucccugugcauuuccccuacacgagcuguggcguuguguuuuuuuuuuuuguuuguuuuuuuuuuguuugugguaugaaagggcaaaguucaucauagugggaaggcagugaacuagcuuggucugugauagcagacacauguggcuuguuuacauugagacagaccaggaagcagaaagcucaggauauaaccaaaaguggcuaccaccuccaagaccugccccaacaaaucacuuugguuagcucggccccaccucccaaagauucccccucccacaaacagcacccagugaggaucaaauauccagacccaacugugggggggggcagggggcggcgguaggucuuuuguguucaggccuggagccuggccuugagcugaggcuggagucgugaccuuggaugguuucuuuguguuucaggucgcaggugcaagugcaguuucaaucagaagcccagguaagggugcugaggcuaucggacagggagaggucuguggagugaaccccguggguguucuuuugucucagaaagagaauguggggagcugggguaugaaucugggggguuuccaaguggcuuuaaaacaaagcagaggucauaauauggaggggcagccucagauguaaauuccuggguaggaguguucuggaaccuuguuuagaggcccuggagacagggaggcuggcuaggagagagguagcagccgauggccgcucuguggugcagggcagagacauugggccugcuucuuaucuuuuccugaggcucugggcauuguguagacacuuggccuccuuucuacaccguauaaguuauaccccauucauuaaaacagccaugguggccauggaccucagaagccaaaguuggguggcaggcacacccaaaccccaccucggggcagacacugaagggcccauaaguucuccagucacccuacacaucccaugguagaguguuugaaugcuucagugggguuggaaggaauagguuccugggcuauccacagagaaugggggauacucugugguuugcccuggacauuggugacagugugucucugcuugucacagggcuccaggugacgaagaggcccagguggagaaccucaucacuacaaacgguaaccgcugugaaaggcuguggggcggggggggggggugucuuccuauagucuuggggguggggagggacucuaggcgccaugagcugcuuugggcuucagcagacaugccucugaggugccaggaaaggguucccaguacccccaguaccuacgugauguuagcgcuucaucugaaccacagaugcaucauuguaugcaaagcaccugcuugccgccaggcaggcuccaucuuuccacgugugcuaagccccacgagggccaucaucaccuaaguucuuguaaccagugaccgucgaggaccgacaccacaucuuagugauccucaauccugguaucagccauaagugaggguucaucauggaacaugguaaggggccucacacgccauccaucugccuucucuuccagcugcggagccccagaaggcagagaacugaggugcagccuccagcgugaagguaggugcucucucucucugugcuuggcuuccugccgucucaccacggccuucagugagccugggcaggggcaucaugcugacuucuucauggcacucaguuuuucuuaccagugggcuccucugugucuuucagaggcgggggaggaacggaacagugcacugcucagucacagagacacggagguguccuuuauccaaacacaacagcauaggaaaucagagcugccaaccagccuugggucaggcucauacaguacugucccagcuaccacaaauacacaccacacacacaucauaccacauacacacaccacacacacacacaucauaccacacacacacauacacacaccacacacacacacauauacacacacaucauaccacacaccacacacaucacacaucacacacacacaccacacaaacacacaccacacacacacaucauaccacacacauacacacaccacacacacacaucauaacacacacacacacacaccacacaucacacacacaccacacaaacacacacaccauucacuacacauacaccauacacaugcacacuauacauacacaaccaaacauaccauacauacacacacauaccacucacaucauacacauauacuaugcauacacacaucaaacauaccacacacacacauacagauagcacacauaccacaaacaucauauacauacacuaugcauacacacaucaaacauaccacacaugcacaaauacagauaucacacacauauaccauacacacacacacacacacacacacacacacacacacauuuauuaugaaacucuccaguacuacucuacaguagugaaaauaauauaugccccucccagucccugcaccuccauuguccucaacacucggaguccaccaugugucacuuccauugcucacuguagggugugccagagaauacauagugacugaacaaagcuuccagucugcagaugggauaggaaccuucuggagcuaccagaagaaauaggacacgcagagccagccccauuuauaaugggaaagauugcagucagagaaagccguucagaucauguccugggguuacuacugcugugauaacacguggucaagaacaaauuggggaggaaaagguuauuuucccuaagccuccauguugaaggaagucaggacaggaacucaagcagggcaggaaccuggaggcaggagcugaugcagaggccauggaggcguauggcuuaugggcuugcuccuucuagcuugcucagccugcuaaaagaaaauagaaccuagaagcaccagucuggguuggugccacccgcagugggcugggcccucucccaucccugguuaaggaaaugacuuaugggucuaccaacagaaacgccuuauggaggcguuuuccaaguggaggcugccucuucucagaugacuauagcuugugucaaguugacacaaaacuacccagcacagauaguaagugacaagauggguuacuaaccugaauccaggucucuguggcuagggucaccuggaauaacuugucaacuguguccuggauggcagacccugggcuaagcaaaggcaagaaagccaguuugucgccucacuucuucagauuccacacgaucgggcguaacaaccaaguguacaacuuuagcuuaagucauaaguuaaaggaagccaggcagagugauacauaccuauaaagccagcccaugggagauagaggcuggaagauuacaaguucaaggucaacccuggcuaauacugaguuugaggucagucugggcuacauggacccugucucagaaccaaagcuaaccaaaagcugucuggaucauggacacuagccucugccaugaagccaguacugccauguaucuguagaguguuuuaauuccuugcagugccuacaucuccacacgacagcuccgggcagcagagcagggcucacgguguccaucuuugggauggauaucuucaagacaagugaccuguuaugcaggggucugucaauaacuccagucuuaguuacacacacacacacacacacacacacacacacacuccuccgucugccucuuagcauugucugcucuucacuggcccuggggguuucaagggcaugccaucggugggauuuauaggcaaagggauuaugcugaagauggggagaggaugagguaugggugccagaaaggaucugggauugacaugugaguugugucuccacagccuccagaagccaaggccagcuaccugacgcuucagagacugaugucgaggcuugagaaaaccggcuacuucauaccagaccuuucccuaggagaagccaagaaugcguguucccugugccucucccugccccccacuaaccccaguccuauauuaaugaugcaacacuucucacugcagccgggcucuggacccugucugugccgugucugugccgugucugugccgugucugugugugucugcugacuguggucgaccguggauuucauuguuucugugaacugugugcuuccucucccacgcuaccaucggcgccuuguguccuccugugaccuccaucuccucuugcucucuggagucugcucuguuccugaggagcccuagucccaucucuggauugagagagaguuaguuguccccagggcaggaguccccagcggacccagggcugagaaaguuuguugcuauucuuuguggacucucagaagaaacuugcucuggauuccaccaguucagaaggucuguuugcagcuggagagucauugcugcaggaucugccuuccagggcuccuuuuccuuuuaggguguccacugcagaguccccaucugccccacccuuuagggaacacccaggaaaucuugccucuggggaacgagcuccucucuuaucuuccgagcaauaaccugguaggcucuggagucccccugccuucauccaccuuuccugcuucuaagacuuccaucucuggcccgauuuaucugagcagaggacuccuuucuucuccgaagcuggucucuagcaggagauagucaaggggacaggcaguggaaaggguggggacgguucugucucucugccuggugguguggauauggcagacuuugcaguuucuugucccugccugucaggggucagaguggagagggauggaaggguucaggggcagcggggcugagggucagagagcaacaggguaugagcagccuggaugcaaaggccagaagucaaaagucaucagaguggaaacucacaccggagccugcccaaccugccuaauguguucccuuggaaacuaaccaagccacacuguguacugggacugcugaucucugucuugugaucuauauccucugacaacagaaaaauaaauaaauacagcauuguuuccuagugac

SEQ ID NO: 5068 - RNA, 1279 nt, Mus musculus
ggugugcagcgaacuuuauugaugguauucaagagaguagggagggcucccuaggccccuccuguuauuaugggcgucugggguggaaauugugagggagaugcucaguguuggggccaaguugggauagggacuccucagcaacagagggccucucucuugcucucaguguccuugcuggggugggugguccaggguuucuuacuccuuggaggccauguaggucaugagguccaccacccuguugcuguagccguguucauugucacaccaggaaaugagcuugacaaaguugucauugagagcagugccagccccggaaucaaagguggaggagugggaguugcuguugaaguugcaggagacaaccugauccucaauguagcccaagaugcccuuuagagggcccucagaugccugcuucaccaccuucuugaugucaucauacuuggcagguuucuccaagcggcaugucagauccacgauggacacauugaagguaggaacacggaaggccaugucagugagcuucccauucagcucugggaugaccuugcccacagccuuggcagcaucaguggaugcagggaugauuuucugggcagccccacagccaucacgccacagcuuuccagaggggccauucacagucuucuggguggcaaugauggcaugaaccguggucaugagcccuuccacaaugccaaaguugucauggaugacuuggccaggggggcuaagcaguugguggugcaggaugcauugcugacaaucuugagugaguugucauauuucucaugguucacauccaucacaaacaugagggcauuggcagaagggauggagaugaugacccuuuuggcuccacccuucaagugggccccggccuucuccaugguggugaagacgccaguagacuccacaacauacucagcacaggccuuaccccauuugauguuagcggggucucgcuccuguaagaucgugaugggcuucccauugaugacaagcuucccauucucagccuugacugugccauugaauuugccguggguggagucagacuggaacacguagaccauguaguugaggucaaugaaggggucguugauggcaacaaucuccacuuugccauguggagagcagauggcagcccuggugaccaggcgcccaauacggccaaauccguucacaccaaccuucaccauuuuguuuacgggacgagccaggcacugcacaagaagaagcgucugucucuggaacagggaggagcagagag

SEQ ID NO: 5069 - RNA, 26974 nt, Mus musculus
cuucccagagaucccagggaaaagcaaaaacccuuuggcuuugacagccaccgccacaagccuuuccgccuccccagccugccuaggugcugggagcugggagcuggauuaugguggccugagcagccgacgcagccguaggagcccggagucccugucgguccccaagcugcaaagcccgccuggaagaccccgaaagcuacgggcucggauagccaugcccgccccucccagccccacaaggggcccgauccccccgcuggcggccggcguccagauguagcuggguccccuggaucgccaucgucgucuccucucgugcgcuacggauuucuccugcccacucuccgccgccuggaccgggaacugagcgaggggccugcagacucugcaguccugaugccgccgaggccgcucuccugagagaagccaccaccacccagacuuaggggcaggcaagagggacagucaccaaccggaccacaaggcccgggcucacuauggccccagcgcugcacuggcuccugcuaugggugggcucgggaaugcugccugcccagggaacccaucucggcauccggcugccccuucgcagcggccuggcagggccaccccugggccugaggcugccccgggagaccgacgaggaaucggaggagccuggccggagaggcagcuuuguggagaugguggacaaccugaggggaaaguccggccagggcuacuauguggagaugaccguaggcagccccccacagacgguaagguggucagaucuagcaacccuccuucaugcaugguagaggggugauaggguagagaugaagcagccugcccugauaaaaugguuuguuuagugggugcagaaugaccgcccgcuccuauuccuccaggauccgguugggaguagccuuuccauuucccgcccccucucacuggcauccaagccccaggacugacuacucaccucucacucccacugccccauccccccacgcccaagaaagcacuucagugguggcugacccuggggaagggccaggcacggggacacuguaacaggugucaguggccggagucucucauauuccaucuccacacucuccccuacucuaguguugcgggggggggggggguaucuaagauccccaccuucaucuucuugagaacccaaaauccuggcaccaguuggaucaaucagccccuuacucuaagucugggcugccauaagccaacaaagugagagucuuaguaacauccauguagccuccaagucccaauagacucuggcuuccccuagucccuuccuccuuuaucccaacccccacucucuacacucuagcuccucccccacccaugccucagaacauggccagaagagagcuguacugagucugagaaagauaagccuaggggagccagaaaccccuugcaaggguucugagacggaugggcacacagccaugggaagggacuucucccugucuuuucccgucuuuuccaacaguuuccaagguaccugggguggcugguggagguuguguccucuaccugugcugacugggagugugggcuugagucagcuauggcccaugugggguugcuggcugaccucucugagugcaucugccaccuccgugggcgagucuggguacugguugguggcagugugauucugcgugugcuucugugugucaccuugagucugauccuguguaucucugugagcuacccucaguggcuccggaccguguccacaaagcuuguccacggaggguguggaaagaugggagugugugcgcuggggucagggaggagacagucacacuuccuuucacucaggcaguuggauaugggagaaccacagaccccugcuuucuuguuacuugcugggucuauaccacucaagcuugcuuugggagcucugaaguccuggucucccccacucaccccuccucuuugcuguacaccauaacuucccagaagucguauggaauccgggggucggagccaagucagagcuagaguucagucugagccaagagaagguaagaugucagggaaggggacauguggagacgugggacucuagugacgugcugugcaacugcacagaucugugauaaagccacaaggacuuuagggucagacaggcuagaaucugggggucugccuagcacccuagccuucccuuuucccagcagugugaccuuaagcaacuuauauaacucuuguuggcuauugccuucucuucaaaacaugggaaauggggccuccuuugcaagacaauugugaggauuaaaugaaaccacguaggggaccaugccuagaagaaaucccuggguuaauugaccuccaauaaauauuaccuccuucuccuuaacuggccuggccacuucugccucuucugugcuaugcaaugaagcauaaaaucuggaccguguugaguauauuuaguacauacuucccugguccccugagaugcaauguaggugcuccagcccagcccuuggcagagaguagcuguugagggcuagucagugcccuccccucccagcuagaagucagagcagggggcuggaggucacacacuagcccugggaacccugaguagaggcacucugugguugcacgugccucugaucccgacccuguuccagccagccucggcucuguggcuauuuuguuccuucccucagcagccugugagaaggaugagccuucuucuuacccaacggggcuaucagaagcagugaaaugggauggaggguggcagaguucuaugaacacaaaccucuggaauuuggaggguuacugcccaugcuugguggucuaaucuacaaaacaauggaagacacaccucugcaugaaaggcuuuaaaaaggaaguaaaauguaaguacuccuuugacaaaagugaugcucuguagauucuuaucuuuagaacccgcuaaacauguaaauucucaugaucccaccccagagucugggagucugcaggucuuaaggcugagaagcaccgaucuaugaggagaaauaaugaugccaaagguagaguuggcucaagggacuugauggaguauguguucauugagugagguccuggaggguggaaaggaauggggccauccuagccaggaccuggcgcuucucccaacacaccguaauugcuucucacuugcuccccacucuggcccagagacuaugagaaacgagagacgaaugaguuguguguuugagcuuauguguguuuguucaggagacaagugaaagccaggccaguugauacugcaggguuaugcugagaccagaucaauuuagguaaauaaaacggagcccaacugucaaaaagccuuaaaugucaggcuauaugguuuggacuucggcucugaggggggaaauugagaucauuuguacuggagaaugauaugaagcaagcaagcagacgucugaaucuuagggagaguggaauauagagcuacgggagacgcgaagcucacuuucuguggagaaggcgugagguugcgguaagagggagagagaaaggaggccaggaugcaaggaaugucacaaaacaggcgagcaggcuggggacaucguguggaggguggagaagaaggaaggcaucagagguaacuuggugauucugacauggcguaaguugaaauggaccauugguggaccaggauacagggcaggagggcaugguugguauacacacuuguuuuauuuuaauucagugugcauaucuuuguuuguucugguuuguuuguuuugcugcaucccucacuccuaccccuugcuauguagccccuggcuagacacaauucaugagccuucugccaaagccuuuagcauggugggacuagaaguguacgccaucacacccagcuucuucuuuuguucuguugcuuggcuuaagacagguccucacuguguagcccuggcugaucugaauuuaccauguagacaugcuagccucaaacuccaaaagauccaccugccucugccucccuagugcuagaauuaaggcugugugccaccaagcccaguuuacuugguucuuuguuuauuuguucuuucuuucugcgaucauguauauguauaugaguauguauaugcauguauacaaacacacauauagacgcucuacauuauucauagcuuucagaaggaaaaacaggcucugaaagguaaacccuuggucacgugcugugucaguaagcugaggcccucccuacuuuacccuuuguucuccuacaaugguauugucuugaauagccuguugagagcaucccucugcugugaugucuccccuacaguuguguagugugcuaugacuauuuuuguuuccuucaucaaacuucaagcucuugggacuagggauguagucuagugguagcacacuagccuagcaagcacauggcucuaggcucauuccucagcaccacacaacuuuaaguucauuuuuuauuaauuaauuaauuaauuagugugugcauauaccacaaacugcauguggagguuagaagacagucuggaggauucucccuuucuaccguguggguuccagggucugaacucagcuuggcagguguagcugcaaguaccuucccccacugagccaccucaccaacccaaaagcucauauucuaauauguaugauaauuucuagcucagacaucugcugagugaaugaauccgugagcuacaggauguugaaauagagcuguuaacugggccuggugacucaggucuguaaccucagcuccugaggcugaggcagcaggaucagaaggucaagacuuagcugggcuacaaagugaguucgggggaaacucccgaaauuacacaaagccuggggaaucugacgagacccugucucaaguaagaaagaaaagucagggugggcuagggauauaguuuaauuauacugcaccagcuagcaccccugguccccaaauguacagugcgcaugcacuccagguuccuuggugcugagaucacaggcaugaaaccuuaauuuccgcacuuuccuauccugccucauuuucacuucaaaugaaaagcugcaccucauugcauuaggauaagcaucacugacccaacacugaagaguaguuuguuaggaaggaaauuugguaacagucauuucaauaugauaaauauuuauugagcaacuguuguguucacaggagaaacagucccagccuuuggggugcuuacaauuuggugugaaauacggauguauaaacaucacugaugcccaagaaggaugaguccaggaaauggcacaaagcuacuucugauagggcacaggcuggcugcuccacucuauggggagaggugcaugagcuguagugagaagcuggaaguuguaaggaugcugcgggccuuguucuggaagcagcuggcagaccucauaagccuaugaaagaggggugguggugucuaauuuugguuucaggaaaacaacuuuaguguggaggagggcuuggauaggguagugugugagacaagcaucuguuagacaagggccugaugagggaggaggcagugaggggagagaggagagaaggucucaggaugcugacagucacagcucaggucaaccagcccugcucugucccuaugagcuaaggggugagagaaagggcgagggaaggaguuggucccuucucccuaaccucucaguuuguuuguauaggugaacagcaaagggguggaggcacaugccuuugauccuaguacuugggaagcagaaguagguggaucugugauuuugagaccagccuggucuacagaguaaguuccaggauagccauagcuacacagaaaaauccugucuugggagggcagggggaggaaagcuuuuaaaacguaguaugauuuaccuagugccuuacacauuuauaucucucucucucuccucucucucucucucucucucucucucucucucucucucucucucucucucucucucucucucucuuuggccaggggauccgguaagacagggguauccuagaacuugugaccuaggccauccuagaacucacuauacugccaggcugaccucgaauuugcaguaauccucuuaccucagcuuccagggauugauuacaggugggccaccgugccuggcuuaaacaguuacuuuucugguuuaaugauauggccuagguauuaguaugcucauuuuggugguaagaaaaccagggcugaaagagauuaaggggguuucaugaaguuacucagcuaggauuaacacagcagaaauucaagcccuuaucuuuaguuccaaagugcugggucaauuuccauuuuaucaucuugaacauguuaauugacuuggaaaugaaccauccuuaugggugaaccuggccacuacuggccacgggcaucuggaaacuggugggagaugggacucaacugauagacuuggugaucaccucgcagagucagcaaaugaucuuguuccucgagagagaauggaaagaaacgaggaugaugguggaggaagaauauuacguauagacaggaggccaucagaaaugggggccuuccgggucugagcuacagauggcaccagcccuuccuauuguuucaaacacuucucugccuucccagcuaaagaaagacagguucauuugggagaacguuucauucguuugagagcgauguccucugacugaacauuucuagacaauucugguaaaaagcaaagcagaaaauucuaauugaaaauccaagaagagaucucccagggaagccccacgagagucucucucugcuguaguccaucucaauggugugacugagcaaaagccaggcuguuuuccuggucccagagagggguucuccuucugggagggccccggaggguggaaggcauucacugauguugauccaccauauccaccgggucuuaggagagugagauggguguucuguggaaggaugcugaaucauuggucuccagagcauucugacccagcgagcagaggcucccaggcuguucucccagacuauggguuuucugucauccaguaguuggccucucugcugcucacuguaaccccaccguggccaggauggcuguuuucugcuggggucuccccucagaaucagugacccuagcauuaauuccuuuucagggccugugaagauuuugccagggaacagagaaggugaacgcuagcuuuccccagugggugagcaugacucaaggaccagagggaaauugagcugaugccagagaaggauucacugucugacagugacaagcauguagcuaauagcugcucuggggaagggcuuucuggguggcuucuacagagaaugaaggaacaaaagagguccuaggaaccagcacaagggaugggucuguugcucuuguagaguacgcaguuagcacgcauggggccuugguuccaucccuagcaucaggaguaaaguuuaaaagccauccugucaauuagacaugugguuuuuuuuuguuuguuuguuuguuuuuugacucugcuacccuacugauagauggcaaaagaacugcccuggaggcuggaggaaauggaauacccuggccaaagacagaagggugcacuggauaaguuugguuuggggugacccugcccuuuaagaucccuuaaaaaucuagccagaguuggugcgugaugcuuguuugcaggccccagcuacugccuggaaaacaaagaaaguagaggauauagcugagaaagaagucugcagaccuagggucagcugccuuuacucacaguugcagggcagccugaggcaggagggacaaacaggguaaacucgagguaaacugcuucaaggagagccaggcaaagcucuuaaccacagagaaaucacuuagucaugacuggcuaaacaagaaagaccauuuaaagagcaacuaccauguuguaggccuugaggcagacacuagccaacacccuagcccccaccacaaacucagagagcucuuaggagaagccucaggguauuguauuuuaagguaagcuguuuggccacaaacaguagauaucccauuccaggagccucuggucagaggauaggcaggcgugacucaaugauugagguuugaggagugguaaccagagaaggcaggugauacugaggaccugcagguagaggagcuucaucuuggcacacucuugagagacaggauauuugaccaggacuugaaaguugaacaugugucagguguacagcagaacaugccagcuaaggaauggagcugugugucccagcccaggcaaggccaucaugcuccucagcgauggaugucacaggaaccacacggaggaaggggagcuccuggggagugaccaggaaauagccaguagcucucaaugucaaggguccuaggauuucauucagauagguagccuaaugcugggcaagaaaccucccaauuacugugacuuaaaaacgcaagucauuuuccaggauccugugggcugacuugagguccuccuguuugaacuuauucuuguggcuacagacagcuggcaagucagcuagaggccaaguugucccaauuugcuagguuuguggcugcaacacuugggcucacugcuggacugcaaucccuguauguaagugccaccucaccagccccuccuugccuuuacugauuucucacuggccaagcccagagucacuguggagggaaucucacacaaaggccugugaaucaccaguauacccauuuaccacauacuuccucuccagauggaaggccaagaagaucaaaggccguuacuacuuaguggucgguuagagccgguggaggcugguauuggcuuuguggcuugguuguaagauggccacguugcucauacucucugggucuguuucuuucucuucagauuggaagaaagccucccccaucucagcuuuacaccaaaggcuuguucuugcuuagcccccagcucuaagguacauacggaagaaagcagaugucuucuuugggaggcuuggaugagaaccucugcccuagaggcuugcaaaagcuguagagccugagauaggcugcaaggaaguuuguggggcaggggaggugcguuuuauucuugugcugaacuggggacggaauaccugagcccuugagcauagacgauucugagcuaucccugucuguggggguuaaguccuguaggauugagggaauccaaacccaccuuaaauuugccagucucgaacuuaacugcaucugcuaagaucuauugcugagcacaguagagcgaaccuaagcaggugugccucucccagcggggcuuguuaggccuucccuagaagcugccuucucucagaggucccaaggagcacauuuguuuguuaagugauuggcacugaccuaguccugaccccaaguuaaaucuccugggcaugggacuccuaggucucccuaggccaggggacaaggagaaagcuacaacacagguggucuaucucaugucaagacaauggaaacuggguuaaggaaggaagguagaucauaaaacuaaccagcuauugggagccucagagggacuuucucccccacugugugguuuuuguuguuguuguuguuguuguuguuuuuguuuuuguuuugguuuuuugagacaagaguuucucuguauaguccuggcuguccuggaacucacucuguagaccaggcuggccuugaacucagaaauucaccugccccaagaaacgccuaguguuuuuuuuuuuuuuuaagggaaaaaaaaaaaaagcuugaaaaaccaguuuuucaagagacaccuauugucaggcacuaggauaccaaacagggcuacacugaguucuuagacacugggaagguaagagaggcagaugguaagggagccuauagucaguuacaguuaagggaauggagccuggucuuccucccaagggaggaaguuuaugcucaggcuuaaagaugaagaaguaagacacagaaccaagaagaggaggggccaggcagagccaguggccagugacacucuaugggaugggcccaggacuggcaggagcagaccaugugugguggggauuggagauuugccugaggcugagcaugcaagcaggguagguuggaaaugcccugaaggaaguaugcaagccagaaguuucccuagucaucuuaucgacaucuccugccuuagggggaccagucgguucacauuugaccuugggaagguuacucaggccaacaguccagaagacagaauggugagguccaaggcagacaugucaagauaguugagauuggaggcugcacagugguuuaagagcgcauugcugcucuugcagagacgguucaguucuaagcacccacaugguggcucccaaccaucuguaacuccaguuccaggggauuugacaacguauucugaccuuuucauccuccuguacacauauaggagacaugcauguacacauauaacauuguauaugauaaauuaugucaugugugagaugugugugugugugugugugugugacaguuaagguugagaaguccuguaauaucccaggguaaaaugaugccaacugggccaaagggugguaaaggggacgggaagaaacaggcacacaaacacucuuuaaaggguggugccuggacaggacugagggagcacuagggacagauaugaagaagaccauuaaagagucucugagguuguugccuuacagaacagacuggauaaugccaccacuuaccaauacagagaauaccgaagaggaccagguagagguuggcuuugggcaucccuacguggaggugccuacaggaaaguagucuggggaagaaggcaaagccaagcugggggugugagccugugaggacccaagaggugacaugggagugaaagaaagaucucucauguaucugucccugugaaagccucagcaacuguaguaaaggcugcuugauaguggcgggaugcaggcaaagccaguuuuagaauggcuugagaaagaguaggaggugaagaaaugaagacagcuuggcugagagcuuagcuugugaagagaggguagcuggaggcgggugugagauucaggaagguuuguguuguuuuuaaugaagagacucggcauuuguaaaggccagugggaaggauuuggauucuuuggugcugggauggaggagcgggagcccauguagcacggugauugaauuagccugaggaaaaggggaucaugucuagaaugggugccuggcaaaggagcgaggagggaauugucuucccagcccagaugaaaacuggggccugagccagggggaaggcucgaguggcuggggcagccucaggcccaggaaggcuagaguaacaagacuagagugggcucagggcccaggagauaggaggcuucugcaacuaauccccccccacaccaccacuaacugccuuguuuggcaguaagaguacuggguggcucagcuccugccucaggccugcaccaaacugaaagggagaggcugccaagagcugcccaaggggcucaguuagaaauguugaaagacagcuccagaaaucauuucucagcagcaggaccacaugcauagcaggagcagccagacauugcugcggagggagucucaacguuuuccuguuuuguuguggagagggagaggcaagagcgauaggagucugaagcccuggaaaagggcaggcuggggaaggagaggggcccaggagugaggaaaguuguucuuucuuggccuuagcccuguuugucugagagaaaccuuccucagguggaagagucagacugggaccagagagaaaacaaggcucaggaccuugugguagagaaggaggaacucugaagagaggagagacaggaaaaggcccuggacaacggggucccuggauagagguuucagucuaguguaaagaaguggccaaucugcucaagcuagccuuuacacagaucccaaguagugucccucccaugaacagguuacagggacugugucaggaggggacccauuucuggugcucaaagcuaagcccuaaagguacagaaaggggucccgguaagcggggugaggccuuuuaaccauuaacccagcugguugaaaucugccaugcggagccuccaggcucuaucgauuauuuuaaaagcacagccacuguuaacugguggcugcccagaaaccagggagaggcacagaaguagagguggggagaagcaggcagggaggaaaaugggagcccagccaggagugggagccggagaggaggucugagguaggauucacggcuuggccaucaauguaggggaggcuuugggggugaucagaaaaccuaagcuggcauuggaaucagccagcacagcccaugggcacugcugagcccugaagccaggaaagggccuggcagaugggacaaaacaagcucaugaccauggugaccuucgcaaggugacuaggucagagcuuugcugacuucacugagaaaggaagggaaggccacugggaaagcugaggugcagggagagagagggcagagagaguccaugacaggcugcuggguuuuccugaggacagggcccuuucccugauccuccuauacagcaaaaacaucacggucugguguggcugagggcagggucaggccaucagagucugacugcaccuggccugcuauguaugcacucugcuucauaguuaguuuuacaaagcuaauuucauuugugagguggcuaaauggggaggugaggaacccucagacuaaagcuggcuucuggagaagaucagguugaaggaugcuugugugauaaagaaacaggguugcuauaacuuggaucuaaacuguaccccaacggaccauguguuuucaguguggugcuagugggaggaagucagguaacuggggguauacucuaggaggagauauuaggacucuggcuccuuccucuuccucugcuucuuggcugcgguggcagguccccuuugucacacgacguacuauguugacacauaccaaagcaauguggccuagugaccacagacugaaacaucugaaacccuaagcuauguaguugagguggggaggaaggggcaggcacacgguggguggcaugugccucagcauccuggagguuggggaagaauaaaggaucaaagucacucucaguuucaaagugagcucaagagccauuuugggugacaggagacccuucuuuuaaaaaaaaaaaaaaaaggcaaggaagagaaggaagaaaagaaggaagaggaggaggaaaccagagacacaaaauacauuuuuacacuuuccuaaguugcuuuaggcaggugucaccaugguggaagcuaauacaagucacaguggaaagugacugcagguaaggaaaggugaaaugagggacagucugcacaugcauaaacuucaugacucaucacaggaugcauacauuggcaggauuugcggacagcgguuuuggcucugugauaucaucuggucauuuuugggaguccagggucagugguuucaaccaguuugaccuagaaggcaucuccagguuugaaaaacaauuuuaaaacaacaaccaaaauccugaacaacccuuaccaagguggguaaccaaacagaagaggcugcuauuuuuuuccuuuauuaguuaagcgacuucuaaaaucagugaugagcacagguaauugaaagcaaaugaagauacagaguuuauuuggguuuuucaugaguguaauguucucuuugguuuuuacaauuuaaagaggaugguccaauccucuuugaaaaggaaaagaauaugauuccuuucauuaagaggaguugaucacaagcaguagagcgggggacacauuaguagaggugcuaggagagagcugugcacacacagccaggacagagacacagcugucuguccacucucagccauggcacuccuggaugcccauucuuucugacgauggcacacauaagcuuaaguaacucaggagaaaccacauuauggguguggggcauggagucccacacacaccuggguaccaaugugcccuacccacugaucccacacaucuuuccuugccagugccagauggaguggaucagccgcagcagaggccucuugauggcagagagaaauagugacgaucaggugacaggaaacacuagcaugucacagacagacgcaagugcagucucugaggcucaggaggacccucaaagucugccuguggccuuggugccagugcugucggccuggcugcucuuauuccguggacagguccaccaggaccacaggccgguggguccagagccgucugucugcaaugucuuuucucuccccuuucucugacagcucaacauccugguggacacgggcaguaguaacuuugcagugggggcugccccacacccuuuccugcaucgcuacuaccagaggcagcuguaaguccuggggaggggugggagaggguucaagaacaagagccuuucuucuacuagggagggggaaagcaaaaggaggcagcuggggccaggaagaaagacagugugggaaaggguggguuaaggggcagacaugaagugcuucugccccaaggcucccagagcagaacaugaaccaucucauuuucugucuauauggacaggcaguagggccaacccacugucauagcuagaguuuagaaggcugaacaggcuagugguuagugccuuucaccauguucucaccggggacugggggcugcucuggguaguuacacgugauuuaagcaagaugaaggaacuaggcauguugguauauaccaguaaucccagcauuuggaggacuguggagacuacacagcaacucucaaagagccaaaaaaacgggagcugggagaugacucagugacuaagaacuuacuaugaaagcaagaagacugaguucaaguucuaguaccuaccuaaagccugccauggcuugcaugcuuguaaccccaauauugacaggcuaagauaggcagaucuagcuuucuggacagcauagcugaaacuucagguuuagugagagacccugucucaaaaaauaaaauggagagcgauuauccucuggcuucugcaugcacaugugugcacauacuccauguacaacaaaaaccauacucuucuccaguuuuaaaaagccagaaaauaagaaggaaagagucuuucaugacccccacugaauugucuccagguaccacuacaacugccaccagcuggguuccgcucaguggugggagauggacuagaauggguuuuuauguaagagagacaugaggaguguugugaaagacugguuauaaaagcagauugaggauguggugaggagaaucuaguguuggcaguaugucuguaugagacaggaggaagguguggccuccacauaguacaggcuuacacccuaaccuuggacuuguaggaaaguacaaaaccacuguccuguuuccuuuugcccuaagaacacaguuggggaaggaguaagcuggguaagaucagugcgaggacauccauuauaaguuuucaugcagugccaucagcccuggguaguuacaugaugaagagaaacagcaggggcauugcacagcagugagugcaacuacucuuguggauuccaaccccugccugcugugccaggacacuugcucggauuuucuguagagguuauuccauggcuuccacagucacucugccuaguucucuccccaccacucaguugguaccacugggccccaaggcagcaagagagucaauggcuccuuuucucugugagugugauggaucuggggugggggaggagauguccaauagcugucuuugcagcagccauagacacaauguacaaagcccaucuuguucuuuagccugagcuucagguccaacaauauacacuauggggacaggagagcaauccccagcuacagcuaucuaucugcagggaugcuugacauucugcucuggguaacagggcuaggguuguucagcugagcagauucuagaaugccauauagagugcauuugggaauauaucugaugacacacaucuauuguuacagcuuugcuuccuuuuuauagguccagcacauaucgagaccuccgaaaggguguguaugugcccuacacccagggcaagugggagggggaacugggcaccgaccuggugagcaucccucauggccccaacgucacugugcgugccaacauugcugccaucacugaaucggacaaguucuucaucaaugguuccaacugggagggcauccuagggcuggccuaugcugagauugccagggugagagaaucaagccuguugccugcauguugcucacugcaugcuacacaaggaaggagccaagagagagaagggggaaggauggauugaaaggguaaacaaggggcuggagagauggcucagugagaauagugcuuacccagcagucaugaguuuaauccucacaacuaaacuuuucaaaacugcugggugugauacuauguacuuauaaucccagcucuggaaagccaaggucaaguaaauccuggggcuuccuggccauuaagccuagcuuacuagaccaguucccagccaaugagagacccugccuuagaaaccgagguagaaugccgcuagagagauggcucagcacuugcugcucuuccaaggggcccaggguuaauuccuagcauccaugugccagcucacaacuccacuuccagggauccaaugcccucuuuuggucucuagaagcaacaagcacaugaauggugcacaggcauagaggcaggcaaaacacccauauucauagaaacacauuuuuuuuuuuuuuuuugagacaggguuucucuguauagcccuggcuguccuguaacucucuacguagaccaggcuggggauaaacucauagagauuccccugccccugccucccaggugcugggauaaaaggcaugugccacuucugcccagcauaaaaacaaaauccauuuuaaaacaaaacaaacuagggcuagugagauggcuugguguguuaggaauccuugccaaagccuaagagccaugugguggaaggaacgaacucauuucugcacaggccucucucucaccuucacacccuugcugcacaagccagugcacacacagggaauauucuuaaagguacacagauucucaagaauaauauccaagauuguccuuuggucuccaaaugugugugugcacagacacaugcacacacacacacacacacacacacacacacacacacacacacacgauauaggaagaggaacaggugcuacaggaacaggaggaggcuguccccaaaucugaaacaagugaaucacguggggcuggaggaaggugcuauggccucgaaacaccugccucugcacugcaguaucucuuauccuugcucaguacuuccuuggucuuuccugaggaacauccccaagcuuugacuuugcccuugaguaccgacaggaagcggaccugucugguagccccugugugaggauuuauuccuguuucucucugccacagcccgacgacucuuuggagcccuucuuugacucccuggugaagcagacccacauucccaacaucuuuucccugcagcucuguggcgcuggcuucccccucaaccagaccgaggcacuggccucggugggagggagcauggugaguaggcccucagagggccaugugccuucucccucauggccggaaucaagaaaccccuuuaaagucccgauucuugcuucccuccuuuccuuuucuucauugcuguucuugaaaggaauugaaucucucauggaagggaucagaaacaauuagguacauuucaaagaaaaugaaaauuaguccuguagauuacugucugagucugagaacaguauguaaggacucuguuaagagcgcauuaaugggcuggagagauggcucagcagauaagagcacugacugcuuuuccagagauccugaguucaauucacaauaaccacaugguggcucacaaccaucuguaaugggaucugaugcccucuucuggugugucugaagacagcgacaguguacuuguauaaaaacaaagaaacaaacaaacagagcauguuaaggcugguaucuggagccaugacugacccagaacucacuauguaguccaggcuggccucagauaugcagcacucccuccuuccauuuuccaaguauaugccaccagacucaguucaagcccauuuauuaauuaggacaguaacaaguauucuccaacaagcaaagacaagaaaauguaugaaagcagcauacaaucaguucauuccacguuuauuguacuagcuuaggcuuaaauaacuuucggucaagggcuauagauuuugauacaaauaaucccgauguguuucuucuccugaacacauuuaggaaacuaaauauuaccaugcauggggcaugaugggagauuagagagaaucuuggcaccccaagaaauggcugaucuuauuauuuagucuuggguaacuugcucuccuucugugcuaggacauaggugucugucucuuuuucuuuuagaucauuggugguaucgaccacucgcuauacacgggcagucucugguacacacccauccggcgggagugguauuaugaagugaucauuguacguguggaaaucaauggucaagaucucaagauggacugcaaggagguaaugggauggaggggauucucgugagcauaaggggagucucacagugugugagagccaugaggguggaagcacaggaucacgaggcaaucccuaaggugaagggcggggccuggcagagcagucacagagccuggaccacaugacuuaaguauaguaaugaaaacaugaaagaguuccuuucuggacucuagucacugccucuucagccuugggcaaggcuuuugugaggcagagguuggaccugacuagaguccugcuguuacuaagugcccucaggcuccucacuacagugccagacuccucaucuacaaggcagagguagaaauacacaagcguucucacagacuguaaaggucaaagccaauguaugaaguguuagucguuaugcuuggcauacccaaaugccaacacuuagggucucuuucccuagauuuuguuuuacauuuauugggaugaggauggggcaugugccacagcuuguguauggagguuagaggacaauuuucaguaacuaguaggucucucugggguugaacucaggucaucagacuugguagcaggugcccuuaccuaucucaacagcccccuuuuuuggcuuuuuugaggaucuuauguagcccacgcugaccucagacuugcuagguagcuaaagaugaccuugaacuccugguccuccuuucucugacucucaagugucucucuacaggcauauaccaccaugcagcaucagagcucaagcucauggcuuugugcgugcugagccacccuucucuccauuauaauguauggugaaugagaauaacuacauaaaaguacuagaaguuacaaauaccacacaaggcauuucugcuuuagauuuagagaacaccuacccgcacaaggugacgaaguuaguacuuaccaagugccugggaucugccaggaccuacuuagugcuuucagccuuuugaccuauguaauccuuaugguaaccuuugagguaggcacuguuauuaucuucaauuuagaacaagagaacagguacacagagguuaagcaacgugcccaaggacgcacauauacaaaaugggaaagcuaagaugccaaccccaguaggaugcuuagcugucagauucaccccucccaccucucccccccucucuccucaguacaacuacgacaagagcauuguggacagugggaccaccaaccuucgcuugcccaagaaaguauuugaagcugccgucaaguccaucaaggcagccuccucggucagugacagucacacuccucagcaagcccuaaagauacguagauccuucccaucaggcgcuuacaaaccacugcucuguugacuuggcauugagaugccuuuuuuuuuuuuuuuuuuuuuuuugagauggggucaugaacguagcccagguuagcauugaacuugacaacuucaugccuuagccuucuaaguucugggaccacaggcagugugagccaccaugcccacucacagcuuuaugaggccaguaucucacuuucuccuccugauccguagacuucaguuuaccuuugcuacuuuggaaaauucccuggaaaagcacacagugguacugucacugugguucugaacacagagaagacauggugggauaggccgaggcuucacauuccucucuugucaacagacggagaaguucccggauggcuuuuggcuaggggagcagcuggugugcuggcaagcaggcacgaccccuuggaacauuuucccagucauuucacuuuaccucaugggugaagucaccaaucaguccuuccgcaucaccauccuuccucagguauguccccaagcugagacaguggggugccaagcagcagacaaaguauguaaagagacauagcuugcuacaacuugaaagaugaaacgaauguguggugguaaaggggucucagaagaauccacaucuuggggcuugaggaagaguguaggagacuaaaaggcagaggaaggcaggaagaaucagacaugcucucacccugugacuguuuaccccuagcaauaccuacggccgguggaggacguggccacgucccaagacgacuguuacaaguucgcugucucacagucauccacgggcacuguuaugggagccgucaucauggaagguuucuaugucgucuucgaucgagcccgaaagcgaauuggcuuugcugucagcgcuugccauggugaggaggguguggggucagucagcucauguucuugcugucagcugcuaauacccagaucucuuuguuugggagguaguaguagcugccucuggcuaaucaaccaugugugagagcuagggcuaaggcuugcucuggugaacacgccugguggggaaagcacuauuggaaacugauagcagcucgagcuucccaggcacuuggaaauacuagcugcaaggguggcugcccgcccacaguaaagcugaguacuacugcagaaaagggccagggcuuugugguugcauuuucaugaagacagguaagucugcuauguguggaaggagcuagauuuuggucaacuuggaacuguugacuuugauaucaccucuacuggaugugagaaugggagaggcuugcaguccaguucccgaggcccuggaaggagaaacagccucccucaguacuagcuucccugccuacugcucgcucuguccaaguugggcucugcagucucacuuggguggaucccaaggggccccugucaggaagcucuuuuaauuguauaaccuaagcuacucuaugacaguaagagcuaccgguucaucuccacccucucuccagugcacgaugaguucaggacggcggcaguggaagguccguuuguuacggcagacauggaagacuguggcuacaacauuccccagacagaugagucaacacuuaugaccauagccuaugucauggcggccaucugcgcccucuucauguugccacucugccucaugguaugucaguggcgcugccugcguugccugcgccaccagcacgaugacuuugcugaugacaucucccugcucaaguaaggaggcccgugggcagaugauggagacgccccuggaccacaucugggugguucccuuuggucacaugaguuggagcuauggaugguaccuguggccagagcaccucaggacccucaccaaccugccaaugcuucuggcgugacagaacagagaaaucaggcaagcuggauuacagggcuugcaccuguaggacacaggagagggaaggaagcagcguucugguggcaggaauauccuuagacaccacaaacuugaguuggaaauuuugcugcuugaagcuucagcccugacccucugcccagcauccuuuagagucuccaaccuaaaguauucuuuauguccuuccagaaguacuggcgucauacucaggcuacccggcaugugucccugugguacccuggcagagaaagggccaaucucauucccugcuggccaaagucagcagaagaaagugaaguuugccaguugcuuuagugauagggacugcagacucaagccuacacugguacaaagacugcgucuugagauaaacaagaaccuaugcgaugcgaauguuuauacuccugggggcagucaagaugaggagacaggauaggauagagacaggaaggagaugguagcaaaacugggaaaggcagaacucugaucacuuucuaguuccaaguuuagacucaucuccaagacagaagcccaucuggacuaagagguaucauuccccaaugugccugugguuguagucugaacugaaaugaaaugggggaaaaagggcuuauuagccaaagagcucuuuuuaacacucuuagaggaacagugcucaugagaaaagucccacuggacagaugaauuccuaucuuguuaauucugucucucucugcuucuucaacaugcuaaguggcaccaaaaugacccaaccccaaggucuuaggugcccuaugggacaacaguuagaauauuguagggcuagggauggucuucccagcauagguucacuccaaccaaggugcuaaaaggaacagacaggagaguccuccucucugauccacaaaggcagagcccucaagauucauccagcaggguuagggcugaugcauuugccucugccuggauuuuguuuuuauuuucuuucuuuuugcccagugguacaaaacgauaagcucuuuauggaauacugaguggguucauuccucucuugcccucuccaauggccccucuauuuaucuggcuaaggaaacaccacgcauuggcuaguauuaaacagcaacuguaagauagagggcuuucuguucuaugucauugccuucaguaucaaggcugccuggagaaaggauggcagccucagggcuuccuuacuuucuucuccuuuccugacagagcagccuuucuguccugcucucugcugccccucccaauauaauccauggguacccaggcugguucuugggcuagguugugggggccacacucaccucuucccugccaguucuaacacgacagacaugaagccaguguuagugggaagagcuggguuuucccaggaugaccacugcauccucuccugguacgcucuacacugcuuucaggcuggggaccugccaagugugggacaguugaugaggaagagacauuagcagggccucuggaguugcuggcccagccagcugcccacaagccauaaaccaauaaaauaagaauccugcgucacaguuuccagcuggguccucuuccuugcccucgcacuggugcugcucuggcugaguaggaauacacccacagacugccaggaagauggagacuguccgcuuccggcucagaacuacaguguaauuaagcuuccaggaucacuaccaugaaaacgccgcauucugcuuuaucauuucuacccauguugggaaaaacuggcuuuuuccccauuucuuuacagggcaaaaaaaaaaaaaaaaaaagggagagagagagagaacucaaccuaguuguuauuuacccuaguaacugguguucuauuuuuuuuuaaagggggaaaauuugcauuuauuuuucuuuugaugguuaacuccuuuguaucauaaaauuaugaacucugauauguaaaacagaaaaaaaucuugacaacagcuucucgcuuguaaaaauauguauuauacagcucuauuuucaaagucuccugaaaaaugacugaccuaucuccacuguauguggggcuuugcuaccgucuguaugaacggaggcccagugggcagaggugauacaaacaggcauggcagacucugaguguuuuucugacuguuucucugcaaagauagagccacagugaugaggcuccaacuguggagguccacucuccaaaaugcugccuuucuggggcucgcucugagagacagcuuggccccaucauuccugcuuuuuuucuucucuacucuuuuggcuucuaagauuuuuuuuuaaaagaaaaguaguuuuuuucuuacuuucuuuuuuccuuucugucuucuuuuugucugucugucuuucucuuuucuuuucuuugacagcaucucauguagaucaggcuggccucaaacuuguagcaacguuccugccuuugccuccugagugcuaggauuacaggugugugccacaacuccuccucgauagaaaccgugugugugugugugugugugugugugugugugugugugugugugugugugugugugugugugugugauuacaugcgugucuguaggggaaggggccaggaggaugagauauggucucauguagcucaggcuagccuugaacuccugacccuccuguguguccaccucccauaugccaugauuacaggcuugugccacuauguuuaacuaaacacaacauucuuuaugcucacuuucaauguacaguuuucaggugacagugagguacuacauagcuagugcuggaugcugcacaguugaagggagagagcaaucuuaagacagaaaaugaaugaaugaaucugccacaugaaauaaacaaaggaaguagacuuccauuuugccaccuuuuucuguucaaguaguaccaaacuggagacaagaagacagaaguacuucauuaaccaaagaaaggaggucaccugaccucuaaaaaggaagacucaggccauucccccuuaaagauuuuaagguaacccugggaaguccaccccuaaucaugcuuaucaaucaaccuggacaauaaggcaagagaaaagaauucauccaugagcucauaggcaaggcagagaaaaacaagagaauuuaguuagcucagaaaggacaaagucuuugcuauccuaacagaaacugcuagacucaauaagcacccccagucccaggaugggaaaacaucaauugucaguagcauguuacccuucccccagaugcauuuuuucucaauuaacacuuguuuaauucugaaaaaagaagguaauuaaaaccauuuccuguaggaguaaagauaaagauugggaaagacucaagguucucagagccacagcugucucagacauaaaaaccagaagaacucaguaaguggcgguggcaaaccuaucuuccuccagaugggaauccacaaagcauagcuuacaacuguaccaccuuccuucaucucacugucuccacuguauucuagacagggaauguauccuucauagcguucuugauugauaaaugaaguccaacaucccacgauuauucugcaaguaauuuugcacagacaucucaccccagugccugucuggagcucaccuaaggucaccaaaucacuugguggugaaccaauugccuuaaccuuuggggggaggggauagcuagauuaggaaaccagaggaauggaagggugagcacuuugcaagccuggcuggucagugcuuaguggaggcuaaaccaguagcaacaagggaugguggcuuggcccaggggaaaaaucugugaauugugcuuuucuaucuagaaagcagaguagacagaagauggugggagaaauggaaccugauuuuguuguucuuggacuguggauuuuacugacauaaaacagaauauccuguauaccugauaucaauguauaaauaaugaggauuaacacaguaaaauguucaaugaaucaaacuaucagaguuacauuuguuccccucagucaguaucauuuugucuauuggaguagaguggcuaaacuaacaccaaggcuuggaggccccugcaaggccagcaucuggaugcacagcaggugagcaccagacaucacaucugcauacacaagccuuauaaaaauggacuagaggcugggacaaaccaaagcaggauggccuuacagcaacagcagcuuccuagauggguuagacaacaguccuaugcagggaucaugauuucaaggccaaauuaaacaucauauaucccuacagucugcauccccccaaaaacugcaagaugaggggaaaagggguguuucugcauuauauacauacuuucauuacgaacauuugaauacagacuuucuauacacacauuaccuauauaauaaaaauguacacggcaugaguauaugucacuguauaaauauauagaguuuuagaaaucuugaacccgcgcuuccuguucgcaucuguuucuccucuucuuccuccccagucggguccaucauuuaagaguugggcaaaagggacaagugucauuuguguuggucugggcccagaauuugauacacuggaaagaaagagacacacauauaccucagacuuagcugggaaaacaaaguaaggucaguagagagugccauuaaagaucacaagaucuagccgggcaugguggcacacgccuuuaaucccaauacucgugaggcagaggcagacagauuucugaguucaaggccagccuggucuacaaagugaguuccaugacagccagggcuauacagagaaacccugucucagaaaaaaaaaaaaggaucacaagaucuaacucucaaaaauucucacagggaucagauggacuagcagggccauuucaguggucuuucuguguguuauguguuguaugcacauguuaguaugaaaacaugcaugugcauaugugcauggaggacugagguuaacacaggugccuuuauuuuacuguuaaaaaaauauguacucaauguaugaguguguggccucagaguuuuuucuuaucaagaauauaaaugcugggcuaaagauguaguuuccagu

SEQ ID NO: 5070 - RNA, 2314 nt, Mus musculus
cccaccucucccccccucucuccucaguacaacuacgacaagagcauuguggacagugggaccaccaaccuucgcuugcccaagaaaguauuugaagcugccgucaaguccaucaaggcagccuccucggucagugacagucacacuccucagcaagcccuaaagauacguagauccuucccaucaggcgcuuacaaaccacugcucuguugacuuggcauugagaugccuuuuuuuuuuuuuuuuuuuuuuuugagauggggucaugaacguagcccagguuagcauugaacuugacaacuucaugccuuagccuucuaaguucugggaccacaggcagugugagccaccaugcccacucacagcuuuaugaggccaguaucucacuuucuccuccugauccguagacuucaguuuaccuuugcuacuuuggaaaauucccuggaaaagcacacagugguacugucacugugguucugaacacagagaagacauggugggauaggccgaggcuucacauuccucucuugucaacagacggagaaguucccggauggcuuuuggcuaggggagcagcuggugugcuggcaagcaggcacgaccccuuggaacauuuucccagucauuucacuuuaccucaugggugaagucaccaaucaguccuuccgcaucaccauccuuccucagguauguccccaagcugagacaguggggugccaagcagcagacaaaguauguaaagagacauagcuugcuacaacuugaaagaugaaacgaauguguggugguaaaggggucucagaagaauccacaucuuggggcuugaggaagaguguaggagacuaaaaggcagaggaaggcaggaagaaucagacaugcucucacccugugacuguuuaccccuagcaauaccuacggccgguggaggacguggccacgucccaagacgacuguuacaaguucgcugucucacagucauccacgggcacuguuaugggagccgucaucauggaagguuucuaugucgucuucgaucgagcccgaaagcgaauuggcuuugcugucagcgcuugccauggugaggaggguguggggucagucagcucauguucuugcugucagcugcuaauacccagaucucuuuguuugggagguaguaguagcugccucuggcuaaucaaccaugugugagagcuagggcuaaggcuugcucuggugaacacgccugguggggaaagcacuauuggaaacugauagcagcucgagcuucccaggcacuuggaaauacuagcugcaaggguggcugcccgcccacaguaaagcugaguacuacugcagaaaagggccagggcuuugugguugcauuuucaugaagacagguaagucugcuauguguggaaggagcuagauuuuggucaacuuggaacuguugacuuugauaucaccucuacuggaugugagaaugggagaggcuugcaguccaguucccgaggcccuggaaggagaaacagccucccucaguacuagcuucccugccuacugcucgcucuguccaaguugggcucugcagucucacuuggguggaucccaaggggccccugucaggaagcucuuuuaauuguauaaccuaagcuacucuaugacaguaagagcuaccgguucaucuccacccucucuccagugcacgaugaguucaggacggcggcaguggaagguccguuuguuacggcagacauggaagacuguggcuacaacauuccccagacagaugagucaacacuuaugaccauagccuaugucauggcggccaucugcgcccucuucauguugccacucugccucaugguaugucaguggcgcugccugcguugccugcgccaccagcacgaugacuuugcugaugacaucucccugcucaaguaaggaggcccgugggcagaugauggagacgccccuggaccacaucugggugguucccuuuggucacaugaguuggagcuauggaugguaccuguggccagagcaccucaggacccucaccaaccugccaaugcuucuggcgugacagaacagagaaaucaggcaagcuggauuacagggcuugcaccuguaggacacaggagagggaaggaagcagcguucugguggcaggaauauccuuagacaccacaaacuugaguuggaaauuuugcugcuugaagcuucagcccugacccucugcccagcauccuuuagagucuccaaccuaaaguauucuuuauguccuuccagaaguacuggcgucauacucaggcuacccggcaugugucccugu

SEQ ID NO: 5071 - RNA, 27483 nt, Mus musculus
uugacaacuucccaacagaaaccaggcuuuugaguccuccaggguagcuugagaggguacucagaaagccguguccauguccccuuuccuucaccucagggaaguaaguugccuauaggguugucauuucaaugaggucuucugguuauucuguuuuucucucaauguugguguugggcucagggaaugcuuuggagaagguggugggaacuggagaagggaagaucaguuuacuguguaaacucacugguuaaaguacccccucccuuccacccugcaauacacacacacacacacacacacacacacacacacacacacaccccaucucgaagagcucuauuaagcuccaggugcacuguaguucacagacugcaucuuccagguuugcucccacuucacaagcagagaacucauaacugaagggggugacagcacaggggaagggaaagcaagauguuuagagucugacagcuggcccgggaccagagccaugugguaauguuugcuccacucccuaccaccuccacggcugugauguggagaagguccccgcuuucaugggaaggaggugggggagccugucaucugcuccaugcucacacaauuuuucucucaaccaaugaccucucagaagcagggguugguuugcaaaauucuucagauaccucaacagauggcaucccacucaggcuaucccugcugacuaggucuggcuccagcccugacuguaucuacccagggaccuaccugccugcuuugcuccuauagccuuccuccgugucuggguccccagagagcugccggacauaggccuuugaggcaacagcuggcauacaggccaggcuucccaugcucuggcuagcagauucucugcccuggaggacuuugacugcaugguuucucucacugcugcaacagucagagcuggcccacacgggcacaacagcgcacuuccaucugggucucccugagaaugccgcuguuuucugagaacccuuggacucugguggcuuuaucaggucuuuuugucagcugcgcuuugggggaugaacuuugcucuucuggcuucugggucagaggguaaagauuugguggcaaccgguagcuagagaaagauagcuacuggcugaauuuggaggacauggcuucuggaaaaccucucuagugcuuuucuggcuagucuuggcaaaguaaaaaugcucugauagccagcccgggugaugcagggcuuccuguucgaggccuuucuguacaaaauuagugagacauugccucaaaacuaugaaacaagccagacucuguugaagcacgccuuuaaucccagcacucaggaggcugaagcaggcaagaucucuguuaguuggaggccagucuacaggaaaguucuacaacagcagaggccagacagugcaacccuuucugggggugugggggaggaaaacccaacaaaaacacaaacuauaaaacaaagagaaggccgaggacaaagcuuagcaaugcauacuucccuuucuaugugaagcccugggcuccaccaguacugcagaaagaagcaagcaaugagggacaggagguuggcucuaggccagggguugucaaaauaguccacaggccaaaggcagccugaugucuguuuuuauaaacaaaauuuuauuggcacacauugguuauguaucagcuaggcuauuuucauacaauagaggccauauggucuguaaagucuaaaauauuuacucugcuguuuuacauaaaaaguugacagacucuugcucuagacugacaaauaucuaagaccuuguuuucugagguucaaguucagaggggucucugcagcaaguggguaaagcuggucuaggucaugcuaugaugucuagggucccucagaguggaaggccugcuuagcacaaaugaaguaaaguaacuugcuggcucuuuguucuuuucuccacacucuauacuuuagcucugccucaacauggccaacaaggguccauccuacggcaugagccgagaagugcaguccaaaauugagaagaaguaugacgaggagcuggaggagcgacuaguggaguggauuguagugcaguguggcccugauguaggccgcccagaucgugggcgccugggcuuccagguguggcugaagaaugguguggugaguaacccuugcgaagggaaucuagggauguguaugccacccuacaaacugugagacagacucccugagcugaguguucaguuguguucuguaccuggcagauucugagcaaauuggugaacagccuguauccugagggaucgaagccagugaaggugccugagaacccacccuccauggucuuuaagcagauggaacagguggcucaauucuugaaggcagcugaagauuauggagucaucaagacugacauguuccagacuguugaccucuaugaagguauaaggaaaaaagggcuggagccagugggcgaguggagagcaagauuaucagucaaggagaaggaauaucaaaagccacaaccagcucuguugauguguucauagcaggaaugggauaugccaagagaacacauagcaaggggaccagcuuggugguacagcauuucccuucuggguacaagggccuguuuuggauccuagaauaucaaauauauaccacaccauacucacuaggguuuagaauauggucucuugaacccucuugauuuggugccacuugcucuugguuggaccauuuuugaagcugggcagguauugccuauaugguccugaaauuagcucccuggccacucuucucauagguaaggauauggcagcagugcagaggacucuaauggcuuugggcaguuuggcugugaccaaaaacgauggaaacuaccguggagaucccaacugguuuaugaaguauguguccacugggucucucugugggguugggguggcuugggcuggucaguugugguaaagaucagguguagcagagccagggacgucccagguaaggguguuggacuaggggaaaugagguccuacuucugcauuccuaccuuuugccagcgugugcuccaccaggcucccuaacuccuggagccaaacucaggggaaaaaaagagaagacaaacaggaaaggaagggagucgaacagggaagcagcagggaucaggaaacaguuggagaacacuaaguucuagcaagccuuacccugguuccuuuucuucuaggaaagcccaggagcauaagagggacuucacagacagccaacugcaggaggggaagcacgucauuggccuucaaaugggcagcaacagaggagccucgcaggcuggcaugacaggcuaugggcgaccccggcagaucaucaguuagaaagggaaggccagcccugagcugcagcauccugcuuagccugccucacaaaugccuauguagguucuuagcccugacagcucugaggugucacugggcaaagaugacugcacaugggcagcucccaccuauccuuagccucagcccagcaucuuaccccagagccaccacugcccuggccccuguucccagcuguacccccaccucuacuguuccucucauccuggaguaagcagggagaagugggcugggguagccuggcuguaggccagcccacuguccuugauaucgaauguccuuugaaggagacccagcccagccucuacaucuuuuccuggaauauguuuuuggguugaaauucaaaaaggaaaaaagaaaaauauauaaauauauauauauauacauguaucuccaucuuuucuccggccuggcuggcaguuugguuugucacuccuguuagcauuccaggaacccugaggguggaagcauguugggcucacacguuccuggccgauggcuucuggaugacuccucuggccccacaggcucagagcuucagaggaagcaggcuauggagaagaagagugaccugcaucugcauagcucugguuuggcagaaggagagaauacugggagugguggacuuguuuggguuuuuauacuucugcuuuuuauuuuggaaagcugugcagaaaaaaauucaacaaaauguugcuuugaaaaguaaaaaucaaaucuuaagcauuaaaaaauucauauuaacaauuagcucagaagaugggaaggggagaaggccaagaacggaggaaaagucaggcagacagcuggccucuggaaugaaggccauuucccugagcacggugcagaggaagacagguggucagagacagugcucccaggcuaucuuugaaaaugcugugucuuagcucucugaaguccagcuggccaacuuccccaaugaggcagcaagggugcugggaauccugugccucccaguucuccugggaacacgucaccauuccuucagcagaaagggcgaaugguagugaagauguggacagguuuaaguuggcuucagaacaggcgcacagaaaaggguaaugaaggcagcugcuuucaggguaggcauguccaggcucuuagcagccucucucuggucccuuggcagugacacuucugacaagagcauuucuagguauauagggacuugcugcauaacuaacucaugaaugaguagagguccugguggucuaggacacugacuagcuccagagagcgaggaaaucaagggcugccuggucuuggugccaaucccuugucaaagguucucagccaaguucagcuagagaagccaugaucaccagucccuuaccacugcauuaagauggcccucacccuccugaggaggcugcaaaugcuucagaggccuggggucccagaugucacuaucaggaccauucccuccugagcuuccacgauugaaagccucauaaccgaguuuaggaagugccuguuguacaugggggaagcugggcucuggggucagcaaaucugcccgcucuuccccugcagcaggucuggggguugguguggaggacaauccagcucuggggccaggaagcuagaugcaguugugcaguccccaugcucugaauccacuccauccagguccuugcugcugcacaguggcauugauucuagugcugucccugcauccuuggaguuuugccuucguggggcccaggggcagcaucccuuccugcagccauggguggaagccuuguuccucuggcucaggcacacuucuagcauguaguaaauaguccagaagacacugaagcagccuaccagcacaagggucugcaaaaccaagcacugguggguuagugacaggucuagcccagaaacacgagcccagacagccucucuuuuguuuuguuuuguuuuguuuguuuuuucaagacaggguuucucuguauagcccuaacuauccuggaacucacuuuguagaccaggcuggccucaaacucagaaaucugccugccucugccucccgagugcugggauuaaaggcgugugccaccacgcccggcucagccucucuuuucugagaccauguuucccaacccaacccaacccaacccaacccaacccaacccaacccaacccaaccacugcccuaacuuuccuuauauaaaaguacuuuccucuaggaggaugcuaacagugaugcuaaaaacuaauguccuccaaaucucucauuuuccauuucaucuggaguaauaccaaggaacaacucccucucccccaaaacacacaccccaggacaguccugucagcuauacccagaguccccaucucuguaccuugaguguguuagggguaaugguguagccauccuccucagggauuuucagcccaggugggcaaggcagggugaagccaucaugcagguauuuuccacucauagcacuuucuaagagacuacaggacaaaaagagacaaggauacacuacuaaguuauagaaacacuacuuaugccaucugccccaaccuuguagcugaagagagugaggggagccccaaggaggaaaggcuacccagcccaugacuguuuccacuggccuaagccuaaagcacagcuggcauucagaaggaggcugggcuuccccacuucucuuuccucugauggauguaccuaccuuugucuguccuugaugucuacuggacuccacauggagccauacagggucagcugccacugcuggaggaugcccaucuggagcggcucaucuccuagggcaauaaguagguaggcaugagcuguguacuguuggccaugcauaacaauagagccuggcccacccagccacccaagggaauccagaccauguggucugccacaguuuaugucccauggacccgcaaggguccugcagaaguaucucacagggcauccuagggacagacaggaagggcaggggaaagcaguguuuugccuuugccucccauacucuggggguucaccuggacuuuuccuucucaggaaaacauguccuucuauuaaaacaaaagcuccaaagcugccagucaagugaauacuauacugacuggaggcuggugauacugcaguuauugaauauuuuugcuauugugacccucguugcuaccacgauccuaaacaacucacuucaagcuaaggaccucgguuuuucuaaaaagcaaaauggugaaaauuuguccugcccuuaccugccuaucaggacuggccgaaggaugguuauaugugaaagggcuugaaaugugguuucaacaaggaauuuuuguugcuauccugaggaaaaauggaucagucacuucuccaaggauuauagaggcaguauaaaugagcaguuuuacggacaaugccuacuuuuaggagaggacauacuuauuggcauguaccaucuucaccaacagcaacccuaccuauuacccauggaauacuuccuguggguagugagacuaagggggacaaggcgguguaagacaggagggcucaccuacaucccugauaaccagucuguagacgccucuugcucuuuccccccagcaccgcacaguggaaaagguccaagcauugaagccauuaggaucccuggggaagagcaaauaaagagcacauggauggccuagcagggacagccgaaacuuaucccagaaacaggaaaggcaccaaaagcauuugggacagugccauucuguuccuggcaucucaggguaugaggaaguuuuguccuuguguaaacgccccuggagaaaacacagggcuggaaauccuacagaucuaaguuucuuuccucucucuuuuagacaggucaaaccauaaagcccugacuggucuucaauuuuuuuccucuuccaccuaagcaacucaaguacugggguuauaguaugugcuguucuuuuuucuguagggagcccagcaugcugaacaagugucuacaacugagcuuauaacuaaggcuguuggcuuuugaaacugagucuuacuagagagcccaggcuggugucaaacucauaauccucuugucuuaucagccuccccaguacggggacuauagccaccacagcacuacauuguuuuccacaggauuaggaaaaaugcauacagaggauaaugccaaguauguuauagacacuugaauaaagcauggucaauggcuucuagcugcuaaagacaaccaguggaaggcuucaguaucuguuugagaagguccuuauuaugaagaaagguugggaagcuaugagcagguguacauacgaguccaugcugcggggcgcgccgaucaaagacaucaugccacugggacaaaacaguuucaguucuaagcugccacgucgugggugagugauggagacugucacugccacauguuccaaggucuucagccccgacaucuccagguccguccugcugacuauaggaagucaggcuaggcagguuggaaacuagcccgcccauaaacaugcccucaguucaucccaauauauaaaaaggaacacagguuccaaagccauauacaacaucaguaguaaaauguacucuagcaaauggaaugcaguguuauagaucagggccuagcuagagagacaauacagccaagaugauauaagaacuccaucauucauccgcucaaacccaucuacugugcaacuccuacaucucaaguacugaugaagagaauacaaagagaaguaagugcauagcaccuacuugauauggggcauaucagaugaguugaggcacacaacacuaagaugugcuagguacagcacagacuagcagaaggcauucuagaagggaaggggcacuaaaaagauagagguaaauaggcaauuuucauuuaugaaagacaacacaacauuaauuuauaaagcugaaaaagcugaucucagaaggauuuacacuacauaauuauacuucccaggcaucagggauguaaaagggguucauguggccauaagcagguccuaugauagcacauuucaggucuugacugugguagugcuuacauaaguacacacaucacagagcuacacacacacacacacacacacacacacacacacacgcaaaaccagugaaacugaucauguucuauggauugugccaauaccaaguauuugguuuugauacuguauuauaauauuugacaguaacaauaaggaagggguacacaagauuuccuugaucauuuuucacauuucuacauaucuauaauuauuucagaauaaaaguguugaggaguggggaacuaacaaacugggagacucaacuaggaaccaagaaaucagacugcagugagauauaauucuccuuaaaguaucuugcauuauuuuuuucaacucagaagacaaaguuuaacaauaucuuuuuaaaaauaauuucuuuuuauuuuauguauaauggugacuacauauaugucuauguacgggugcugucacaguaguuacagucaguugugaguugugagcugcuauguggguguugagaauugaaucuggauccucuggaagaacaaacagucagugcuuuucuguuguuguuuuguuuuguuuuuuugagacuggguuucucugaguaguccccuggcuguccuggaacucacuuuguagaccaggcuggccuugaaaucagaaauccgccugccucugccuccugagugcugggauuaaaggcaugcgccaccacacccggcucagccagugcucuuaacugcugagccaucucuccagcccaacaucucucucuuuuuuuuuuucuaagauuuuauuuugggggcuggagagauggcucagugguuaagagcauugacugcucuuccagggguccugaauucaauucccagcaaccacaugguggcucacaaccaucugugaugggauccaaugcccuuaucuggugugugugugaagacagcuacaguguauucauauacauaagauaaauaaauaaacuuaaaaaauauuuuuuaugucuauguguacuguaucugcauguacaccugcaugcuagaagagggugucagaucccauugcagguggcugugagccaccaugugguuucagggaauuaaacucaggaccucuggaaaaacagccagugcucuuaaccgcugagccaucucucuagcccaaagagugacaucuuaauuuuucagauaaggaagacagagaggugcuugcugagaaaugugggaaagggaagcuaagcuaagaaagauuuuacuuuuuuuguuuuugagaguguuucucucuguaguccuggcuguccuagaacucagauccacaugccuccugagugauggcaugugcuaccaccauguagcgugugcuaagucuuuaaaaaaaaaaaaaaacuaacacaaaagaaaauaaaagucaagcaauuaucccuaccuugcuugauccuuacaguuuacucuuuuuuguuuuguuuucuuucuuucuuucuuucuuuuuuuuuuuuuuuuuuuuuuuuuuuuuuuuuugaggcaaggucucucuauguagcccuggcuguccuggaacuuacuguuuggaucaggcuauucugaaacuuggagaucuuccugccuuugccucccaaaugcugggauuaaaagcauauuaccacuaugccuggcuuauauugacuuuuaaaugcuguggacagagaccaggggcaaugcauuuggguaaacuauaauuucuaauagaauuaaauaaguuaaugccuaaaauggucaacuacuuugaauaccagcugguugaguuuuuugucaacaugaaacaagauaaagucauuuaggaagaaggaagcucaacuaagaaaaugucccuaacauacuggccuguggauuucuucauugaugauugauauggguaggcucagcccauggagggggcaguacccucuccguguagguagucaugaaguguauaagaaaccaggccaagcaagccauggagaacaagccagugagcagaguuccuccauugccucuucaguuccuuccaugauagacuguaaucuacaagcuaaaauaaacccuuucuuucacacauugcuucuggcaugguguuucaacagcaccagaaacccuaagaaacugguuguccucauaucuaaaagacaccaaauucuguuugcuuguuuccguaaucugguguaagcuaugacaauaucuagccuuccuauuuauuucauggggaaucaauauaagauuuaagaggaggaaucgugcauagaaaagggagcugaaaucaaacacagcagcucugacaagggaggaaacaggaugguaguggaggaauaaggagccauagaauacagcucaaaagacacucaucguuuuggaguuucaaguacauaaagaaaacaggaaccuuggacagggagggaggccagagaggagaauggagcacagggaaucacugacagcagaguaaggcaggggcuaaccuaucuguaggaucagugcagcaagaagguucaucaggauggacuauagacuaaaggcaccaagagugugcugggaauauaguuuaguaguagaguacuuacuagcaaugaagaagaaccuggguucaauuacuauuaggaaagcaaggagggaaggagggaggaaggaagggaaggaaaaauacacacagagucuugaagaagguagggauuucagcuagaagagaagcaggagaaacaaugguggccugaaguuggggaggaaaggagagcaggacuucacuuggcagaggguuagcuggcauacuugacugcacacaaagcacgggugcaagggugcauucugggaucuuacagauucuccagugaggaaacuucccagcaaagcccacucucucuuucuaccuguuagggacuucagacucaggugugagcuucuucuuccucacuuccauugggaaaaaugcaagccuguuuugcucuugaguuacucugcucaacaugcuugccuagaaacauguagaugguuaaaauaaaaauucacaaugacugaaugcaauugggaggcagaacuugaguucaaggccagccuggucuacaggacaaguuccagggcagccaggcagugagggcuacacaggaaaaccugucuuaaaagagagagagagagagagagagagagagagagccgggugugguggcgcacgccuuuaaucccggcacucaggaggcagaggcagguggauuucugaguucaaggccagccuggucuacaaagugaguuccaggacagccagagcuauacagagaaacucugucucgaaaaacucaaaacucaaagagagagagagagagagagagagagagagagagagagagagagagagagagagagagagagagagagagaaagaaguucagagagagagaaguucacuuccuaucccacuagcuaucaaugagauguuugcugcacacaucuggacaucuccauuacugguaaaauucuugguuaacaauguucugcauccuuuaagguuauuucaacucuucugcuacugucuggauacucaguuccuucugccuguauuucucucuuuuuaaaaagagagccucucucuguaguccuggcuggccugaaacuuacuacguaaaccaagaugaacuugcagucaucuuccuguccugacgccugagugcuaggacuacaaacagcugucaccaggcucagcuucccucugucuccuaaaacauuugcuuccagcccuuaaccugcagucagccugaucuugcuugaagacuauggcuggccuaucagugcuguaaguucuacagugugucuggaaugauguggcugucugggaugaggugucuggaccaucuaggauugauuguaggggguggggcaucuagacuggggcugcauugcucaguucuguaccaugugaauuucacuccuuugauggccaagccagccuuucaggcucaccuuuucuuucuguuuuguucuaucuauugagggcugaauguacuaagggcaagaaaccucuuucccuggcuucugacauggaugaccugcuugccacucccaccccuguauucugcccucuacacuucucuuuaaugcuuuccagcgaccaacaggcaguugccagcugcccaauaccuauggaagggcacuuuaaggggccacauucccuggguaaugggaagcagaggauaacaaagcuggucaagucucugacccugagaaguucacuugcucaucucacagaagugagaggaaacagccuugaguaaaggccaaaaggcccacaauccccaagacaguguauaaaggccaggggcuuccccaagccacauuccuggauguuuucuacccuuccuaugacagcaugcuguucauggaaaaaugcguucguucccuaggccucgucuccuuccacacauaggggcacuaacaggaguaagauaugcuuagggagagaaguguucaugaagagaggcuggccuauccucccacccaaggucccuucuuuggucauucuucuagaccucauaucucuggucugggcacuuucaagggacacaggaaaaauaaguacagaguucugauaucagcauggcgcgcauauacaccucaguuuuuacaaaguagcaaauaacucugguugucaacauuucucaagguugaaaaauugacccaugagacuaagaauaggaacaucugagaaaugugcauauagagaagcugggguguagcuuagugguagaguaugcaugcuuaggauguaugaggcauuggguuuuuucacaagcaccaaaacaauaaagacaaugcaggcugcacaaaacaucugaauccagccucccgucucucuugggaggguauccaccucuggguuuaacauagagcacaccccuugggucagaaggugcccugcacuccuucacagacagacccacccugugauggcaagcagagaggaaagagcaacagcacaguagcaacuguagcccagggaaccugugcuugugcuugugccccaccccuuagagauggcaucuggcuuucucuggaggaaauuaagaaccaaacaugcauuucucuccuucaugcuggggccucugugcuggauaggguguuuggcaagaucuuagcaugaaagucacaggaacuuuuuucaaccccugcugaggcucccuaagccccacucccacucagcccacugccuuccuaguccauugcuuacagcuccuucuuacuaugaggaacucaggagaaaggucuuguuaagcagccagaggccagccaacucagaagcagcaacaugcccuaaaauggucaaagaaaacuccacagguuuggcuacagcucaagcuacugaaggaagggggagaacugggcagggaggaugagcuuagcuuagcuuccccaucacccgccucaagccuggaccugacauuaaccccuugugcuggaggcuuaccauuccauagcaccuccagagaguggggggaccucggaacagccuuauuuucuuucagcauggggcugacauaggaggcuaaguaagggacagauguccagaucugcucaaagaaaaguaggggacagcaauuaacaaacaaaacuuauuguauucacacacacacacacacacacucaugcagagacucaguaagcucucuaaggucuaacccucuagcuuuucuaucaucagacucuuucacuugaggucccuucuguaccccaaauguuccugagaaaaacaaguuaagaacucagaggaaacagccauggucugaagggaaggaaaccagaagcacugaaagccccagaguccaaucaaguucuccuuacacuacuaacaacuugggaacuuagacuucccacugauaagauggcuaucagccagaauaaggccuaaaguggucaaguaccaauaaaaugccaggugauguuuaggcauugguaccuucccucaguuucucuauacaggguauccugcuggcuaacaccugguucaccuuggcugcauugacaagucuccaagcguugagcaggccgaaaccaugcugauggcuguggcugaagccagccucauuggugagccagucugcaugaugaucuucauacugaaagaauaaaagccuuggugaaucucuagcauugccugacuuucuucucccacugaggccgcuaggaauggauucccucaaaaaagguaaaaaaaaagagucaaaacuccaugagugacuugcuucccuagagggacuccagacgaccagcucccaagugagagugccuugccacagcucaucuuggggaucuguccucacacccaugcuguacacaucccacccugagacauuuggaaaguuuugagucuggagucuccugacagcccagccauggaguggggugggcugggcacuuguuaucagcucucaccuggauggcugugaagacaauuaugugcuguacaucccgccaugugaggcagggccgcaccugcagcaugagggcuaucauuccagcugccagaggagcugcagcugagguuccuguguggccuucagugcagccagugcccuucugaaggucccagucaguggucaccugcaagguggaauaaggagugggaggaguuagacacuggaagggaaugagacaguccucaaacaagucucucagguggcccucuccucuaacuuuccuuaugacagaggcccaggcacaggagacccuuaccccuuccauccaucucuagaugauggaaacugaagagugaccuugggggcacagcuguaaggaaaggagauaauggaugugagaggauguggguuacacauaaguuucuugguuccugcuccucuaauuuuuuaucauuucauuccuaaacucucuaucccaacucacauaacacagcuagccgggaguggcuacagcuauacugggcuccggcuggagcugggagaggaaccaugagaauguaggguacaaguucccuaagauuauuuauuacaaccuucccuugaagccuacugcaguuucaguaucuacauggacugucugccaggcaauccuggccacuggacaagcugcuuuccugcucuggguggugucuugguugggugucugugagcuccucucuccuacccaugucucucagaugagacauuaaaacugggagaagacaguaucuguuuggcaucaaggucaugccccaucaacacaaguguaucaaaaaggguuaacaggacuugcccagcuaaacuuuuugauaaagccagugcaggcuacuuuuuuuuuucuuucaaacuucucuccugggucagacaccagggugccaacuucuuccaagagcugccuucuccauugcuuccuccacccccaacccaucccagcuguuacugcagcagccaagagaaguaauuuucacccagacacugugcucuccuaaaagaaaaggaaaaacacuccacguuguagucuccaccagagaggaagccugacuggugccagggaacagauugauuuuuuccuguuaaggacacagccucacacagcgauagccuagaguacagaugcaaagccugccaacuugcccauaauggcaagcacaucacacagcgcaagaaaaaccuagggaagcucccugggcaagaagccagaugcugggaagccuauuccccuggcccuucuccucagagacagcuccaugcagcugccuggucacacaacaggagguugccaaggcaagggcauuccaaagaugggaacuuggcugaauaaacucccuuuacaaaucuggacaaauuacaguucagauggaagguggggugagggugagaaaccaaguugaguuggaaggggcaaagcuaggcuguguagagcaacagugacaauuucacuacagagccuuguuaggucccuugcaggggacaggauucgagggucacauaacucugccaggcgguaaggaauaggcacuuguucuucuaacaggcuaguaucaccccaauuuuugggcaaacuuucugcuuuucacuuuagucuaucccuucucucuccucccuggggugagggucaacuggcacagagccucagaacaauguguugaccagaagucauuuucuggcauaacaaguucauuuuguaagaugaacuugacccugugugaagaugaagcuacuuaauucccaguaaccucaggaacaacccaacuggccacuggcaaaugcugacaagcaucuggcuccugcccagcucuggccuggaccaucccauuuuuuuccuuuuuuuuuuuuuuuuuuuuuuuaguuuuucaagacaggguuucucuguguagcccuggcuguccuggaacucacucuguagaccaggcuggccucgaacucagaaauccaccugccucugcuucccaagugcugggauuaaaggugugcgccaccaccgcccgguuggagcauccuauucuuacuagacacuguaaggugcuugcucuggguccagaggcuuggcucucuaggccgggcuuuccugaguccuucaaggguuguguggcuacagaagcucuccauuucccuguugccuuucaggcuuuggcuuaaaucagaggucuagggaaggacagggucaguuccaacuuccuguccugugcaucccugagacaagcacugccuuuguuccuuggcaaacauggcagucaguauuuauaaaaggacugaacagcacacagaaaguuguaaaaguccaaauucuaccauagguauccuacaaacaaguuaaaaaguuuaagaucaaaaccacuaaugcgccaagcagcggugacgcauaccuuuaauuccagcacucgggaggcagaggcgggcggaucucugaguucaaggccagccuggucuacagagugaguuccaggacagccagggccacacagaaaaacccugucucgaaaaagaaaacuaaaaccaaaacccccccacuaaugcaggaggaucaggaacuaaggggauccucagcuacauagugacuuggaggcaaccuagguuauaagacccuuucucaaagaaugaggugaaaaaaacagcuguuuuauuagguaugguauaucccaccuguaaucucaacucauggaggccaaggcaggaagauggcuaauaaauucaaagccacuuugaacaauauuaugaguuccaagccuggcuggcuacagagugaguccuugucuugaacuaccccugcccaccaccaccccgacuaccacaugggaaggguccuagaagugcucacaaugcuccgcagcaucuugucuccaccacugaaggugacugccagcauggaggcacacuccucugcauaaaaaggcauccgucccuccucauccacagcuccuggcacagaaaagcaagacaagagcucacauaacaaguggauccuauagcuagcaccugauaccaaaguugucuucaucaugaagggaugagcucaaaaaauaaccacagcuucaucuguaugugggcggguagccucaaauggcagagggaauucuugcauuacaccacucuucccauaggcuucaggcaucucuguacuuagccucuuguuuucaauguguacuaagaucuacugugagucauacauaugagauauuagagccauguggaaaaggccacauccuggaagggguaggaaggacacaguaugcagugguagagaggggcagggacaguuccuugugaucuaaggagucagaaugaggcugaugucaagaagccuauaguuauguaggacgucgaguaaacaaauaauaauaaaaagugaaaugauaaacuuuauaacugggagugcaagacagaauuccuuaauucagguuaaaaggaagccagaggcagcuucaagagaguggccuggucauggaaagagaccaaaguggagcucaaaccugucauaaugguagugaagacagguaggugauuucugggaaaugguugaacaugucccagagaaacccugagagcucgaaagagcugggcuaguacuguuccucaagagaugauccugauuacacauuuagagaaacagaaugaagcaaugcagugagacacaaaccacacccagugaccccaugcccauggaaucgcuagaccacuaccuauggugacaguguagauggaguuggcauagccaucauaguugcaguugucauugugcuggcccccauuaccacuggcaaccacaaagauacuuccaaagccuuggcgaccagccaucacuccauguuguaaggcagccugaagaacaaaaaugucaggcuauuagucaagcagcuaauagaaaaaccuguacccauugaaccagccauccacucuuccugcuucuagaaagaaagacaagggugaggcccugggcaagggggaaagagauuuauacacacauacauaaaguggggagaaagcuaagacuuaacaguguuugggcuggagagauggcuuagcgguuaagaacacuggcuguucuucagagggcccaaauucaauucucagaacacauaugacagcucacaacugucuguaacucuaguuccaggagaucugacacccucacauagauauacaugcagggaaaauaccacugaauauaaaaaucaauaaaucuaaaaaacguaaaccccaaccccccaaaaaaccaauagucuuugacagacauguucugcuuaucagauaacugagcagggugaggaacagaaacccagagugagauccaaaagaaacaagcuggaaguuauuccuucucugagcaccaggguccuacaguccuccauucuaagugaggcacacaaucuuucuugacaggaugaauggcacagcuaugcuaaauggaguaaguugggcacuauaaugaaggcgggaugggaagaggguuugauugaugacucuucuaaaacugaguaaagagggucccaagggguccccagucuucaugcuccucaguuaccuuuccgagcugaugaggaccauccacugucuucccaucaucaucugggccccagcuguugagauucgcaaagggaagaguagaguaaggaucuccuugucuucagagccacucaccugccugcagcuuuuacucuucucccaaggaaccccaugauuaaaagacacauggugccaagggaccauuuucuuccaaaguagaaaaugcaaguauaugcuaaggcucuucuuuauuuggaaaugucccaauuuaaaaugacuuuaucuagccucaggucccagggaagcagaagauacguaguggaauagggacagcggcauccugugauuuacggagcuacuacuaggcuugauaaaagcugcucaguuuuggauuuuuuuuuuuuuaauuaauuaaaguuuauuuuauguugucuaagaauuuugccugaauguauguacaaguucaacauauguggaguaccccuagaggccagguuucagauucccucaaacuggagugacagaaggauguaaaccaucauguaguuacugggaacugaaaccagguccucuguaagagcaucaagcgcucucagccaccaagccaucucucuagcuccaagguuauuuuuguuguuguugucacugagacaaguaucucuguauagcccuggcuguccuggaacucauguagacuaggcuguccuugaauuuagagauccaucugccucugccuucugagauuaaaaaugugugcugacacaccagacaaauuccugguucuuaaauugagcaaggccugugagaugccucaggagguaaagguguaugcuaugaaagccgagugacugacugaccccaggggcccacauaaagggcuuguccucugaccaugggauuggcacaauagcacaauaccacccccaccccccaaauaacaagagauuaaagagaauuuaagaaacguacugguuaggggaagaacaggcucuaucaauaugacaggggccauccaccuuaaacuccuccuauccaacuccuaaaccaacagccugaagcuucaagugcaucuuugcaggggggcacugaacucagugcacuuucuucuaugagcauuaugaauuuacacaacaaaugcaugcaugcugggacacucuuuuuguggcaagucuaagacccagcacccagcggcugcggaacuagauaaaugaagaaaaauggccucauuagcugagucuaacaaggaaccccugcuaggcuagaggcagccuguuucccuaugcuucuuuuuucuuuuuuugaaagaucugucccagagacucgagucucucaccuccuccccugcagcucaccccuccuuaccugcagcuguagaugucauugaucugauagugcuuguugaacgccacagccuccauacugucaguaagugguccauccagcacccggauaccuagguauugaaguuacaccagcuccucacugaugcuggucccauaaggaacuagaaauagugcacauuccccaaguagggugccaggugguagggugguauguucuuuagcacuuuugugugugcauauuuuucauagcuauauauguaggagugugaaugcauuaguguacauaugcauaugugucgguaaguguguguggucgucuaucuuggauagcauucuucagaauacuugucuuugacacagagccucucgaugggacuuggggacccaauuaaguuaggcaggcuauccagagagccccauggauucaucuaucccuguguucucaguucugggauuacaagaaaauccaauuguuucuagcuuuuuacaugggugccaggaauugaacucaggucuucaugcuugccuggcaagcacuuuaucaacuacacaccaaaccccucuuuuauacuuuggauuuuuauaccaucuacaaguauuacuaguucaaaaaugguuuuuguuuacuuggguuuuuuggggacaggguuucucuguguaguccugguucuccuagaacucauguuauagaccaggcuggccucgaacaagagaucugccuguuucugcuuucugagugcuaggauuaaaagcauaugccacuacagccugccauuuauuuauuuauuauuuauaaagacagagucuuagccagcauagucuugucuuaaacuuacaacauagcagaagaugauuuugaaucccugauccuccuggcccuacuucucaaauucugggaauaugccuagcuuucaagugucuauuacuaucaugcuugaacucagaucuaacgauccugagaggugagaagcacuggguuagaauauagguagguaaucuaagauauccccucucagcuuggcacaucauguggaaccucuagcucagugacugacacaauagagaaaugaaguaaauagcauucgccccuuugcuaccccagugcugcucaaacucuuuuucuaagauggagugagugggucacuguggugcaagguuaagaacaaauggggauuugcagagugcugaggcccccugcuggaaaagaccagggugacagccagccuguagagaccauaggcucccaggauucaggagugcccauccuuuccccuugacccacaagacugggagaugaggaaccauauaacuaccucucuuaaaagccagacaacuaagcucucuuaagagaauggagagcaggggacuggagcaguggggcugagagagcagccuccauagauguggaguuguggaaggcaaacuaugaggaggcacuugauaacauaugaaaacagcagcagagcacagucaacucgaaggaagagucagugacgugggucaguggugagcagagccaugaucagaaacagaagagagacuugagcaggggcagccugggaccuauagcccacaauaugagccuuugcacacuuaccuguuuucuacuguacaauaaauacuguuguuaaaagcccaugugacauaccacagcccugaaaagucaaugagcuaauuaacuugcuaugcucuuacuccucacuuuaggcuacaaacacugaggguaugaaaaugaaacuucagaauggggaagguagagaaugaucacugugucccaagagcuucccagagauaggagaagcaugaguuaccugcuauucggcucccguaggccacacccacugcacagaagcuguuguugggcacagcugcaauuucuccugcacaccgggucccauggugguuaccauucuccucaucaggguggggcaugggaucugggucauuagaguugaggucauaacuucccucuggacucugaaacauugaagggucaacaaaugguuacuuacugguuaggaggagucaguuccuaacaucagggagaauaggaacuggaaguuuccacucccaaaucaggguagcacacccacugccucgagcaaaccaagguuauaagguaagagccaaggacacuggagggaagcugagagggcaggguuguuuuguuuuguuuguuuuuaaucaagcuuuucuccuggcugguauaguacuaugccugcugcuugaggggagcccaggguaaaagauuucagacuuucuaaaggucacaccuuagccagagguuuucagaaccucuaaagagaaaguaguugccuauagggccauucccugcuccccucccaggaaagcagcaacaacaggaugcaggaauuaaugcuauagaccaaagucaacuuccgggccuuaaccgcaagucuggaaagcugacugagaaaggaggcagaacacuauccccucccaggcugucugcuuuggcucagugccuucuaggaaagggaacaaaagggaaggagcaggguggcagcagggcucacuucaggccacucacguaguugggugcgauguccuggacgguguguuccacuccgucauccaccaccaccacugucaccccacgcccaguuacauuucgcucccacacaccugucacauugaugucucuuccugggcuccgccgauuauucuguagaagacagaaaucaaccgacauacagcucaguccagagagacaaguuaaagcuaccccuuuccuuggcuuuuauuaaagagccaaacagaggcuacagaccaacagguuaguggggaacagaguccagaugggcacaugagaguccugucccuccgaucgauucuuggucucacuuguaggcaacucaaggacaaagugguagcuagggcuaauugguaauuauuaugcaguaaaguuugcaaucagccaauacacaacaggguuccccaugaguaagacacuuuucuaaaugcuucacauauacacuuacuuguuuuaacaguaacuccaugaaauaugcacugcuacaaccuccauuuuacaaguggggcacagagggguauaguucagccaaagguacaugcuagaaaguggaaggcuagaacaggagugcaguagacuagcugcaguugagugcauacacccucagcacugcccugcucuucacagcagacagggaagguauggacuaagagcaaacuauauucccaauccacagacaugcccccuucaguauaaguacaggggagugggagaaagccucagucaaaagcacacuagagaaggcccugucuaucugaggcuguacuuaccaggugccacuguugaggguacuugggaucauugaaguggauacugcgcuuggcccucuucagcagcguuugcuccgagugccagcgcacagcuucaugccuggcuaacacagccucugccuguugccgcauggccuccaccuccauggcuugccuaugcccaguaggcuggacaaagagguagugccccuggaguucuccaaugcgcccagcauucacaagcccugcugccugggccacagcaucggccuguugcgucagacucucuuccuuccucucaccuucuaggcuguccagauguacggcccagcucagccccccugugcccaagaugucaagcccaccugccucugauaggcccaugaccuggggaaccagaaagaagauggcuaauuccagccagaggcagaugggcaggcccaggugggcauccaagugugggacuuucugccucccuuucggcaucagaacagcaggcugcaaacaaaggaaaaagaaucagcaaaaaaaggccagcagcuauaggaaacucagagagugacuagguccaucaguguguuccccuugggaagcccaacacgccucuuucaagugguuagucacuugauauucauagucucuuucccuccccuaccaaguacauuugucccuaagcaaaauguuaacccccagguagaguaugagccagggcuaaccccaguggaugacuccuacagcacaauggcccaucccuuggugcccccaauagccuggcaucauccaggugcuugcuuugggcugcucauucaguuacuccaaguacauaucacucccaugacugacaacaucaggaccccuccuccuccuccuccuucucuuccuccuucuuuuuuaaaaacaugaucucacuauguagcucucucuggcuguccuggaacucacuauguagaccaucaggcuggccucaaauucacugagauccaccagugucuaccugggauuacaggcaugagccaucacacccagcucuaucucccucuuauuuacagacaacauaagucuuuuucccaguggacuucuaucucccauuguggagccauuccuaccugggcucucugugaaguuuagguccuggccuggguaaccauaccacacucaucuugugaaaauggagggagaugucaccuucacugugagcagugagugucgacugggaacacagcugcagaccuguggaccccaaguacagaaacaacaacaaaaaggugucccacuaaagccagcaaagcagaaacuaaagugaaggccaggccugaccagugaccaguguuaaaugucauuuccagggaucuaaaacaggccacagacuaggagacauucaucacaauaaggccacaccaauacagaacccagauaccccacuucuuaaccuaucauguuauuuucauuugcuucuuuaagggcuuagcaagaccuaacugucaaucagggagaaagccagauaauggaaauaaaauguaguauaagugcauguggguaacugggagagaggaaaugacuggcaagaaggacuaaggagcuggccccgucucaccaaguuggauuuucagugagggcacaggcuccagcccugucuucaaccacucaaaggggaaaaaaccccaccaaauuagaacuuucgagcaacugugggggcaggaacaaggcacauguggggucuugagcucauuuaaaacucacuacugucuaccaagcccacacugcagcagucuugguguccagacauacacuuggaugguaccgacuuaaaacauucuggaaagacuguuuuaccaaagacuccuuggaccucccuuccucuguauaccaggcuggccuggaacucaagagagccagccugcuuccgcuuccagagugcugggauaacaaaggugugugccaccaacauccggcuuaaacaagcuuucuuuauauaauaaagguuggcugagaacucuugcuuccaccccuuuacugcuguuauuauaggugugggccaccauguccuuaaguuccauggcauauuuccuauuacauucuuccugccccuggggcugcuucaauuuggcccaagauacccaggugucuucccuagucugcauauaaguaaauccaaagucugguuugauagcagccauccacucaggcaggcuccuacaaucucuguagguuccaacagagauuucuggaagagaaaccgaguuuuguuuuuguuuuguuuuguuuguuuguuuguuuuuuucucccugugguccagaggcacagcagcacuuauucucagaccucugagcaagaaaucuuaagcacuuucugaaaauagacucccaucacccucaacuaagguagacgggcaccuuuccugcucaagauucugcucuuaaaccaccguccuucaagccccgccuccccacucacaggaaccagggucuguacagagugaguuuucugaugcccccacucccacgcggacucagcugcuccgugcaaugugccucucucuccuuaggaccgaugcuguccggaaccuacgacccggagacccggucccucuggggucgcccacgccaggacccaaggugcccucagcgaaggaccuccuccgcagacgccgaccagccccgguccauggucccccguauauccgagguccagccuccacuacauuucuucccgacucacccacagccucuguugcuacugucgcugcugcugcugccgccgcagcccccacccuacggaaacucucggcuuccccggagccggaggcgccacugacagcgacaucacuuccgcccggcgccgcagccaaucagcggcugggccugcggccucuugaccagcgggccgagcuccgggcgcuccgccgacagcuucugucacaggcccgugagggcugugggaguuccggcgccucgaauccucguguccuccgccacaggacccccuccgccacagggcccucguccuucauggcguccucuguaaggaccaucccgguuccgaccucuaaacaccccucgcggcucuucuccgucggacugccauagccuugacucuuccccauaaacuccucagagaggcucucgccuccauccggccgccgucucucuggcccgcgugucccucgggcuccgcuugggucucagggcugguccccucagcggcuccguuguccggucgcuguccgcgccugccgccagagggcgccgucgguggcggccgcucaccccgcggguuccgcuccucucgccgccccggccucgcccccuugcgcucgcgccgccggaagugggaggugccgcgcgcgggccagcgcucgaccccucccccaggcuuggccgcccccucccccgcuccgcccgcucaggugcgucccuucccucccccccgcuuggcuccccgggggcgcggcgcgggaggugugugcggggcggcgcgcgcgggucgggacggcgggacuag

SEQ ID NO: 5072 - RNA, 6433 nt, Mus musculus
uggugucuuuccccaaauauggagccuguguggagugaguggggcggcccgggguggugagccaagcagacuuccaugggcagggaggggcgccagcgggcggcagaggggugacaucacugccuaggcggccuuuaaaccccucacccagccggcgccccggcccgucugccccagcccagacaccgaagcuacucuccuuccaguccacaaacgaccaagccuuguaagugcaagucaugggagcagaagggcugugggcucaauuagauccccuagucucuucuaguuugcuggguggaauugggucccuagagaccauucucuguguuagacaaaaagucuggguuaaaaugccuaggaugauuugacuggggcaaaagaauaaauggggugagagggaggcucaaauuucagucacugucccacccauagguguaugggcuauguguuaggcccaaagaggugacaaaugaggccaagggaacaacuccaucuuuggaucuccaagaaggugaggggcuaaguucuggaaagcagugacccacugaugguccccagggcuaaugcaacucgggggagccaggagguagcccccucaggcaguggaggacuaaagaucuuauuuuuuguagcgcuagggaucaaaccccagggcgcuauguguggcaggcaugugcuccaucuaccacagaaguuuaaugcuucagacuagccugggauagggccugcuuuuucuuuccuuuucucucucucucucucucucucucucucucucucucucucucucucucucuuucuuuccuuuucucucuuucacucucucuuucuaauuuucuuuuucuuuuuuucuuucuuuucuuuagacaggguuucucuguguagcccuggcuguucuggaacucacucuuuagaccaggcuggccucgaacucagaaaucuaccugccucugccucccaagugcugggauuaaaggcgugugccaccacugcccagcuaagguuugcuuuuucauggcagcuugguccaguuugaaaguaggaggucaguccacuguaggcagauaggugacagguggcagauaggugacagauaggugacagguggaggagcuuuggaacugggacuggacagcccugggaccccuguuccucccaaagggucuuggugguuccccuuggggcucucuaaaggaugucagugggcuguugccacaucuauauaagaggacuagucuucuggaauuuaggugugaucucucagggaugcagaaaugcucacccuuacugucauuuuaugggcugagguaccacaggcagauauacccugguucugcuuguuguccagggucucugcuacauggaggccccuuuccacagccuaaccucucuaccugcugacaggagggcuggauggccacaggcauccaagcugcgcaucaugcagguguuuugcguuggagcuuuugucuagaaauacccuggugggcugccaaaccaccacccauaucccucucuccucucugcugccucuaagaugacagcuugauuuuucuuauagugauuuuuuuuuuugguuuuguuuuuuuguuuguuuuaaguuagcauacaaaguaauacauuucaucauggcauuuggacauacauauauauuuuauuugcucuccuggccucuucucaaagagacuucucuggacuuucuuguauuuuugguugugagccuagccuuuaacggcugagccaucucuccagcccuucuuuggacuuucuacuucauacuucccaccagucugggaagaagggcacauggaaucuugagagcaugaccugacccagaccugacagaugucaaggcugcaguguaugcucuuguugcuacggcuuguucuuaguccugcaguucagaacuuucuggagacugagaagugcaugugaggacacucuccucccaucuuuuccucuaguggcuagugauguuugguuuuuuguuuugagacaggguuucucuguauagcccuagcuauccuggaacucacuuuguagaucaggcuggccuccaacucagaaaucugccugccucugccucccgagugcugggacuaaaggcgugcgccaccacuguccagucaggaguagaaggaaacuguaaggugcuugagacaggcugaguagaggcuaggaggaaggggcuccgcagucaccggcuccaugacucugugacuuuugugguuccuugucgcagcgguuccuggugguggugguggucggggguuggggggagggggcaggccacacaguggggugugggagggaauagcuguugacaacuucccaacagaaaccaggcuuuugaguccuccaggguagcuugagaggguacucagaaagccguguccauguccccuuuccuucaccucagggaaguaaguugccuauaggguugucauuucaaugaggucuucugguuauucuguuuuucucucaauguugguguugggcucagggaaugcuuuggagaagguggugggaacuggagaagggaagaucaguuuacuguguaaacucacugguuaaaguacccccucccuuccacccugcaauacacacacacacacacacacacacacacacacacacacacaccccaucucgaagagcucuauuaagcuccaggugcacuguaguucacagacugcaucuuccagguuugcucccacuucacaagcagagaacucauaacugaagggggugacagcacaggggaagggaaagcaagauguuuagagucugacagcuggcccgggaccagagccaugugguaauguuugcuccacucccuaccaccuccacggcugugauguggagaagguccccgcuuucaugggaaggaggugggggagccugucaucugcuccaugcucacacaauuuuucucucaaccaaugaccucucagaagcagggguugguuugcaaaauucuucagauaccucaacagauggcaucccacucaggcuaucccugcugacuaggucuggcuccagcccugacuguaucuacccagggaccuaccugccugcuuugcuccuauagccuuccuccgugucuggguccccagagagcugccggacauaggccuuugaggcaacagcuggcauacaggccaggcuucccaugcucuggcuagcagauucucugcccuggaggacuuugacugcaugguuucucucacugcugcaacagucagagcuggcccacacgggcacaacagcgcacuuccaucugggucucccugagaaugccgcuguuuucugagaacccuuggacucugguggcuuuaucaggucuuuuugucagcugcgcuuugggggaugaacuuugcucuucuggcuucugggucagaggguaaagauuugguggcaaccgguagcuagagaaagauagcuacuggcugaauuuggaggacauggcuucuggaaaaccucucuagugcuuuucuggcuagucuuggcaaaguaaaaaugcucugauagccagcccgggugaugcagggcuuccuguucgaggccuuucuguacaaaauuagugagacauugccucaaaacuaugaaacaagccagacucuguugaagcacgccuuuaaucccagcacucaggaggcugaagcaggcaagaucucuguuaguuggaggccagucuacaggaaaguucuacaacagcagaggccagacagugcaacccuuucugggggugugggggaggaaaacccaacaaaaacacaaacuauaaaacaaagagaaggccgaggacaaagcuuagcaaugcauacuucccuuucuaugugaagcccugggcuccaccaguacugcagaaagaagcaagcaaugagggacaggagguuggcucuaggccagggguugucaaaauaguccacaggccaaaggcagccugaugucuguuuuuauaaacaaaauuuuauuggcacacauugguuauguaucagcuaggcuauuuucauacaauagaggccauauggucuguaaagucuaaaauauuuacucugcuguuuuacauaaaaaguugacagacucuugcucuagacugacaaauaucuaagaccuuguuuucugagguucaaguucagaggggucucugcagcaaguggguaaagcuggucuaggucaugcuaugaugucuagggucccucagaguggaaggccugcuuagcacaaaugaaguaaaguaacuugcuggcucuuuguucuuuucuccacacucuauacuuuagcucugccucaacauggccaacaaggguccauccuacggcaugagccgagaagugcaguccaaaauugagaagaaguaugacgaggagcuggaggagcgacuaguggaguggauuguagugcaguguggcccugauguaggccgcccagaucgugggcgccugggcuuccagguguggcugaagaaugguguggugaguaacccuugcgaagggaaucuagggauguguaugccacccuacaaacugugagacagacucccugagcugaguguucaguuguguucuguaccuggcagauucugagcaaauuggugaacagccuguauccugagggaucgaagccagugaaggugccugagaacccacccuccauggucuuuaagcagauggaacagguggcucaauucuugaaggcagcugaagauuauggagucaucaagacugacauguuccagacuguugaccucuaugaagguauaaggaaaaaagggcuggagccagugggcgaguggagagcaagauuaucagucaaggagaaggaauaucaaaagccacaaccagcucuguugauguguucauagcaggaaugggauaugccaagagaacacauagcaaggggaccagcuuggugguacagcauuucccuucuggguacaagggccuguuuuggauccuagaauaucaaauauauaccacaccauacucacuaggguuuagaauauggucucuugaacccucuugauuuggugccacuugcucuugguuggaccauuuuugaagcugggcagguauugccuauaugguccugaaauuagcucccuggccacucuucucauagguaaggauauggcagcagugcagaggacucuaauggcuuugggcaguuuggcugugaccaaaaacgauggaaacuaccguggagaucccaacugguuuaugaaguauguguccacugggucucucugugggguugggguggcuugggcuggucaguugugguaaagaucagguguagcagagccagggacgucccagguaaggguguuggacuaggggaaaugagguccuacuucugcauuccuaccuuuugccagcgugugcuccaccaggcucccuaacuccuggagccaaacucaggggaaaaaaagagaagacaaacaggaaaggaagggagucgaacagggaagcagcagggaucaggaaacaguuggagaacacuaaguucuagcaagccuuacccugguuccuuuucuucuaggaaagcccaggagcauaagagggacuucacagacagccaacugcaggaggggaagcacgucauuggccuucaaaugggcagcaacagaggagccucgcaggcuggcaugacaggcuaugggcgaccccggcagaucaucaguuagaaagggaaggccagcccugagcugcagcauccugcuuagccugccucacaaaugccuauguagguucuuagcccugacagcucugaggugucacugggcaaagaugacugcacaugggcagcucccaccuauccuuagccucagcccagcaucuuaccccagagccaccacugcccuggccccuguucccagcuguacccccaccucuacuguuccucucauccuggaguaagcagggagaagugggcugggguagccuggcuguaggccagcccacuguccuugauaucgaauguccuuugaaggagacccagcccagccucuacaucuuuuccuggaauauguuuuuggguugaaauucaaaaaggaaaaaagaaaaauauauaaauauauauauauauacauguaucuccaucuuuucuccggccuggcuggcaguuugguuugucacuccuguuagcauuccaggaacccugaggguggaagcauguugggcucacacguuccuggccgauggcuucuggaugacuccucuggccccacaggcucagagcuucagaggaagcaggcuauggagaagaagagugaccugcaucugcauagcucugguuuggcagaaggagagaauacugggagugguggacuuguuuggguuuuuauacuucugcuuuuuauuuuggaaagcugugcagaaaaaaauucaacaaaauguugcuuugaaaaguaaaaaucaaaucuuaagca

SEQ ID NO: 5073 - RNA, 18144 nt, Mus musculus
ugcuguccccauauuuuauuuguauuucuuauucguaggacacagucccuggaguggaaugacuggguugaaggguauagagcucuuuuaagccuaagccaaaacaguuccucagaaagguuuuugccaguugacaacgaaaggucagaaucuuuccgugggcuuuguucaaacaaacaaagcaguuucugcagaguagggacagagcucacagguuggaaggcauccugguuauggugcccugguucugguuauccccucuacugugagaggggagcggccgcugagcugcucucagugggcaggcgcuuuuaugagccaaugagggaaaaagaaugaugcugggguaaugauuuuggagcacaauuccugucuugagcaaagaaaucaucugucagcaagacccugcacuuacugggcucugugaaucuugccagcaaugccaacacccagcaguagaggugggaggaggaucaggcguucaagacucuccaaacuuacacgaccaguuccagaccagccugaguuaugugagccgucucaaaaagccaaaaaaacgcggaccacaaaagcaagaauccaauacuuagugauccuucgugaaaaacccaacuccagacgcucacaggacagcgaaggaaggaggcggcgacggcugcgugggaaguagaggcagccuggcccuuuaaauccgcgucgguuucccaugacguaagcgggcgggcacagcccgcuguuuaccgcggcgcagcuccugguagcuccgaguucugcgccgcguccgccgcccuuaaagggcccgcguccgggaagccuucgggccagggccaccgccgccucggcucuccgggcgcgagcggacgccgggucuccagccgggcugggccgggcugggccgggcugggguagcgggucgcggugccgcccucgcgagccgggauccgcgcgaggcccaggagcggcuccagggaggggacgcguccuaucugaggccgggguuaaaguucuggucccggugagaugcuggaagcugcugcggcagccgcaacgcgcccggucgccgucccgucgccaauccccgccgucccgggccaugaucgccuggcgucugcccuugugcgugcucuugguggccuccgucgagagccaccugggggcccuggggcccaagaacgucucgcagaaagacgcggaguuugagcgcaccuacgcggacgacgucaacagcgagcuggucaacaucuacaccuucaaccacaccgugacccgcaaccgggugagcgcgggacuccacgggcggccgagcgggugggcgcccggccuggacuugaugcugccccuuuccucuccgccagccuuugagccgcccucccccugccaagaccugguuuccaccagcauucccgggcagcuccagcggggcagcuugggaaguucccugccaccagcugugaucaggaccggucuggucugcucugugaccuggcucucaaucuagcucucagucugugaggucggggugaggggaaaacaggcucccagccuugcguggcucagacaacuccagauggggccaacuuagaauugaaagagcucggucacagggaggugaaggagacagaccuccuugccucagaaagccagcuggccuuguaaguugaaggugacaagauaaggcccucgaaggcugaguggcaagagaaaagggaguuuguuucuaagacagaacuaucuccgacuucuuacucauuucuucccaguagugaaaguagaaagaaggcuggcagagcugggcccaggcagagcacagccugggagauucuugcugccuggcuguguggccugccuagcucucuugcucauucuccaaggcccgaucuggauugacucggaagcacuggaguugaggaggaggcaccugaggcuuucuuugggagggagaggaguuugguuucuggcaggccaugaucaaccaucaggauccauuuccuugaagucugaucuccccuuuugaguaccauuuccaggaucaucccggaaguggcaccuaccccucagggaaacguuaccccuagauuugguuucagcaaccuaguaacuaguugucugcaguugugauuucuucacuuuuaaacgcccacuguccuguguagcuuuguccgcagcagagaggguggguuauuucuuuauuuucuuagagagggugaaucaagguucagauggaaagucacuucagagcuuggcccauggucagaacuagagagacaacuuguauuucgacacaguucccuacaccccucccugcagggcucuggccuccagaguagcaguggaaccggagcuucuugcugcuuuccuaguucaugaggaagaagauugagggcuugagggcacgucuugaucucccgugacagugugugcacagggacguguguagacacgugucuauaacaugugugugcaugugggcuauccuggaaccuucuaaggucuccgcugcauaucccugcuguugccuggguucugcugcucuguauacccguucuuccaagagcgagcuucuucaagccucggaccggacagugucagucauuucuagaaacuuggccuguucccucacaaggagaagcacagacaguguccuggcuggccaggauggacggcacagggcagagcucagccugcagucuguagagucaugugucugaggaacagagagcugaguuugaaagaggaugccuccuucucugcagaccgagggugugcgagugucugugaauguccugaacaagcagaaaggggcgccuuugcuguuugugguccgccagaaggaggcuguuguguccuuccaggugccccuaauccuucgaggacugugaguaagaccuggggauguagggaggggcauccuugccagguuuucagggacccucacccggggaaccuuuuuguuuuucucccuucucccugagcccaguggcaggaggguaacuuugucagcccagggaaugggaaauauggggaccugauaggaagaacucaggcuggcugggacuagucacacucuucucugucuuggaccauagauaucagcggaaguaccucuaccaaaaaguggaacgaacucugugucagccccccaccaagaaugagucugagauccaguuuuucuauguggacgugucuacccugucacccgucaauaccacuuaccagcuccgagucaaccguguggacaauuuugugcucagguauugaggguaagagagaggggaccucacagccucugccuucuucccaagugcugagcguaauuguaggguuccucucuucccuguaggacuggagagcuguuuacuuuuaauaccacugcagcccagccccagguaaaaucccuuaucaaaauggggucccucagccugacguggucacacaugccuuugauccuagcauuugggagucagguggguuucuugaguucaaagccagcuuagucuacauagugaguucuaagucaccaagguuacacagagaaaccuugucucaagauagcaacaacaacaaaaaagaaaauugggggagauuuggauaugagagcaggaguagguacagaauugcuaggacuagcaauuaauuuugucucuagggugggacucucggagcuccuguguggauagacaggcagggacagugcagugacagggucugcucacugacuuuccuacucugccucucaggcacaauccuaugugcccagcugacacacaggauaucagugcucagggacaugcaggacugggauguucacggucaaggcucuucuccccucguagcuucauugucugagccaagaagauucugaaaccucccuuggaggagacagaucccuucggaggggcagagagagcacccuccugagaugacacucucccuuccuauguucucaguacuucaaauacgaguuuccugaugguguggacucgguaauugucaaggugaccuccaagaaggccuuccccugcucagucaucuccauccaagauguccugguaagcugucugucauuuuauccuccaucagaaaguaguugggacauuagcagaggggacagggcccaguuccccauccaucugccucuuccuuccuuccuccacagugcccugucuaugaucuggacaacaauguagccuucauuggcauguaccagacgaugacuaagaaggcagccaucacugugcagguaggaaaugcaugugcccuucugagggauggacggggcuggcuguugaaguagaugccucuccacacccuguccuuguccccauuccugccuuaagauucuuaaacuuuuucacuugaccuugugcugccugagaaacuuuucuccgcugaaccaugucacuagcucuuaauuuuuuuuuuuuuuuuaaaaucggcaaagcaaaggauuuuacucagauauaacguggaggcaccggccagauaugcuacaagagagcagcagagauuuacuucgaaaccauauuuuuguuuuauaaugaucaguguugagggugccacuuugcaucaacguaugguaccauguggcagaaacacuuuuagggccauuuuagaaacuguugaguucucucuucagcaacacagacacugaaguuggaaugguauagacuauuaguguggcccccugugcagagauggcgugcaaauucgugaggcguucuauauauuuuuuuuuauuacaaggaugugcuuuuuuuuaaaaaagauuuauuuauuuauuauaaguaaguacacuguagcuguccucagauacuccagaagagggcaucagauuucguuacggaugguugugagccaccaugugguugcugggauuugaacucgggaccuuuggaagagcagucgacacucuuaaccacugagccaucucgccagccccuauauuuuuaaaaaagauaauuguuaaaaaucuugucguaaucccaaaucaaaucucauugaguccuuugggaauucagaacaauuauuuaaaccacacauccuuaccuagcacaauccaggaagaccaaggugcauugauuuuauccccacgugcuugaggucaggcggucggaaaacacaaagucuuuuuuucccauuacugaagguuucugugagagcagaaaacuuggggugugcaguaaacaccccgcauuucagcgugugcaguacucuagcacccaagcugaguuucagacaguguuccuuggcgucgugugcucugauggcguacaugguacaaagagcacguguguguucagaaucagggcugaggugacaccaccugauaacagcauggcugagugcuuuuagaagcgccuuggaugcagugugcguuugauuuugaaugauuuucgguugucguucguucagaaacauuuuacuguugcuugauguuuuaccaccccccgcauccugcuccuauguucucugguauaugugaguagggccaucucuggcuggugcccaggacaagcugugugcaccgcauacgugcucacuuguucaccagauuguagcauggguauggguuugggcccuaacccuaacuucucaaggccugugugacaaagauaauggcagcuccucucccgugggugcagcucagugguagagcaccugccuggcaguugagaggcuguguauuagaucgucagcaucacagaagugugaggcaagagaucuaugcaaggacuggguaaaacuauaucuagaaagaggcuuguagcuucugguccaaaguucauauucagaaaaagacggcaacaguaauguucaccagcauccuccuccucuucccccuccuccuccuccuuucccuccugcagcggaaagacuuccccagcaacagcuucuaugugguggugguagugaagacugaggaccaggccugcggaggguccuugcccuucuacccuuuuguggaagguauguuucauguacugguuugggauggaucaggcucaguggcgucccaggagauagaaaggaccauguggcuguugguggauccacugggacacaagccugggguccuagacucgccaaggccuggcuccaucagcccuagcucaacucccagcaaugacuucuuuuccacuuugacauuuuacuuccagaugagccaguggaucaagggcaccgucagaaaacacugucagugcuggucucucaggcugucacauguaagugugggcaccugagugugaugagaaaagcucccucaggcuuccucucagacccaagaaaaagcagcuguuuucagaaugggaggaguggcgaggacccuccuacccagcaggagcugggacaccggcaagcaggcuuccauccagagagaugccaaaggcgaucccuguguaauaugggacaggguccauggacaaacugacgagcaaaaucucagugacacccugccucuuagcagaggaaucugugcccugucucugugacagaaguaguaagaucuaucccacuggauacauucgguugugaggcuuagcccagaguuagaguauugggccccuagucagugcugagcaaugccuauuaacuuuuucaguggaguccuuucuaaacuggacucuaaggagccgggcauggugguguacccucuuuaaucccagcguugggagguaaagacaagaucauagcccagacucacccuuccuuauaucaugaggucaaagccaauuugaauaugagacguugucuccaaaaaaauguaacaguaaaaaguaaccaggcuggagaaauggcucagcuguuaagaacacugggugauuuuccagaggauccagguauuauuccacagcacccacguggcagcucacaaggcaccuggaacucugguuccaagggaucugauccuuugccuuccacaggcuccugugggcgauacacauacauacauacauacauacauacauacauacauacauacauacauacauacaugcgggcagaguacucacgcauacaauacaaauaaaugcaucuuuuuuuuuuuuuuuuuuuugguuuuacgagacaggguuucucuguguagccuuggcuguccugggacucgcucuguagaccaggcuggccuugaacucagaaaucagccugcuucugccucccaagugcuggguuuaagggugugcgccaccacgcccggcuaaauaaaugcaucuuaaacaugugauuauaagcccaacucacacuaagucaauuaauuaguuaaaaacaaaagagccaaauuagggcuugugcuagaaaggggacucaguacucacugagcccuggugugugcuagcagugcagcucuuaggaaggauggggcccggagggcuguguaggguacagagagcugggaugagcaaaggccaggucacuguguggcugucgagggcaccgucucugagcuauaguuugaacuuagguccacauggaguugacuccaaguaggagagaaagccuuagggaacaccaugagcagguaggcucgugccagagucugguguguugaccuauagccagauauucauacugucugggcauugccuucaggagagggggcagccagagcucagaggucccugggcauccagaggcgguguggggagggcugcuguauucuugacacauucaucuuguuccccucccuguagcugaggccuauguuggugggaugcucuuuugccugggcauauucuuguccuucuaccugcugacugugcugcuggccuguugggagaacuggaggugaggcggggcugcugggcuguucccugcucugcgccgucgggcugagggcaugggagagagaguagugggauccuagcuggcccagggcgaccuuguucuugucucaaggcacuacggaacaggaacugguugggaucugggauccaugaaccauuucuuuguaaaacaggcucaugccauugcuccuccccaagcugggaacaccccguuacuccugggguggaggaacucaggaucaggguggguagagaggauagaaggaagguuagucuggccuagggugaggccucauccugccucaguuguccccugaauuccugcaggcaaaggaagaagaccuugcuguuggccauagaccgagccugcccagaaagugguaucugcaggggacaggggcuggcuggaucuguuguggggagaugggagcagggauggguagggaauggucagaagaggguggguugguggcuucuuuauguucggccuaggaguaacauuucacaacuggaaccaggccuuggcucaccccuccauagacaccaggaaacugcccuaugucucaggcagugcggcccagccucagguuguuaacuuccaauucucucucucucuuccaucacuucucucugcccucccuccugcuuggaccucucucucagcuucucuccuugguaagcuccaggugcugugggcagaggagcugcugucuaggggcggaaccugaagcaucggcgcuuccuagggagggaccugggcacagauagcaucuuccuugauggcuuagauguguuaguuccuugacuguccucucuuuguguuuucuuuuuuuaaguuuuuagacaagaucucauucauagcccagagaagucugaaacugaauauguagcccaggcuagccuaaaaaacguauagcagucuuccuaucuuagccaggcgagagugcugggguuacaagcaugaaccaccaugucugguuguccccuuuucuaagaggacacagggugucacacuugcuuggagugacguaauugugaggguucgguggguuugggcaccuguguuucucuuacugcuggcauggcucuucuggcugucuuucccagguucuccucccccccuccccuccuccccuggcucacaagccuccucauuacaggucacgcccgggucuuggcugauucauuuccuggcagugccccuuacgaggguuacaacuauggcuccuuugguacguuucagucaggacuguguuugcccaugcccagccacagcacccugugccgccacucgugacggccgugcccuugcagcugcuccgaaguccuuaggagcagaucuagggucucuuguccugaggucgcuccuucccgccucaccacccauuccugccugcagaaaaugguuccggauccacugacggguugguugaaagcgcagguucaggggaccucuccuacaguuaccagggugagugggccaggcaggaggaugcacguuagggcugcuguugacuagguggaguuuccuggugggcgguugccucucugccauuugcuggaaccagggaagggcugcucuuccgccccaucucccucucugcuccgcggacucgguuccccuguaacuuucccuuuccuuucaagggcacgaccaguucaagcggcgccuucccucuggccagaugcggcagcugugcauugccauggguagauguggggaggggguagggcugcccuaccaaucaauuccugccaggauggucaguccauggaacuggcugccucugggaccagaaaaaugcuuagugcauggcuuuccuagcaagugccaucugugccagcccguggucuucugagaaagauagccacuggccaccaucagugucccaccucaguguccucuugucaguauccucccucccuggugugcuggccaagggauccuggaucugggugucaccuaggggcuuuggccagguggggugacaggaggaggcuucuggagguaggagagagguguuuuuuccucaagcccuugucuauguacuaggaccucagggguggccguggcaugucuucucagaacccaacaggacggggcaccucuaaucugcaugauuggccaaguucaauccuguuagugugugugugguuuacucagugucuuggccuggaucagagccaggaguggagcagggcucgagucacuccugcuccacgggguccggcagagcuccccaccacuucccgcugagcuaggaguacguuuccugccagcaccugggccaccugcccuaccgcucugagcucuggcccacaguuugccucuuccccauuguugaauaauuuugacauugcuucugaugggugggggcagacccaguguucgguccugcuggcccaagccccuuuccuuugucacaccuagaccgcuccuuugacgcaguggguccucggccucgacuggacuccaugagcuccguggaagaggaugacuacgacacacugacugacaucgacucagacaaaaacgucauucgaaccaaggugagacauauagcccugccaugcccugcccugcccagacggaucuggagcaagggacugugugcagcucccguggcgaaucacugugcuguguuuggaaggcagagggaaaagaacugagcugggacaggcaggaccgacuccaggagaagucggccuggggagaucgggacuaauuaagcagaucuuguuggcauacuugaccacagaaguguggagucucagaacccugcccacugaguucuggcuugucugccuaaccuggggaucagggguucagcgaggcucauuccugcuucuccucagcaauaccucuguguggcugaucuggcacgaaaggacaaacguguuuugcggaaaaaguaccagauuuacuucuggugaguggcacuccuguuagcgaguagggcagcuccucaggcccugccaaccuuaccuuggcccuucccccucaggaacauagccaccauugcggucuucuacgcacuuccuguggugcagcuggugaucaccuaccagacggugagaggucgaggggugggucuuggucuguaacucugccuuaucugcagugagcauagguuauagguuguggcagcaguuuucaaaucccaauucugcuuuagcugugagucucugggcuucuaagcuccaguuuuuuucaucugcaguuugggggcaacaugaagcugggugggaccuaugaaacagaggucacaggacuuuuuaagugugacuuccuuccccuuccugugaggcaaggacuucuggaguuuucagucacuguaucuauaaagaggacgauggcgcccgugccaccuuagcaguauaaggaguaccagccuggguacuguguacacacuucagccaugcugguacugcucuuguuuugccaguuggacccaggguguguggcaugggcucccugcugagucaggcauguuaauagcuacacuccucccccauacacacacagguggugaaugucacagggaaccaggacaucugcuacuacaacuuccucugugcccacccgcugggcaaccucagguggggauugugcuggaggcccagggauggguagaguaggcagggugggguuuugugaagccugcugggcagaagacagaaaaggcaagagggcccuggucucagcuaagccuguccugucccuuccagcgccuucaacaacauccucagcaacuugggguacauccugcuggggcugcucuuccugcucaucauccugcagcgagagaucaaucauaaccgggcccugcugcggaaugaccucuaugcucugguaagccagcuaccucccacugcgacauggccuccaucuggcagacugaccucccccaguccagcucugcuccaucuagccccacacuacccugcccugccuaggucugcccagcccugcccugauggguucugcccugcccugcccagcccagaucugcccugcccugcccugcccugcccagcccaggucugcccugcccugcccugaugggggucugcccugcccagcccagcccagaucugcccugcccugcccugcccagcccaggucuguccugcccugcccugcccugcccugcccugcccugcccugcccugcccugcccugcccuaauggguucugcccuacccagccuaguccaggucuacccugcccugcccugauggguucugcucugcccugcccugcccugaugggcucugccuugcccacaucucucuugcccucucugccuucugcucucccaucuacucuugcuuuucccugugugcccuaucccugcucagcuguuuuauccugucuuaccuuguccugcccucucugcccagcccugcacaaccuacccugcuacccacucaccacacagcgcaguccucuuccacaccccuugggucuccucuucccaccucaccugcacgucucuuccuucucuuucuccccacaggagugugggauccccaaacacuuuggucuguuuuacgccaugggcacagcacugaugauggaggggcuacuuagugccuguuaccacgucugccccaacuacaccaacuuccaguuuggugagugcugccuccugucuggcugaaucugcugucccaggucaccagcugcuagggggcucugaggcuggccucugagugcagcuuccauucuagaagauggcuaccugugcugccucuucccagucaucccacagaaacucuaagaaucucaggaagugcucccuaacuucugcguauucauauacugagacccucaaacuaagauguccuugacuugagggaacaacagacuagcaagugguaggauucaggggcagcuaaggggcuaaagcugaagcagugacccuucagcuugcugauggcacuccagaggucuugauugucugggcugggaguuguguguggggucccugugguaucugcagcucacagccuguuccuccccagauaccuccuucauguacaugauugcuggccucugcaugcugaagcucuaccagaagcggcacccagauaucaacgccagugccuacagugcauaugccugcuuggccaucgucaucuucuucuccguucugggcguggugagggccuggucuacucuguacaccccguaggaagggcacgucccucccccuaacacccaccccacccccaccccgugaguguguauucaucugggcuuccacugcaggagagauccuacugcuucccuaaggggccauucugggccccucuguaaucgaagccuaacccagcagcuugugcuaguaggggugcagacacaggacacgggagcagguaccgucugcgccccucacucgugugggcuugcccacagguguuuggcaaagggaacacggccuucuggauugucuucuccgucauucacaucaucuccacccugcuccucagcacucagcucuauuacaugggccgcuggaagcugggugagagcagcacacgcccagggcgggacagaccggguggggcaggcgcaggguggugguggugguggggacacaggggaccuuugaugucucuuccauuugaccgggcuggacgagucccugggugggaaauugagcgugcucccugguguuacugagcugugcccucugaagucucagccaugccuugucggcaccaccccuucucacugcagacuccgggaucuuccgccgcauccuccaugugcucuacacagacugcauccggcagugcagcgggccccuuuacacgguaccugcucagcuccccaacuccuuccuccucagucuccccuccucagagaacccagcguggggugggugcuggcugacaugagccuucuaccucuucccuccccaucucucucucccucucaguccccgugucucugcuucccuccaggaccgcauggugcuucuggucaugggcaacauuaucaacuggucgcugugaguguggccauuggcuguggaguuagcuggggacagacauagucagccaguggcugacauaagggcaauggacaguuugcuaaagaacccugggcuucuagaaccuucuaugagccucugaauguaguccaaaacaacgaugaagcauggugggggugcgugcgggcagaggugaggcccucccuccccagaacccaccccuucuuucagggcugcauacggacucaucaugcgccccaaugacuuugcuuccuacuugcuggcaauuggcaucugcaaccugcugcuuuauuucgccuucuacaucaucaugaaggugaauggcaaagguggagcagcugcucugcucuauggggacagagccgggcacugggagauucugucuguacauaugucuguccauauguccaugccagugagguuugggggauuggguggcuugagucuccccuguaaauacuccugggagcugcuugcuaggcuugugcucugccaccaagccacgccccuagccuggguccccugaaccugugauaggccaggcccuugaggacgggcgccucccaguggcccuccagguuguaccaugugagggagcugccagccaaugcuuuuguugguucagggauguggguauauggacaccuaguucaaaguggccaugggguaaagacacagggcugccagcacgagacuugggugagcucugcgguggagccuguaaagcugggaggggcccaggugggcggcggccgggcugacggcugcgggccucccuuagcuccggagcggcgagaggaucaagcucaucccucugcucugcaucgucugcaccuccguggucuggggcuucgcgcucuucuucuucuuccagggacugagcacguggcaggugaggagccgcccgccgccaggcucguagcaagcuaaccuggggugaauucucugccuugggccaggccuucccgagugacuugucauuauagccuccugaugcucaaucugccagcauggaacucuggaccuguuacuuuaacggcagcugaguuucaaagaggcccagggcuuuuccccagcauagagcguguguguggcagcugugguuugaagugggacacaucaguuucuuuacugccucaaaggacaccuggugugcaucaaacuauaaaucucugauagaacugaaagucucugcuggacauugugguggacgccguuaaucucagcacauaggaggcagaggcagaggcagaggcagguggauccccaaguuugaggcuaaccuccucuacagagugaguuccagaauagccagaugcuacacagagaaaccgugucucuugaaaagcaaaaagcauaacaaaaauagaauugaacauaacauggccucugccugcgugacauuggacuuacagucuaguucaaaagagacacugcuagcucacguugggguuuuguucuguuuuaaggccagggaucaaaacugcccuuguacuugguaagcacauacucugccaccgagcuccauccccacaccuagcuuaugugugaaaugaaaagcagcggagucaggguaguggagugugcagaagaggauggcgagcgagcgagcaagcagcggagucaggguaguggagugugcagaagagaggauggcgagcgagcgagcaagcagcggagucaggguaguggagugugcagaagaggauggcgagcgagcgagcaagcagcggagucaggguaguggagugugcagaagagaggauggcgagcgagcgagcaagcagcggagucaggguaguggagugugcagaagaggauggcgagcgagcgagcaagcagcggagucaggguaguggagugugcagaagaggauggcgagcgagugagcaagcagcggagucaggguaguggagugugcagaagaggauggcgagcgagugagcaagcagcggagucaggguaguggagugugcagaagaggauggcgagcgagcgagcccucuaagucaggaggucugggagcuucuugaaggaggcagacuuugcucauggccagaaagucccauggauagagcuacauagcacuagcagugucaccugagcacugucacccuguugucacacagggccgaaugaccaaggcagcuuugauguaugagaacacacugauucgggagcuuggcaaagaccuagcgcucuauggggucagaugugucuuggucuguggccucagcacaggauguacccgacacagggucagaagauguguguggcagcaaggugggcagagcggggagggacaggagcaucgcagcaugaccuaguguagucacuggcaggaaaccuacccugagguauuuugaaagcaaggccaagucccaggcagguagugaguuggggcuucugggccuccuggcuuucugaguagaagcuguaaugacagugugcugcccacaucucuaaagggaagaugggucuggaggaaggagcagaaucaguguauuuaagaaaagcuguuguuagcuguggagggccagagugaggcaugagccagaacgggaugcucuccuguuagggaccagggggugccauggaguggguuggaggcagguguggagcuggucucugcagagcagacucaguaggcugcuggcucucuccccugccagaaaacccccgcagaguccagggagcacaaccgcgacugcauccuccucgacuucuuugaugaccacgauaucuggcacuuccuguccuccauugccauguuuggguccuuccugguaugugggaugugccuggccugagggcagaggggaugguagagcagacagccucuccuucccaggaucugacccuccacccacccuuagguuuugcugacguuggaugacgacuuggacacaguacagcgggacaagaucuaugucuucuagcagcaucugugguccaggcuucaccucacaggccuagcgccugccucugcaucaccugccaguugccacaagaacaccacggguaugagucccagcucugcugcccagcauuggaugucguggcaagacagcgagauuccagcccaggccugacucaggauaguuccugguggcacugagccuuggaguugccucugcggaggaggaggccugcuccgcauuccccagacacuggccaaauugcugcuuucuucucaguguuggguccuccccaggacccuagucuguccaucugucuuguuuauccacuggcucuccauuugucccuuuggagaggaaggugggaaggcaauguccugucccauuucaugccuugcauucugcccaucccuucccuccucucagcuuaggacacacagcccuuucuucuucccaugcucuguccaggaccacagucuggugccugauucuuuguccaucaccaggaccuaagcucucccugggucuguagcuggcugcuaucacugcccacucugaccugccaggacagaugcagguaggagacuuugggggcuggccagcuggugccaggcuuucggugcuaaggccugcaaggggccuagguacgacccuccucccugaccugugcuuggagcuggcucuucagcagugagggccagcccaaguugagucuucugaucggggacugaauucagaggccaccucaucccaccagccacuagaaugaugccagcacuaggguuggugggaaguggcaacucacuguccccuuccacacccucaguccugccaagccccagaugggggccucucagugccauugacacugcccaagaaugucuagaggccacggaacggugccaagcacacagucccuuuugccucuuucacgggagcaggagucccagugccugucguggaaagggaggaacaugccaggucccuguguguccuuggcccugucucaccaaaggacucagggcugguuucugaguuuccguccaguauuuagccaaguucuguguuagucacguaggccuaagagccuuggcguuuacagagucacccagcucuggccccuggccauucugguccuuggcguuuacagagucacccagcuccaggccccuggccacuuugguacuugguugcccuucacuccaccagguccauuccagaugccaagagugggccccaggaauguguuuccuucucuccaccauguuuuuauagcucuugggcugggagaagaggcgggucugggucuuuguuucugagcuuuguucuauguuccuccaugcuacgguugcaauuguuuucuaugaacgaguacauucaauaaagacaaccagaccugggauuuggggucuuacugau

SEQ ID NO: 5074 - RNA, 2015 nt, Mus musculus
cucaaaaggggagaucagacuucaaggaaauggauccugaugguugaucauggccugccagaaaccaaacuccucucccucccaaagaaagccucaggugccuccuccucaacuccagugcuuccgagucaauccagaucgggccuuggagaaugagcaagagagcuaggcaggccacacagccaggcagcaagaaucucccaggcugugcucugccugggcccagcucugccagccuucuuucuacuuucacuacugggaagaaaugaguaagaagucggagauaguucugucuuagaaacaaacucccuuuucucuugccacucagccuucgagggccuuaucuugucaccuucaacuuacaaggccagcuggcuuucugaggcaaggaggucugucuccuucaccucccugugaccgagcucuuucaauucuaaguuggccccaucuggaguugucugagccacgcaaggcugggagccuguuuuccccucaccccgaccucacagacugagagcuagauugagagccaggucacagagcagaccagaccgguccugaucacagcugguggcagggaacuucccaagcugccccgcuggagcugcccgggaaugcugguggaaaccaggucuuggcagggggagggcggcucaaaggcuggcggagaggaaaggggcagcaucaaguccaggccgggcgcccacccgcucggccgcccguggagucccgcgcucacccgguugcgggucacggugugguugaagguguagauguugaccagcucgcuguugacgucguccgcguaggugcgcucaaacuccgcgucuuucugcgagacguucuugggccccagggcccccagguggcucucgacggaggccaccaagagcacgcacaagggcagacgccaggcgaucauggcccgggacggcggggauuggcgacgggacggcgaccgggcgcguugcggcugccgcagcagcuuccagcaucucaccgggaccagaacuuuaaccccggccucagauaggacgcguccccucccuggagccgcuccugggccucgcgcggaucccggcucgcgagggcggcaccgcgacccgcuaccccagcccggcccagcccggcccagcccggcuggagacccggcguccgcucgcgcccggagagccgaggcggcgguggcccuggcccgaaggcuucccggacgcgggcccuuuaagggcggcggacgcggcgcagaacucggagcuaccaggagcugcgccgcgguaaacagcgggcugugcccgcccgcuuacgucaugggaaaccgacgcggauuuaaagggccaggcugccucuacuucccacgcagccgucgccgccuccuuccuucgcuguccugugagcgucuggaguuggguuuuucacgaaggaucacuaaguauuggauucuugcuuuugugguccgcguuuuuuuggcuuuuugagacggcucacauaacucaggcuggucuggaacuggucguguaaguuuggagagucuugaacgccugauccuccucccaccucuacugcuggguguuggcauugcuggcaagauucacagagcccaguaagugcagggucuugcugacagaugauuucuuugcucaagacaggaauugugcuccaaaaucauuaccccagcaucauucuuuuucccucauuggcucauaaaagcgccugcccacugagagcagcucagcggccgcuccccucucacaguagaggggauaaccagaaccagggcaccauaaccaggaugccuuccaaccugugagcucugucccuacucugcagaaacugcuuuguuuguuugaacaaagcccacggaaagauucugaccuuucguugucaacuggcaaaaaccuuucugaggaacuguuuuggcuuaggcuuaaaagagcucuauacccuucaacccagucauuccacuccagggacuguguccuacgaauaagaaauacaaauaaaauauggggacagca
